United States Patent 9,205,144 (IDENTIFICATION OF CONSERVED PEPTIDE BLOCKS IN HOMOLOGOUS POLYPEPTIDES) - sequence listing, part 11

SEQ ID NO: 403219 - protein, 11 aa, Influenza virus
PNDERGNPGVK

SEQ ID NO: 403220 - protein, 11 aa, Influenza virus
NDERGNPGVKG

SEQ ID NO: 403221 - protein, 11 aa, Influenza virus
DERGNPGVKGW

SEQ ID NO: 403222 - protein, 11 aa, Influenza virus
EKGNPGVKGWA

SEQ ID NO: 403223 - protein, 11 aa, Influenza virus
KGNPGVKGWAF

SEQ ID NO: 403224 - protein, 11 aa, Influenza virus
GSPGVKGWAFD

SEQ ID NO: 403225 - protein, 11 aa, Influenza virus
NPGVKGWAFDN

SEQ ID NO: 403226 - protein, 11 aa, Influenza virus
PGVKGWAFDNG

SEQ ID NO: 403227 - protein, 11 aa, Influenza virus
GVKGWAFDNGD

SEQ ID NO: 403228 - protein, 11 aa, Influenza virus
VKGWAFDNGDD

SEQ ID NO: 403229 - protein, 11 aa, Influenza virus
NGDDVWMGRTI

SEQ ID NO: 403230 - protein, 11 aa, Influenza virus
GNDVWMGRTIS

SEQ ID NO: 403231 - protein, 11 aa, Influenza virus
DDVWMGRTISK

SEQ ID NO: 403232 - protein, 11 aa, Influenza virus
DVWMGRTISKD

SEQ ID NO: 403233 - protein, 11 aa, Influenza virus
VWMGRTISKDS

SEQ ID NO: 403234 - protein, 11 aa, Influenza virus
WMGRTISKDSR

SEQ ID NO: 403235 - protein, 11 aa, Influenza virus
MGRTISKDSRS

SEQ ID NO: 403236 - protein, 11 aa, Influenza virus
GRTISKDSRSG

SEQ ID NO: 403237 - protein, 11 aa, Influenza virus
RTISKDSRSGY

SEQ ID NO: 403238 - protein, 11 aa, Influenza virus
TISKDSRSGYE

SEQ ID NO: 403239 - protein, 11 aa, Influenza virus
ISKDSRSGYET

SEQ ID NO: 403240 - protein, 11 aa, Influenza virus
SKDSRSGYETF

SEQ ID NO: 403241 - protein, 11 aa, Influenza virus
KDSRSGYETFR

SEQ ID NO: 403242 - protein, 11 aa, Influenza virus
DSRSGYETFKV

SEQ ID NO: 403243 - protein, 11 aa, Influenza virus
SRSGYETFKVI

SEQ ID NO: 403244 - protein, 11 aa, Influenza virus
RSGYETFRVIS

SEQ ID NO: 403245 - protein, 11 aa, Influenza virus
SGYETFRVISG

SEQ ID NO: 403246 - protein, 11 aa, Influenza virus
GYETFRVISGW

SEQ ID NO: 403247 - protein, 11 aa, Influenza virus
YETFRVIGGWA

SEQ ID NO: 403248 - protein, 11 aa, Influenza virus
VIGGWATANSK

SEQ ID NO: 403249 - protein, 11 aa, Influenza virus
IGGWATANSKS

SEQ ID NO: 403250 - protein, 11 aa, Influenza virus
VDNNNWFGYFG

SEQ ID NO: 403251 - protein, 11 aa, Influenza virus
NNNWFGYFGIF

SEQ ID NO: 403252 - protein, 11 aa, Influenza virus
SNWSGYSGIFS

SEQ ID NO: 403253 - protein, 11 aa, Influenza virus
NWFGYFGIFFV

SEQ ID NO: 403254 - protein, 11 aa, Influenza virus
WFGYFGIFFVE

SEQ ID NO: 403255 - protein, 11 aa, Influenza virus
KSCVNRCFYVE

SEQ ID NO: 403256 - protein, 11 aa, Influenza virus
SCVNRCFYVEL

SEQ ID NO: 403257 - protein, 11 aa, Influenza virus
CVNRCFYVELI

SEQ ID NO: 403258 - protein, 11 aa, Influenza virus
VNRCFYVELIR

SEQ ID NO: 403259 - protein, 11 aa, Influenza virus
RCFYVELIRGM

SEQ ID NO: 403260 - protein, 11 aa, Influenza virus
CFYVELIRGMP

SEQ ID NO: 403261 - protein, 11 aa, Influenza virus
FYVELIRGRPQ

SEQ ID NO: 403262 - protein, 11 aa, Influenza virus
YVELIRGRPQE

SEQ ID NO: 403263 - protein, 11 aa, Influenza virus
PQETRVWWTSN

SEQ ID NO: 403264 - protein, 11 aa, Influenza virus
QETRVWWTSNS

SEQ ID NO: 403265 - protein, 11 aa, Influenza virus
ENRVWWTSNSI

SEQ ID NO: 403266 - protein, 11 aa, Influenza virus
RVWWTSNSIIV

SEQ ID NO: 403267 - protein, 11 aa, Influenza virus
VWWTSNSIIVF

SEQ ID NO: 403268 - protein, 11 aa, Influenza virus
WWTSNSIIVFC

SEQ ID NO: 403269 - protein, 11 aa, Influenza virus
WTSNSIIVFCG

SEQ ID NO: 403270 - protein, 11 aa, Influenza virus
TSNSIIVFCGT

SEQ ID NO: 403271 - protein, 11 aa, Influenza virus
SNSIIVFCGTS

SEQ ID NO: 403272 - protein, 11 aa, Influenza virus
NSIIVFCGTSG

SEQ ID NO: 403273 - protein, 11 aa, Influenza virus
SIIVFCGTSGT

SEQ ID NO: 403274 - protein, 11 aa, Influenza virus
IIVFCGTSGTY

SEQ ID NO: 403275 - protein, 11 aa, Influenza virus
IVFCGTSGTYG

SEQ ID NO: 403276 - protein, 11 aa, Influenza virus
VFWGTSGTYGT

SEQ ID NO: 403277 - protein, 11 aa, Influenza virus
TGSWPDGANIS

SEQ ID NO: 403278 - protein, 11 aa, Influenza virus
GSWPDGANISF

SEQ ID NO: 403279 - protein, 11 aa, Influenza virus
SWPDGANISFM

SEQ ID NO: 403280 - protein, 11 aa, Influenza virus
SKSRGYKMNTR

SEQ ID NO: 403281 - protein, 11 aa, Influenza virus
KSRGYKMNTRI

SEQ ID NO: 403282 - protein, 11 aa, Influenza virus
SRGYKMNTQIL

SEQ ID NO: 403283 - protein, 11 aa, Influenza virus
RGYKMNTRILI

SEQ ID NO: 403284 - protein, 11 aa, Influenza virus
GYKMNTRILIL

SEQ ID NO: 403285 - protein, 11 aa, Influenza virus
YKMNTRILILT

SEQ ID NO: 403286 - protein, 11 aa, Influenza virus
KMNTRILILTL

SEQ ID NO: 403287 - protein, 11 aa, Influenza virus
ADKICLGHHAV

SEQ ID NO: 403288 - protein, 11 aa, Influenza virus
DKICLGHHAVS

SEQ ID NO: 403289 - protein, 11 aa, Influenza virus
KICLGHHAVSN

SEQ ID NO: 403290 - protein, 11 aa, Influenza virus
ICLGHHAVSNG

SEQ ID NO: 403291 - protein, 11 aa, Influenza virus
CLGHHAVSNGT

SEQ ID NO: 403292 - protein, 11 aa, Influenza virus
LGHHAVSNGTK

SEQ ID NO: 403293 - protein, 11 aa, Influenza virus
GHHAVSNGTKV

SEQ ID NO: 403294 - protein, 11 aa, Influenza virus
VNTLTERGVEV

SEQ ID NO: 403295 - protein, 11 aa, Influenza virus
TLTERGVEVVN

SEQ ID NO: 403296 - protein, 11 aa, Influenza virus
LTERGVEVVNA

SEQ ID NO: 403297 - protein, 11 aa, Influenza virus
TERGVEVVNAT

SEQ ID NO: 403298 - protein, 11 aa, Influenza virus
ERGVEVVNATE

SEQ ID NO: 403299 - protein, 11 aa, Influenza virus
RGVEVVNATET

SEQ ID NO: 403300 - protein, 11 aa, Influenza virus
GVEVVNATETV

SEQ ID NO: 403301 - protein, 11 aa, Influenza virus
VEVVNATETVE

SEQ ID NO: 403302 - protein, 11 aa, Influenza virus
EVVNATETVER

SEQ ID NO: 403303 - protein, 11 aa, Influenza virus
CGLLGTITGPP

SEQ ID NO: 403304 - protein, 11 aa, Influenza virus
GLLGTITGPPQ

SEQ ID NO: 403305 - protein, 11 aa, Influenza virus
LLGTITGPPQC

SEQ ID NO: 403306 - protein, 11 aa, Influenza virus
LGTITGPPQCD

SEQ ID NO: 403307 - protein, 11 aa, Influenza virus
TGPPQCDQFLE

SEQ ID NO: 403308 - protein, 11 aa, Influenza virus
GPPQCDLFLEF

SEQ ID NO: 403309 - protein, 11 aa, Influenza virus
LRQILRESGGI

SEQ ID NO: 403310 - protein, 11 aa, Influenza virus
ESSFYAEMKWL

SEQ ID NO: 403311 - protein, 11 aa, Influenza virus
PSFYAEMKWLL

SEQ ID NO: 403312 - protein, 11 aa, Influenza virus
YAEMKWLLSNT

SEQ ID NO: 403313 - protein, 11 aa, Influenza virus
AEMKWLLSNTD

SEQ ID NO: 403314 - protein, 11 aa, Influenza virus
EMKWLLSNTDN

SEQ ID NO: 403315 - protein, 11 aa, Influenza virus
PALIIWGIHHS

SEQ ID NO: 403316 - protein, 11 aa, Influenza virus
LYGSGAKLITV

SEQ ID NO: 403317 - protein, 11 aa, Influenza virus
SSNYQQSFVPS

SEQ ID NO: 403318 - protein, 11 aa, Influenza virus
SNYQQSFVPSP

SEQ ID NO: 403319 - protein, 11 aa, Influenza virus
NYQQSFVPSPG

SEQ ID NO: 403320 - protein, 11 aa, Influenza virus
VNGQFGRINFH

SEQ ID NO: 403321 - protein, 11 aa, Influenza virus
NGQFGRINFHW

SEQ ID NO: 403322 - protein, 11 aa, Influenza virus
GQFGRINFHWL

SEQ ID NO: 403323 - protein, 11 aa, Influenza virus
FSFNGAFIAPD

SEQ ID NO: 403324 - protein, 11 aa, Influenza virus
SFNGAFIAPDR

SEQ ID NO: 403325 - protein, 11 aa, Influenza virus
FNGAFIAPDRV

SEQ ID NO: 403326 - protein, 11 aa, Influenza virus
NGAFIAPDRVS

SEQ ID NO: 403327 - protein, 11 aa, Influenza virus
GAFIAPDRVSF

SEQ ID NO: 403328 - protein, 11 aa, Influenza virus
GGTIISNLPFQ

SEQ ID NO: 403329 - protein, 11 aa, Influenza virus
GTIISNLPFQN

SEQ ID NO: 403330 - protein, 11 aa, Influenza virus
TIISNLPFQNI

SEQ ID NO: 403331 - protein, 11 aa, Influenza virus
IISNLPFQNIN

SEQ ID NO: 403332 - protein, 11 aa, Influenza virus
SLLLATGMKNV

SEQ ID NO: 403333 - protein, 11 aa, Influenza virus
LLLATGMKNVP

SEQ ID NO: 403334 - protein, 11 aa, Influenza virus
LLATGMKNVPE

SEQ ID NO: 403335 - protein, 11 aa, Influenza virus
LATGMKNVPEI

SEQ ID NO: 403336 - protein, 11 aa, Influenza virus
ATGMKNVPEIP

SEQ ID NO: 403337 - protein, 11 aa, Influenza virus
TGMKNVPEIPK

SEQ ID NO: 403338 - protein, 11 aa, Influenza virus
CSPLSRCRKTR

SEQ ID NO: 403339 - protein, 11 aa, Influenza virus
SPLSRCRETRG

SEQ ID NO: 403340 - protein, 11 aa, Influenza virus
LSRCRKTRGLF

SEQ ID NO: 403341 - protein, 11 aa, Influenza virus
SRCRKTRGLFG

SEQ ID NO: 403342 - protein, 11 aa, Influenza virus
RKRMTRGLFGA

SEQ ID NO: 403343 - protein, 11 aa, Influenza virus
KRMTRGLFGAI

SEQ ID NO: 403344 - protein, 11 aa, Influenza virus
RETRGLFGAIA

SEQ ID NO: 403345 - protein, 11 aa, Influenza virus
ETRGLFGAIAG

SEQ ID NO: 403346 - protein, 11 aa, Influenza virus
ARGLFGAIAGF

SEQ ID NO: 403347 - protein, 11 aa, Influenza virus
GFIENGWEGLV

SEQ ID NO: 403348 - protein, 11 aa, Influenza virus
FIENGWEGLVD

SEQ ID NO: 403349 - protein, 11 aa, Influenza virus
IENGWEGLVDG

SEQ ID NO: 403350 - protein, 11 aa, Influenza virus
ENGWEGLVDGW

SEQ ID NO: 403351 - protein, 11 aa, Influenza virus
NGWEGLVDGWY

SEQ ID NO: 403352 - protein, 11 aa, Influenza virus
GWEGLVDGWYG

SEQ ID NO: 403353 - protein, 11 aa, Influenza virus
WEGLVDGWYGF

SEQ ID NO: 403354 - protein, 11 aa, Influenza virus
EGLVDGWYGFR

SEQ ID NO: 403355 - protein, 11 aa, Influenza virus
GLVDGWYGFRH

SEQ ID NO: 403356 - protein, 11 aa, Influenza virus
LVDGWYGFRHQ

SEQ ID NO: 403357 - protein, 11 aa, Influenza virus
VDGWYGFRHQN

SEQ ID NO: 403358 - protein, 11 aa, Influenza virus
NGWYGFRHQNA

SEQ ID NO: 403359 - protein, 11 aa, Influenza virus
GWYGFKHQNAQ

SEQ ID NO: 403360 - protein, 11 aa, Influenza virus
WYGFKHQNAQG

SEQ ID NO: 403361 - protein, 11 aa, Influenza virus
YGFKHQNAQGE

SEQ ID NO: 403362 - protein, 11 aa, Influenza virus
GFKHQNAQGEG

SEQ ID NO: 403363 - protein, 11 aa, Influenza virus
FRHQNAQGEGI

SEQ ID NO: 403364 - protein, 11 aa, Influenza virus
RHQNAQGEGIA

SEQ ID NO: 403365 - protein, 11 aa, Influenza virus
HQNAQGEGIAA

SEQ ID NO: 403366 - protein, 11 aa, Influenza virus
QNAQGEGIAAD

SEQ ID NO: 403367 - protein, 11 aa, Influenza virus
NAQGEGIAADY

SEQ ID NO: 403368 - protein, 11 aa, Influenza virus
AQGEGIAADYK

SEQ ID NO: 403369 - protein, 11 aa, Influenza virus
QGEGIAADYKS

SEQ ID NO: 403370 - protein, 11 aa, Influenza virus
GEGIAADYKST

SEQ ID NO: 403371 - protein, 11 aa, Influenza virus
EGIAADYKSTQ

SEQ ID NO: 403372 - protein, 11 aa, Influenza virus
GIAADYKSTQS

SEQ ID NO: 403373 - protein, 11 aa, Influenza virus
IAADYKSTQSA

SEQ ID NO: 403374 - protein, 11 aa, Influenza virus
AADYKSTQSAV

SEQ ID NO: 403375 - protein, 11 aa, Influenza virus
ADYKSTQSAIN

SEQ ID NO: 403376 - protein, 11 aa, Influenza virus
DYKSTQSAINQ

SEQ ID NO: 403377 - protein, 11 aa, Influenza virus
YKSTQSAINQI

SEQ ID NO: 403378 - protein, 11 aa, Influenza virus
KSTQSAINQIT

SEQ ID NO: 403379 - protein, 11 aa, Influenza virus
STQSAINQITG

SEQ ID NO: 403380 - protein, 11 aa, Influenza virus
TQSAINQITGK

SEQ ID NO: 403381 - protein, 11 aa, Influenza virus
QSAINQITGKL

SEQ ID NO: 403382 - protein, 11 aa, Influenza virus
SAINQITGKLN

SEQ ID NO: 403383 - protein, 11 aa, Influenza virus
AINQITGKLNR

SEQ ID NO: 403384 - protein, 11 aa, Influenza virus
INQITGKLNRL

SEQ ID NO: 403385 - protein, 11 aa, Influenza virus
NQITGKLNRLI

SEQ ID NO: 403386 - protein, 11 aa, Influenza virus
QITGKLNRLIE

SEQ ID NO: 403387 - protein, 11 aa, Influenza virus
ITGKLNRLIEK

SEQ ID NO: 403388 - protein, 11 aa, Influenza virus
TGKLNRLIEKT

SEQ ID NO: 403389 - protein, 11 aa, Influenza virus
GKLNRLIEKTN

SEQ ID NO: 403390 - protein, 11 aa, Influenza virus
KLNRLIEKTNQ

SEQ ID NO: 403391 - protein, 11 aa, Influenza virus
LNRLIEKTNQQ

SEQ ID NO: 403392 - protein, 11 aa, Influenza virus
NRLIEKTNQQF

SEQ ID NO: 403393 - protein, 11 aa, Influenza virus
IEKTNQQFELI

SEQ ID NO: 403394 - protein, 11 aa, Influenza virus
EKTNQQFELID

SEQ ID NO: 403395 - protein, 11 aa, Influenza virus
KTNQQFEMIDN

SEQ ID NO: 403396 - protein, 11 aa, Influenza virus
TNQQFEMIDNE

SEQ ID NO: 403397 - protein, 11 aa, Influenza virus
NQQFEMIDNEF

SEQ ID NO: 403398 - protein, 11 aa, Influenza virus
EVEKQIGNVIN

SEQ ID NO: 403399 - protein, 11 aa, Influenza virus
VEKQIGNVINW

SEQ ID NO: 403400 - protein, 11 aa, Influenza virus
EKQIGNVINWT

SEQ ID NO: 403401 - protein, 11 aa, Influenza virus
KQIGNVINWTR

SEQ ID NO: 403402 - protein, 11 aa, Influenza virus
IGNVINWTRDA

SEQ ID NO: 403403 - protein, 11 aa, Influenza virus
GNVINWTRDSI

SEQ ID NO: 403404 - protein, 11 aa, Influenza virus
NVINWTRDSIT

SEQ ID NO: 403405 - protein, 11 aa, Influenza virus
VINWTRDSITE

SEQ ID NO: 403406 - protein, 11 aa, Influenza virus
INWTRDSMTEI

SEQ ID NO: 403407 - protein, 11 aa, Influenza virus
WTRDSMTEIWS

SEQ ID NO: 403408 - protein, 11 aa, Influenza virus
TRDSMTEIWSY

SEQ ID NO: 403409 - protein, 11 aa, Influenza virus
RDSMTEIWSYN

SEQ ID NO: 403410 - protein, 11 aa, Influenza virus
DSMTEIWSYNA

SEQ ID NO: 403411 - protein, 11 aa, Influenza virus
SMTEIWSYNAE

SEQ ID NO: 403412 - protein, 11 aa, Influenza virus
MTEIWSYNAEL

SEQ ID NO: 403413 - protein, 11 aa, Influenza virus
TEIWSYNAELL

SEQ ID NO: 403414 - protein, 11 aa, Influenza virus
EIWSYNAELLV

SEQ ID NO: 403415 - protein, 11 aa, Influenza virus
IWSYNAELLVA

SEQ ID NO: 403416 - protein, 11 aa, Influenza virus
WSYNAEFLVAM

SEQ ID NO: 403417 - protein, 11 aa, Influenza virus
SYNAEFLVAME

SEQ ID NO: 403418 - protein, 11 aa, Influenza virus
YNAEFLVAMEN

SEQ ID NO: 403419 - protein, 11 aa, Influenza virus
NAEFLVAMENQ

SEQ ID NO: 403420 - protein, 11 aa, Influenza virus
HTIDLADSEMD

SEQ ID NO: 403421 - protein, 11 aa, Influenza virus
TIDLADSEMDK

SEQ ID NO: 403422 - protein, 11 aa, Influenza virus
IDLADSEMDKL

SEQ ID NO: 403423 - protein, 11 aa, Influenza virus
DLADSEMDKLY

SEQ ID NO: 403424 - protein, 11 aa, Influenza virus
ADSEMDKLYER

SEQ ID NO: 403425 - protein, 11 aa, Influenza virus
DSEMDKLYERV

SEQ ID NO: 403426 - protein, 11 aa, Influenza virus
KLYERVRRQLR

SEQ ID NO: 403427 - protein, 11 aa, Influenza virus
LYERVRRQLRE

SEQ ID NO: 403428 - protein, 11 aa, Influenza virus
YERVRRQLREN

SEQ ID NO: 403429 - protein, 11 aa, Influenza virus
ERVRRQLRENA

SEQ ID NO: 403430 - protein, 11 aa, Influenza virus
RVRRQLRENAE

SEQ ID NO: 403431 - protein, 11 aa, Influenza virus
VRRQLRENAEE

SEQ ID NO: 403432 - protein, 11 aa, Influenza virus
RRQLRENAEED

SEQ ID NO: 403433 - protein, 11 aa, Influenza virus
RQLRENAEEDG

SEQ ID NO: 403434 - protein, 11 aa, Influenza virus
GCFEIFHKCDN

SEQ ID NO: 403435 - protein, 11 aa, Influenza virus
CMASIRNNTYD

SEQ ID NO: 403436 - protein, 11 aa, Influenza virus
MASIRNNTYDH

SEQ ID NO: 403437 - protein, 11 aa, Influenza virus
ASIRNNTYDHS

SEQ ID NO: 403438 - protein, 11 aa, Influenza virus
QNRIQINPVKL

SEQ ID NO: 403439 - protein, 11 aa, Influenza virus
SSGYKDVILWF

SEQ ID NO: 403440 - protein, 11 aa, Influenza virus
SGYKDVILWFS

SEQ ID NO: 403441 - protein, 11 aa, Influenza virus
GYKDVILWFSF

SEQ ID NO: 403442 - protein, 11 aa, Influenza virus
YKDVILWFSFG

SEQ ID NO: 403443 - protein, 11 aa, Influenza virus
KDVILWFSFGA

SEQ ID NO: 403444 - protein, 11 aa, Influenza virus
DVILWFSFGAS

SEQ ID NO: 403445 - protein, 11 aa, Influenza virus
VILWFSFGASC

SEQ ID NO: 403446 - protein, 11 aa, Influenza virus
LWFSFGASCFI

SEQ ID NO: 403447 - protein, 11 aa, Influenza virus
WFSFGASCFIL

SEQ ID NO: 403448 - protein, 11 aa, Influenza virus
FSFGASCFILL

SEQ ID NO: 403449 - protein, 11 aa, Influenza virus
SFGASCFILLA

SEQ ID NO: 403450 - protein, 11 aa, Influenza virus
FGASCFILLAI

SEQ ID NO: 403451 - protein, 11 aa, Influenza virus
FICVKNGNMRC

SEQ ID NO: 403452 - protein, 11 aa, Influenza virus
ICVKNGNMRCT

SEQ ID NO: 403453 - protein, 11 aa, Influenza virus
CVKNGNMRCTI

SEQ ID NO: 403454 - protein, 11 aa, Influenza virus
VKNGNMRCTIC

SEQ ID NO: 403455 - protein, 11 aa, Influenza virus
KNGNHAVHYCI

SEQ ID NO: 403456 - protein, 11 aa, Influenza virus
GIVNTTLSTIA

SEQ ID NO: 403457 - protein, 11 aa, Influenza virus
IVNTTLSTIAL

SEQ ID NO: 403458 - protein, 11 aa, Influenza virus
VNTTLSTIALI

SEQ ID NO: 403459 - protein, 11 aa, Influenza virus
NTTLSTIALII

SEQ ID NO: 403460 - protein, 11 aa, Influenza virus
TTLSTIALIIG

SEQ ID NO: 403461 - protein, 11 aa, Influenza virus
LSTIALLIGIG

SEQ ID NO: 403462 - protein, 11 aa, Influenza virus
STIALLIGIGN

SEQ ID NO: 403463 - protein, 11 aa, Influenza virus
TIALLIGIGNL

SEQ ID NO: 403464 - protein, 11 aa, Influenza virus
IGVGNLIFNTV

SEQ ID NO: 403465 - protein, 11 aa, Influenza virus
GVGNLIFNTVI

SEQ ID NO: 403466 - protein, 11 aa, Influenza virus
VGNLIFNTVIH

SEQ ID NO: 403467 - protein, 11 aa, Influenza virus
GNLIFNTVIHG

SEQ ID NO: 403468 - protein, 11 aa, Influenza virus
TYNSTVVNNIT

SEQ ID NO: 403469 - protein, 11 aa, Influenza virus
YNSTVVNNITT

SEQ ID NO: 403470 - protein, 11 aa, Influenza virus
NSTVVNNITTT

SEQ ID NO: 403471 - protein, 11 aa, Influenza virus
STVVNNITTTI

SEQ ID NO: 403472 - protein, 11 aa, Influenza virus
TVVNNITTTIV

SEQ ID NO: 403473 - protein, 11 aa, Influenza virus
SLPLCPFRGFF

SEQ ID NO: 403474 - protein, 11 aa, Influenza virus
LPLCPFQGFFP

SEQ ID NO: 403475 - protein, 11 aa, Influenza virus
PLCPFQGFFPF

SEQ ID NO: 403476 - protein, 11 aa, Influenza virus
LCPFQGFFPFH

SEQ ID NO: 403477 - protein, 11 aa, Influenza virus
CPFQGFFPFHK

SEQ ID NO: 403478 - protein, 11 aa, Influenza virus
PFQGFFPFHKD

SEQ ID NO: 403479 - protein, 11 aa, Influenza virus
FQGFFPFHKDN

SEQ ID NO: 403480 - protein, 11 aa, Influenza virus
QGFFPFHKDNA

SEQ ID NO: 403481 - protein, 11 aa, Influenza virus
GFFPFHKDNAL

SEQ ID NO: 403482 - protein, 11 aa, Influenza virus
FFPFHKGNSAR

SEQ ID NO: 403483 - protein, 11 aa, Influenza virus
FPFHKDNAIRP

SEQ ID NO: 403484 - protein, 11 aa, Influenza virus
PFHKGNSARLI

SEQ ID NO: 403485 - protein, 11 aa, Influenza virus
FHKDNALRLAE

SEQ ID NO: 403486 - protein, 11 aa, Influenza virus
HKGNSARLIHH

SEQ ID NO: 403487 - protein, 11 aa, Influenza virus
KDNAIRLGENR

SEQ ID NO: 403488 - protein, 11 aa, Influenza virus
VIVTREPYISC

SEQ ID NO: 403489 - protein, 11 aa, Influenza virus
IVTREPYISCD

SEQ ID NO: 403490 - protein, 11 aa, Influenza virus
VTREPYVSCDY

SEQ ID NO: 403491 - protein, 11 aa, Influenza virus
DCWSFALAQGA

SEQ ID NO: 403492 - protein, 11 aa, Influenza virus
CWSFALAQGVL

SEQ ID NO: 403493 - protein, 11 aa, Influenza virus
WSFALAQGALV

SEQ ID NO: 403494 - protein, 11 aa, Influenza virus
SFALAQGALVG

SEQ ID NO: 403495 - protein, 11 aa, Influenza virus
FALAQGALVGT

SEQ ID NO: 403496 - protein, 11 aa, Influenza virus
ALAQGALVGTK

SEQ ID NO: 403497 - protein, 11 aa, Influenza virus
LAQGALVGTKH

SEQ ID NO: 403498 - protein, 11 aa, Influenza virus
AQGALLGTNHS

SEQ ID NO: 403499 - protein, 11 aa, Influenza virus
QGALVGTKHSN

SEQ ID NO: 403500 - protein, 11 aa, Influenza virus
GALVGTKHSNG

SEQ ID NO: 403501 - protein, 11 aa, Influenza virus
ALLGTNHSNGT

SEQ ID NO: 403502 - protein, 11 aa, Influenza virus
DRTPYRSLIQF

SEQ ID NO: 403503 - protein, 11 aa, Influenza virus
RTPYRSLIQFP

SEQ ID NO: 403504 - protein, 11 aa, Influenza virus
TPYRSLIQFPM

SEQ ID NO: 403505 - protein, 11 aa, Influenza virus
PYRSLIQFPMG

SEQ ID NO: 403506 - protein, 11 aa, Influenza virus
YRSLIRFPIGV

SEQ ID NO: 403507 - protein, 11 aa, Influenza virus
RSLIRFPIGVA

SEQ ID NO: 403508 - protein, 11 aa, Influenza virus
SLIRFPIGVAP

SEQ ID NO: 403509 - protein, 11 aa, Influenza virus
FPIGVAPVLGN

SEQ ID NO: 403510 - protein, 11 aa, Influenza virus
PIGVAPVLGNY

SEQ ID NO: 403511 - protein, 11 aa, Influenza virus
GVAPVLGNYKE

SEQ ID NO: 403512 - protein, 11 aa, Influenza virus
APVLGNYREIC

SEQ ID NO: 403513 - protein, 11 aa, Influenza virus
LGNYKEICVAW

SEQ ID NO: 403514 - protein, 11 aa, Influenza virus
GNYKEICVAWS

SEQ ID NO: 403515 - protein, 11 aa, Influenza virus
NYKEICVAWSS

SEQ ID NO: 403516 - protein, 11 aa, Influenza virus
EICVAWSSSSC

SEQ ID NO: 403517 - protein, 11 aa, Influenza virus
ICVAWSSSSCF

SEQ ID NO: 403518 - protein, 11 aa, Influenza virus
CVAWSSSSCFD

SEQ ID NO: 403519 - protein, 11 aa, Influenza virus
VAWSSSSCFDG

SEQ ID NO: 403520 - protein, 11 aa, Influenza virus
AWSSTSCFDGK

SEQ ID NO: 403521 - protein, 11 aa, Influenza virus
WSSTSCFDGKE

SEQ ID NO: 403522 - protein, 11 aa, Influenza virus
SSTSCFDGKEW

SEQ ID NO: 403523 - protein, 11 aa, Influenza virus
STSCFDGKEWM

SEQ ID NO: 403524 - protein, 11 aa, Influenza virus
TSCFDGKEWMH

SEQ ID NO: 403525 - protein, 11 aa, Influenza virus
SCFDGKEWLHV

SEQ ID NO: 403526 - protein, 11 aa, Influenza virus
CFDGKEWMHIC

SEQ ID NO: 403527 - protein, 11 aa, Influenza virus
FDGKEWMHVCI

SEQ ID NO: 403528 - protein, 11 aa, Influenza virus
DGKEWMHVCIT

SEQ ID NO: 403529 - protein, 11 aa, Influenza virus
GKEWMHVCITG

SEQ ID NO: 403530 - protein, 11 aa, Influenza virus
GKMTDSIKSWR

SEQ ID NO: 403531 - protein, 11 aa, Influenza virus
MTDSIKSWRRD

SEQ ID NO: 403532 - protein, 11 aa, Influenza virus
TDSIKSWRRDI

SEQ ID NO: 403533 - protein, 11 aa, Influenza virus
DSIKSWRRDIL

SEQ ID NO: 403534 - protein, 11 aa, Influenza virus
SIKSWRRDILR

SEQ ID NO: 403535 - protein, 11 aa, Influenza virus
IKSWRRDILRT

SEQ ID NO: 403536 - protein, 11 aa, Influenza virus
KSWRRDILRTQ

SEQ ID NO: 403537 - protein, 11 aa, Influenza virus
SWRRDILRTQE

SEQ ID NO: 403538 - protein, 11 aa, Influenza virus
WRRDILRTQES

SEQ ID NO: 403539 - protein, 11 aa, Influenza virus
RRDILRTQESE

SEQ ID NO: 403540 - protein, 11 aa, Influenza virus
RDILRTQESEC

SEQ ID NO: 403541 - protein, 11 aa, Influenza virus
NILRTQESECQ

SEQ ID NO: 403542 - protein, 11 aa, Influenza virus
ILRTQESECLC

SEQ ID NO: 403543 - protein, 11 aa, Influenza virus
LRTQESECQCL

SEQ ID NO: 403544 - protein, 11 aa, Influenza virus
RTQESECQCIG

SEQ ID NO: 403545 - protein, 11 aa, Influenza virus
TQESECQCIGG

SEQ ID NO: 403546 - protein, 11 aa, Influenza virus
GTCVVTVTDGP

SEQ ID NO: 403547 - protein, 11 aa, Influenza virus
TCVVTVTDGPA

SEQ ID NO: 403548 - protein, 11 aa, Influenza virus
CVVTVTDGPAA

SEQ ID NO: 403549 - protein, 11 aa, Influenza virus
VVTVTDGPAAN

SEQ ID NO: 403550 - protein, 11 aa, Influenza virus
VAVTDGPAANN

SEQ ID NO: 403551 - protein, 11 aa, Influenza virus
AVTDGPAANNA

SEQ ID NO: 403552 - protein, 11 aa, Influenza virus
VTDGPAANNAD

SEQ ID NO: 403553 - protein, 11 aa, Influenza virus
TDGPAANNADH

SEQ ID NO: 403554 - protein, 11 aa, Influenza virus
DGPAANNADHR

SEQ ID NO: 403555 - protein, 11 aa, Influenza virus
GPAANSADHRI

SEQ ID NO: 403556 - protein, 11 aa, Influenza virus
PAANSADHRIY

SEQ ID NO: 403557 - protein, 11 aa, Influenza virus
AANSADHRIYW

SEQ ID NO: 403558 - protein, 11 aa, Influenza virus
ANSADHRIYWI

SEQ ID NO: 403559 - protein, 11 aa, Influenza virus
NSADHRIYWIR

SEQ ID NO: 403560 - protein, 11 aa, Influenza virus
SADHRIYWIRE

SEQ ID NO: 403561 - protein, 11 aa, Influenza virus
ADHRIYWIREG

SEQ ID NO: 403562 - protein, 11 aa, Influenza virus
KIKHLEECSCY

SEQ ID NO: 403563 - protein, 11 aa, Influenza virus
IKHLEECSCYV

SEQ ID NO: 403564 - protein, 11 aa, Influenza virus
KHLEECSCYVD

SEQ ID NO: 403565 - protein, 11 aa, Influenza virus
HLEECSCYMDI

SEQ ID NO: 403566 - protein, 11 aa, Influenza virus
LEECSCYMDID

SEQ ID NO: 403567 - protein, 11 aa, Influenza virus
EECSCYVDIDI

SEQ ID NO: 403568 - protein, 11 aa, Influenza virus
ECSCYVDIDIY

SEQ ID NO: 403569 - protein, 11 aa, Influenza virus
CSCYVDIDIYC

SEQ ID NO: 403570 - protein, 11 aa, Influenza virus
DIDIYCICRDN

SEQ ID NO: 403571 - protein, 11 aa, Influenza virus
IDIYCICRDNW

SEQ ID NO: 403572 - protein, 11 aa, Influenza virus
DIYCICRDNWK

SEQ ID NO: 403573 - protein, 11 aa, Influenza virus
IYCICRDNWKG

SEQ ID NO: 403574 - protein, 11 aa, Influenza virus
YCVCRDNWKGS

SEQ ID NO: 403575 - protein, 11 aa, Influenza virus
CVCRDNWKGSN

SEQ ID NO: 403576 - protein, 11 aa, Influenza virus
VCRDNWKGSNR

SEQ ID NO: 403577 - protein, 11 aa, Influenza virus
DNWKGSNRPWI

SEQ ID NO: 403578 - protein, 11 aa, Influenza virus
NWKGSNRPWIR

SEQ ID NO: 403579 - protein, 11 aa, Influenza virus
WKGSNRPWIRI

SEQ ID NO: 403580 - protein, 11 aa, Influenza virus
KGSNRPWIRIN

SEQ ID NO: 403581 - protein, 11 aa, Influenza virus
GSNRPWIRINN

SEQ ID NO: 403582 - protein, 11 aa, Influenza virus
SNRPWIRINNE

SEQ ID NO: 403583 - protein, 11 aa, Influenza virus
NRPWIRINNET

SEQ ID NO: 403584 - protein, 11 aa, Influenza virus
RPWIRINNETI

SEQ ID NO: 403585 - protein, 11 aa, Influenza virus
PWIRINNETIL

SEQ ID NO: 403586 - protein, 11 aa, Influenza virus
WIRINNETILE

SEQ ID NO: 403587 - protein, 11 aa, Influenza virus
IRINNETILET

SEQ ID NO: 403588 - protein, 11 aa, Influenza virus
RISNETILETG

SEQ ID NO: 403589 - protein, 11 aa, Influenza virus
ISNETILETGY

SEQ ID NO: 403590 - protein, 11 aa, Influenza virus
SNETILETGYV

SEQ ID NO: 403591 - protein, 11 aa, Influenza virus
NETILETRYVC

SEQ ID NO: 403592 - protein, 11 aa, Influenza virus
ETILETRYVCS

SEQ ID NO: 403593 - protein, 11 aa, Influenza virus
TILETRYVCSK

SEQ ID NO: 403594 - protein, 11 aa, Influenza virus
IVETGYVCSKF

SEQ ID NO: 403595 - protein, 11 aa, Influenza virus
LETGYICSKFH

SEQ ID NO: 403596 - protein, 11 aa, Influenza virus
ETGYICSKFHS

SEQ ID NO: 403597 - protein, 11 aa, Influenza virus
TRYVCSKFHSD

SEQ ID NO: 403598 - protein, 11 aa, Influenza virus
GYICSKFHSDT

SEQ ID NO: 403599 - protein, 11 aa, Influenza virus
SKFHSDTPRPD

SEQ ID NO: 403600 - protein, 11 aa, Influenza virus
KFHSDTPRPDD

SEQ ID NO: 403601 - protein, 11 aa, Influenza virus
FHSDTPRPDDP

SEQ ID NO: 403602 - protein, 11 aa, Influenza virus
HSDTPRPDDPS

SEQ ID NO: 403603 - protein, 11 aa, Influenza virus
DPSTMSCDSPS

SEQ ID NO: 403604 - protein, 11 aa, Influenza virus
PSTMSCDSPSN

SEQ ID NO: 403605 - protein, 11 aa, Influenza virus
SCDSPSNINGG

SEQ ID NO: 403606 - protein, 11 aa, Influenza virus
NGGLGVKGFGF

SEQ ID NO: 403607 - protein, 11 aa, Influenza virus
GGLGVKGFGFK

SEQ ID NO: 403608 - protein, 11 aa, Influenza virus
GDDVWLGRTVS

SEQ ID NO: 403609 - protein, 11 aa, Influenza virus
NDVWLGRTVSN

SEQ ID NO: 403610 - protein, 11 aa, Influenza virus
DVWLGRTVSNS

SEQ ID NO: 403611 - protein, 11 aa, Influenza virus
VWLGRTVSNSG

SEQ ID NO: 403612 - protein, 11 aa, Influenza virus
WLGRTVSNSGR

SEQ ID NO: 403613 - protein, 11 aa, Influenza virus
LGRTVSNSGRS

SEQ ID NO: 403614 - protein, 11 aa, Influenza virus
EGWINSPNHVK

SEQ ID NO: 403615 - protein, 11 aa, Influenza virus
GWINSPNHVKS

SEQ ID NO: 403616 - protein, 11 aa, Influenza virus
AKSITQTLVSN

SEQ ID NO: 403617 - protein, 11 aa, Influenza virus
KSVTQTLVSNN

SEQ ID NO: 403618 - protein, 11 aa, Influenza virus
SVTQTLVSNND

SEQ ID NO: 403619 - protein, 11 aa, Influenza virus
VTQTLVSNNDW

SEQ ID NO: 403620 - protein, 11 aa, Influenza virus
TQTLVSNSDWS

SEQ ID NO: 403621 - protein, 11 aa, Influenza virus
QTLVSNDDWSG

SEQ ID NO: 403622 - protein, 11 aa, Influenza virus
TLVSNSDWSGY

SEQ ID NO: 403623 - protein, 11 aa, Influenza virus
LVSNDDWSGYS

SEQ ID NO: 403624 - protein, 11 aa, Influenza virus
VSNSDWSGYSG

SEQ ID NO: 403625 - protein, 11 aa, Influenza virus
SNSDWSGYSGS

SEQ ID NO: 403626 - protein, 11 aa, Influenza virus
NSDWSGYSGSF

SEQ ID NO: 403627 - protein, 11 aa, Influenza virus
DDWSGYSGSFI

SEQ ID NO: 403628 - protein, 11 aa, Influenza virus
DWSGYSGSFII

SEQ ID NO: 403629 - protein, 11 aa, Influenza virus
GCFQPCFYIEL

SEQ ID NO: 403630 - protein, 11 aa, Influenza virus
CFQPCFYIELI

SEQ ID NO: 403631 - protein, 11 aa, Influenza virus
FQPCFYIELIR

SEQ ID NO: 403632 - protein, 11 aa, Influenza virus
QPCFYIELIRG

SEQ ID NO: 403633 - protein, 11 aa, Influenza virus
PCFYIELIRGR

SEQ ID NO: 403634 - protein, 11 aa, Influenza virus
CFYIELIRGRP

SEQ ID NO: 403635 - protein, 11 aa, Influenza virus
FYIELIRGRPN

SEQ ID NO: 403636 - protein, 11 aa, Influenza virus
DNVSWTSNSIV

SEQ ID NO: 403637 - protein, 11 aa, Influenza virus
NVSWTSNSIVT

SEQ ID NO: 403638 - protein, 11 aa, Influenza virus
VSWASNSIVTF

SEQ ID NO: 403639 - protein, 11 aa, Influenza virus
SWASNSIVTFC

SEQ ID NO: 403640 - protein, 11 aa, Influenza virus
WASNSIVTFCG

SEQ ID NO: 403641 - protein, 11 aa, Influenza virus
ASNSIVTFCGL

SEQ ID NO: 403642 - protein, 11 aa, Influenza virus
SNSIVTFCGLN

SEQ ID NO: 403643 - protein, 11 aa, Influenza virus
NSIVTFCGLNN

SEQ ID NO: 403644 - protein, 11 aa, Influenza virus
SIVTFCGLNNE

SEQ ID NO: 403645 - protein, 11 aa, Influenza virus
IVTFCGLNNEP

SEQ ID NO: 403646 - protein, 11 aa, Influenza virus
VTFCGLNNEPG

SEQ ID NO: 403647 - protein, 11 aa, Influenza virus
TFCGLNNEPGS

SEQ ID NO: 403648 - protein, 11 aa, Influenza virus
FCGLNNEPGSG

SEQ ID NO: 403649 - protein, 11 aa, Influenza virus
CGLNNEPGSGN

SEQ ID NO: 403650 - protein, 11 aa, Influenza virus
GLNNEPGSGNW

SEQ ID NO: 403651 - protein, 11 aa, Influenza virus
LNNEPGSGNWP

SEQ ID NO: 403652 - protein, 11 aa, Influenza virus
NNEPGSGNWPD

SEQ ID NO: 403653 - protein, 11 aa, Influenza virus
EPGSGNWPDGA

SEQ ID NO: 403654 - protein, 11 aa, Influenza virus
PGSGNWPDGSD

SEQ ID NO: 403655 - protein, 11 aa, Influenza virus
GSGHWPDGSNI

SEQ ID NO: 403656 - protein, 11 aa, Influenza virus
SGNWPDGANIG

SEQ ID NO: 403657 - protein, 11 aa, Influenza virus
GNWPDGANIGF

SEQ ID NO: 403658 - protein, 11 aa, Influenza virus
NWPDGSDIGFM

SEQ ID NO: 403659 - protein, 11 aa, Influenza virus
WPDGANIGFMP

SEQ ID NO: 403660 - protein, 11 aa, Influenza virus
PDGSDIGFMPK

SEQ ID NO: 403661 - protein, 11 aa, Influenza virus
SKSRGYKMNTK

SEQ ID NO: 403662 - protein, 11 aa, Influenza virus
KSRGYKMNIQI

SEQ ID NO: 403663 - protein, 11 aa, Influenza virus
SRGYKMNTKIL

SEQ ID NO: 403664 - protein, 11 aa, Influenza virus
RGYKMNTKILV

SEQ ID NO: 403665 - protein, 11 aa, Influenza virus
GYKMNIQILIL

SEQ ID NO: 403666 - protein, 11 aa, Influenza virus
YKMNTKILVLA

SEQ ID NO: 403667 - protein, 11 aa, Influenza virus
KMNIQILILAL

SEQ ID NO: 403668 - protein, 11 aa, Influenza virus
GDKICLGHHAV

SEQ ID NO: 403669 - protein, 11 aa, Influenza virus
NGTKVDTLTEK

SEQ ID NO: 403670 - protein, 11 aa, Influenza virus
KVDTLTEKGIE

SEQ ID NO: 403671 - protein, 11 aa, Influenza virus
VDTLTEKGIEV

SEQ ID NO: 403672 - protein, 11 aa, Influenza virus
DTLTEKGIEVV

SEQ ID NO: 403673 - protein, 11 aa, Influenza virus
TLTEKGIEVVN

SEQ ID NO: 403674 - protein, 11 aa, Influenza virus
LTEKGIEVVNA

SEQ ID NO: 403675 - protein, 11 aa, Influenza virus
TEKGIEVVNAT

SEQ ID NO: 403676 - protein, 11 aa, Influenza virus
EKGIEVVNATE

SEQ ID NO: 403677 - protein, 11 aa, Influenza virus
KGIEVVNATET

SEQ ID NO: 403678 - protein, 11 aa, Influenza virus
GIEVVNATETV

SEQ ID NO: 403679 - protein, 11 aa, Influenza virus
IEVVNATETVE

SEQ ID NO: 403680 - protein, 11 aa, Influenza virus
EVVNATETVEQ

SEQ ID NO: 403681 - protein, 11 aa, Influenza virus
IGPPQCDQFLE

SEQ ID NO: 403682 - protein, 11 aa, Influenza virus
GPPQCDLFLEF

SEQ ID NO: 403683 - protein, 11 aa, Influenza virus
GFTYTGVRTNG

SEQ ID NO: 403684 - protein, 11 aa, Influenza virus
RSRSSFYAEMK

SEQ ID NO: 403685 - protein, 11 aa, Influenza virus
SRSSFYAEMKW

SEQ ID NO: 403686 - protein, 11 aa, Influenza virus
RSSFYAEMKWL

SEQ ID NO: 403687 - protein, 11 aa, Influenza virus
SSFYAEMEWLL

SEQ ID NO: 403688 - protein, 11 aa, Influenza virus
SFYAEMEWLLS

SEQ ID NO: 403689 - protein, 11 aa, Influenza virus
FYAEMKWLLSS

SEQ ID NO: 403690 - protein, 11 aa, Influenza virus
RPQINGQSGRI

SEQ ID NO: 403691 - protein, 11 aa, Influenza virus
PQINGQSGRID

SEQ ID NO: 403692 - protein, 11 aa, Influenza virus
QINGQSGRIDF

SEQ ID NO: 403693 - protein, 11 aa, Influenza virus
INGQSGRIDFY

SEQ ID NO: 403694 - protein, 11 aa, Influenza virus
NGQSGRIDFYW

SEQ ID NO: 403695 - protein, 11 aa, Influenza virus
GQSGRIDFYWL

SEQ ID NO: 403696 - protein, 11 aa, Influenza virus
NDTVTFTFNGA

SEQ ID NO: 403697 - protein, 11 aa, Influenza virus
DTVTFTFNGAF

SEQ ID NO: 403698 - protein, 11 aa, Influenza virus
TFTFNGAFIAP

SEQ ID NO: 403699 - protein, 11 aa, Influenza virus
FNGAFVAPDRV

SEQ ID NO: 403700 - protein, 11 aa, Influenza virus
NGAFVAPDRVS

SEQ ID NO: 403701 - protein, 11 aa, Influenza virus
GAFVAPDRVSF

SEQ ID NO: 403702 - protein, 11 aa, Influenza virus
SLMLATGMKNV

SEQ ID NO: 403703 - protein, 11 aa, Influenza virus
LMLATGMKNVP

SEQ ID NO: 403704 - protein, 11 aa, Influenza virus
MLATGMKNVPE

SEQ ID NO: 403705 - protein, 11 aa, Influenza virus
AHKQLTHHMRK

SEQ ID NO: 403706 - protein, 11 aa, Influenza virus
KKRKKRGLFGA

SEQ ID NO: 403707 - protein, 11 aa, Influenza virus
KKKKRGLFGAI

SEQ ID NO: 403708 - protein, 11 aa, Influenza virus
MRKKRGLFGAK

SEQ ID NO: 403709 - protein, 11 aa, Influenza virus
RRRGLFGAIAG

SEQ ID NO: 403710 - protein, 11 aa, Influenza virus
KGLFGAIAGFI

SEQ ID NO: 403711 - protein, 11 aa, Influenza virus
GFIENGWEGLV

SEQ ID NO: 403712 - protein, 11 aa, Influenza virus
FIENGWEGLVD

SEQ ID NO: 403713 - protein, 11 aa, Influenza virus
IENGWEGLVDG

SEQ ID NO: 403714 - protein, 11 aa, Influenza virus
ENGWEGLVDGW

SEQ ID NO: 403715 - protein, 11 aa, Influenza virus
NGWEGLVDGWY

SEQ ID NO: 403716 - protein, 11 aa, Influenza virus
GWEGLVDGWYG

SEQ ID NO: 403717 - protein, 11 aa, Influenza virus
WEGLVDGWYGF

SEQ ID NO: 403718 - protein, 11 aa, Influenza virus
EGLVDGWYGFR

SEQ ID NO: 403719 - protein, 11 aa, Influenza virus
GLVDGWYGFRH

SEQ ID NO: 403720 - protein, 11 aa, Influenza virus
LVDGWYGFRHQ

SEQ ID NO: 403721 - protein, 11 aa, Influenza virus
VDGWYGFRHQN

SEQ ID NO: 403722 - protein, 11 aa, Influenza virus
DGWYGYRHQNA

SEQ ID NO: 403723 - protein, 11 aa, Influenza virus
GWYGYRHQNAQ

SEQ ID NO: 403724 - protein, 11 aa, Influenza virus
WYGYRHQNAQG

SEQ ID NO: 403725 - protein, 11 aa, Influenza virus
YGYRHQNAQGE

SEQ ID NO: 403726 - protein, 11 aa, Influenza virus
GYRHQNAQGEG

SEQ ID NO: 403727 - protein, 11 aa, Influenza virus
KHQNAQGEGTA

SEQ ID NO: 403728 - protein, 11 aa, Influenza virus
HQNSQGEGTAA

SEQ ID NO: 403729 - protein, 11 aa, Influenza virus
QNSQGEGTAAD

SEQ ID NO: 403730 - protein, 11 aa, Influenza virus
NSQGEGTAADY

SEQ ID NO: 403731 - protein, 11 aa, Influenza virus
SQGEGTAADYK

SEQ ID NO: 403732 - protein, 11 aa, Influenza virus
AADYKSTQSAV

SEQ ID NO: 403733 - protein, 11 aa, Influenza virus
ADYKSTQSAIN

SEQ ID NO: 403734 - protein, 11 aa, Influenza virus
DYKSTQSAINQ

SEQ ID NO: 403735 - protein, 11 aa, Influenza virus
YKSTQSAINQI

SEQ ID NO: 403736 - protein, 11 aa, Influenza virus
KSTQSAINQIT

SEQ ID NO: 403737 - protein, 11 aa, Influenza virus
STQSAINQITG

SEQ ID NO: 403738 - protein, 11 aa, Influenza virus
TQSAINQITGK

SEQ ID NO: 403739 - protein, 11 aa, Influenza virus
QSAINQITGKL

SEQ ID NO: 403740 - protein, 11 aa, Influenza virus
SAINQITGKLN

SEQ ID NO: 403741 - protein, 11 aa, Influenza virus
AINQITGKLNR

SEQ ID NO: 403742 - protein, 11 aa, Influenza virus
INQITGKLNRL

SEQ ID NO: 403743 - protein, 11 aa, Influenza virus
NQITGKLNRLI

SEQ ID NO: 403744 - protein, 11 aa, Influenza virus
QITGKLNRLID

SEQ ID NO: 403745 - protein, 11 aa, Influenza virus
ITGKLNRLIDK

SEQ ID NO: 403746 - protein, 11 aa, Influenza virus
TGKLNRLIDKT

SEQ ID NO: 403747 - protein, 11 aa, Influenza virus
GKLNRLIDKTN

SEQ ID NO: 403748 - protein, 11 aa, Influenza virus
KLNRLIDKTNQ

SEQ ID NO: 403749 - protein, 11 aa, Influenza virus
LNRLIDKTNQQ

SEQ ID NO: 403750 - protein, 11 aa, Influenza virus
NRLIDKTNQQF

SEQ ID NO: 403751 - protein, 11 aa, Influenza virus
RLIDKTNQQFE

SEQ ID NO: 403752 - protein, 11 aa, Influenza virus
LIDKTNQQFEL

SEQ ID NO: 403753 - protein, 11 aa, Influenza virus
IDKTNQQFELI

SEQ ID NO: 403754 - protein, 11 aa, Influenza virus
DKTNQQFELID

SEQ ID NO: 403755 - protein, 11 aa, Influenza virus
RTNQQFELIDN

SEQ ID NO: 403756 - protein, 11 aa, Influenza virus
TNQQFEMIDNE

SEQ ID NO: 403757 - protein, 11 aa, Influenza virus
NQQFEMIDNEF

SEQ ID NO: 403758 - protein, 11 aa, Influenza virus
QQFELIDNEFN

SEQ ID NO: 403759 - protein, 11 aa, Influenza virus
QFELIDNEFNE

SEQ ID NO: 403760 - protein, 11 aa, Influenza virus
EIEKQIGNVIN

SEQ ID NO: 403761 - protein, 11 aa, Influenza virus
IEKQIGNVINW

SEQ ID NO: 403762 - protein, 11 aa, Influenza virus
EQQIGNVINWT

SEQ ID NO: 403763 - protein, 11 aa, Influenza virus
QQIGNVINWTR

SEQ ID NO: 403764 - protein, 11 aa, Influenza virus
QLGNVINWTRD

SEQ ID NO: 403765 - protein, 11 aa, Influenza virus
LGNVINWTRDS

SEQ ID NO: 403766 - protein, 11 aa, Influenza virus
GNVINWTRDSI

SEQ ID NO: 403767 - protein, 11 aa, Influenza virus
NVINWTRDSIT

SEQ ID NO: 403768 - protein, 11 aa, Influenza virus
VINWTRDSITE

SEQ ID NO: 403769 - protein, 11 aa, Influenza virus
IEVWSYNAEFL

SEQ ID NO: 403770 - protein, 11 aa, Influenza virus
WSYNAEFLVAV

SEQ ID NO: 403771 - protein, 11 aa, Influenza virus
SYNAEFLVAVE

SEQ ID NO: 403772 - protein, 11 aa, Influenza virus
YNAEFLVAVEN

SEQ ID NO: 403773 - protein, 11 aa, Influenza virus
NAEFLVAVENQ

SEQ ID NO: 403774 - protein, 11 aa, Influenza virus
AEFLVAVENQH

SEQ ID NO: 403775 - protein, 11 aa, Influenza virus
EFLVAVENQHT

SEQ ID NO: 403776 - protein, 11 aa, Influenza virus
FLVAVENQHTI

SEQ ID NO: 403777 - protein, 11 aa, Influenza virus
LVAVENQHTID

SEQ ID NO: 403778 - protein, 11 aa, Influenza virus
VAVENQHTIDL

SEQ ID NO: 403779 - protein, 11 aa, Influenza virus
AVENQHTIDLT

SEQ ID NO: 403780 - protein, 11 aa, Influenza virus
ENQHTIDLTDS

SEQ ID NO: 403781 - protein, 11 aa, Influenza virus
NQHTIDLTDSE

SEQ ID NO: 403782 - protein, 11 aa, Influenza virus
QHTIDLTDSEM

SEQ ID NO: 403783 - protein, 11 aa, Influenza virus
HTIDLTDSEMN

SEQ ID NO: 403784 - protein, 11 aa, Influenza virus
TIDLTDSEMNK

SEQ ID NO: 403785 - protein, 11 aa, Influenza virus
IDLTDSEMNKL

SEQ ID NO: 403786 - protein, 11 aa, Influenza virus
DLTDSEMNKLY

SEQ ID NO: 403787 - protein, 11 aa, Influenza virus
LTDSEMNKLYE

SEQ ID NO: 403788 - protein, 11 aa, Influenza virus
TDSEMNKLYEK

SEQ ID NO: 403789 - protein, 11 aa, Influenza virus
DSEMNKLYEKV

SEQ ID NO: 403790 - protein, 11 aa, Influenza virus
SEMNKLYERVK

SEQ ID NO: 403791 - protein, 11 aa, Influenza virus
EMNKLYERVRR

SEQ ID NO: 403792 - protein, 11 aa, Influenza virus
MNKLYERVRRQ

SEQ ID NO: 403793 - protein, 11 aa, Influenza virus
NKLYERVRRQL

SEQ ID NO: 403794 - protein, 11 aa, Influenza virus
KLYERVRRQLR

SEQ ID NO: 403795 - protein, 11 aa, Influenza virus
LYERVRRQLRE

SEQ ID NO: 403796 - protein, 11 aa, Influenza virus
YERVRRQLREN

SEQ ID NO: 403797 - protein, 11 aa, Influenza virus
ERVRRQLRENA

SEQ ID NO: 403798 - protein, 11 aa, Influenza virus
RVRRQLRENAE

SEQ ID NO: 403799 - protein, 11 aa, Influenza virus
VKRQLRENAEE

SEQ ID NO: 403800 - protein, 11 aa, Influenza virus
KRQLRENAEED

SEQ ID NO: 403801 - protein, 11 aa, Influenza virus
KQLRENAEEDG

SEQ ID NO: 403802 - protein, 11 aa, Influenza virus
QLRENAEEDGN

SEQ ID NO: 403803 - protein, 11 aa, Influenza virus
LRENAEEDGNG

SEQ ID NO: 403804 - protein, 11 aa, Influenza virus
RENAEEDGNGC

SEQ ID NO: 403805 - protein, 11 aa, Influenza virus
ENAEEDGNGCF

SEQ ID NO: 403806 - protein, 11 aa, Influenza virus
NAEEDGNGCFE

SEQ ID NO: 403807 - protein, 11 aa, Influenza virus
AEEDGNGCFEI

SEQ ID NO: 403808 - protein, 11 aa, Influenza virus
EEDGNGCFEIF

SEQ ID NO: 403809 - protein, 11 aa, Influenza virus
EDGNGCFEIFH

SEQ ID NO: 403810 - protein, 11 aa, Influenza virus
DGNGCFEIFHQ

SEQ ID NO: 403811 - protein, 11 aa, Influenza virus
GNGCFEIFHQC

SEQ ID NO: 403812 - protein, 11 aa, Influenza virus
NGCFEIFHQCD

SEQ ID NO: 403813 - protein, 11 aa, Influenza virus
GCFEIFHQCDN

SEQ ID NO: 403814 - protein, 11 aa, Influenza virus
CFEIFHQCDND

SEQ ID NO: 403815 - protein, 11 aa, Influenza virus
FEIFHQCDNDC

SEQ ID NO: 403816 - protein, 11 aa, Influenza virus
EIFHQCDNDCM

SEQ ID NO: 403817 - protein, 11 aa, Influenza virus
CMESIRNNTYD

SEQ ID NO: 403818 - protein, 11 aa, Influenza virus
MESIRNNTYDH

SEQ ID NO: 403819 - protein, 11 aa, Influenza virus
IRNNTYDHKKY

SEQ ID NO: 403820 - protein, 11 aa, Influenza virus
RNNTYDHKKYR

SEQ ID NO: 403821 - protein, 11 aa, Influenza virus
IDAVKLSSGYK

SEQ ID NO: 403822 - protein, 11 aa, Influenza virus
VKLSSGYKDII

SEQ ID NO: 403823 - protein, 11 aa, Influenza virus
LSSGYKDIILW

SEQ ID NO: 403824 - protein, 11 aa, Influenza virus
SSGYKDIILWF

SEQ ID NO: 403825 - protein, 11 aa, Influenza virus
SGYKDIILWFS

SEQ ID NO: 403826 - protein, 11 aa, Influenza virus
GYKDIILWFSF

SEQ ID NO: 403827 - protein, 11 aa, Influenza virus
YKDIILWFSFG

SEQ ID NO: 403828 - protein, 11 aa, Influenza virus
KDIILWFSFGA

SEQ ID NO: 403829 - protein, 11 aa, Influenza virus
DIILWFSFGAS

SEQ ID NO: 403830 - protein, 11 aa, Influenza virus
IILWFSFGASC

SEQ ID NO: 403831 - protein, 11 aa, Influenza virus
ILWFSLGASCF

SEQ ID NO: 403832 - protein, 11 aa, Influenza virus
LWFSFGASCFL

SEQ ID NO: 403833 - protein, 11 aa, Influenza virus
WFSFGASCFLL

SEQ ID NO: 403834 - protein, 11 aa, Influenza virus
LVFMCVKNGNM

SEQ ID NO: 403835 - protein, 11 aa, Influenza virus
FMCVKNGNMRC

SEQ ID NO: 403836 - protein, 11 aa, Influenza virus
MCVKNGNMRCT

SEQ ID NO: 403837 - protein, 11 aa, Influenza virus
CIKNGNMRCTI

SEQ ID NO: 403838 - protein, 11 aa, Influenza virus
IKNGNMRCTIC

SEQ ID NO: 403839 - protein, 11 aa, Influenza virus
KNGNMQCTICI

SEQ ID NO: 403840 - protein, 11 aa, Influenza virus
MNPNQKLFASS

SEQ ID NO: 403841 - protein, 11 aa, Influenza virus
NPNQKLFASSG

SEQ ID NO: 403842 - protein, 11 aa, Influenza virus
PNQKLFASSGI

SEQ ID NO: 403843 - protein, 11 aa, Influenza virus
NQKLFASSGIA

SEQ ID NO: 403844 - protein, 11 aa, Influenza virus
QKLFASSGIAI

SEQ ID NO: 403845 - protein, 11 aa, Influenza virus
KLFASSGIAIV

SEQ ID NO: 403846 - protein, 11 aa, Influenza virus
LFASSGIAIVL

SEQ ID NO: 403847 - protein, 11 aa, Influenza virus
FASSGIAIVLG

SEQ ID NO: 403848 - protein, 11 aa, Influenza virus
ALSGVAIALSI

SEQ ID NO: 403849 - protein, 11 aa, Influenza virus
LSGVAIALSIL

SEQ ID NO: 403850 - protein, 11 aa, Influenza virus
SGVAIALSILN

SEQ ID NO: 403851 - protein, 11 aa, Influenza virus
GVAIALSILNL

SEQ ID NO: 403852 - protein, 11 aa, Influenza virus
VAIALSILNLL

SEQ ID NO: 403853 - protein, 11 aa, Influenza virus
AIALSILNLLI

SEQ ID NO: 403854 - protein, 11 aa, Influenza virus
IALSILNLLIG

SEQ ID NO: 403855 - protein, 11 aa, Influenza virus
ALSILNLLIGI

SEQ ID NO: 403856 - protein, 11 aa, Influenza virus
LSILNLLIGIS

SEQ ID NO: 403857 - protein, 11 aa, Influenza virus
SILNLLIGISN

SEQ ID NO: 403858 - protein, 11 aa, Influenza virus
ILNLLIGISNV

SEQ ID NO: 403859 - protein, 11 aa, Influenza virus
INLLIGISNMS

SEQ ID NO: 403860 - protein, 11 aa, Influenza virus
NLLIGISNMSL

SEQ ID NO: 403861 - protein, 11 aa, Influenza virus
LLIGISNMSLN

SEQ ID NO: 403862 - protein, 11 aa, Influenza virus
SNMSLNISLYS

SEQ ID NO: 403863 - protein, 11 aa, Influenza virus
ENTYVNNTTVI

SEQ ID NO: 403864 - protein, 11 aa, Influenza virus
NYLMLNKSLCK

SEQ ID NO: 403865 - protein, 11 aa, Influenza virus
YLMLNKSLCKV

SEQ ID NO: 403866 - protein, 11 aa, Influenza virus
LMLNKSLCKVE

SEQ ID NO: 403867 - protein, 11 aa, Influenza virus
MLNKSLCKVEG

SEQ ID NO: 403868 - protein, 11 aa, Influenza virus
LNKSLCKVEGW

SEQ ID NO: 403869 - protein, 11 aa, Influenza virus
NKSLCKVEGWV

SEQ ID NO: 403870 - protein, 11 aa, Influenza virus
KSLCKVEGWVV

SEQ ID NO: 403871 - protein, 11 aa, Influenza virus
SLCKVEGWVVV

SEQ ID NO: 403872 - protein, 11 aa, Influenza virus
VEGWVVVAKDN

SEQ ID NO: 403873 - protein, 11 aa, Influenza virus
EGWVVVAKDNA

SEQ ID NO: 403874 - protein, 11 aa, Influenza virus
GWVVVAKDNAI

SEQ ID NO: 403875 - protein, 11 aa, Influenza virus
WVVVAKDNAIR

SEQ ID NO: 403876 - protein, 11 aa, Influenza virus
VVVAKDNAIRF

SEQ ID NO: 403877 - protein, 11 aa, Influenza virus
VVAKDNAIRFG

SEQ ID NO: 403878 - protein, 11 aa, Influenza virus
VAKDNAIRFGE

SEQ ID NO: 403879 - protein, 11 aa, Influenza virus
AKDNAIRFGES

SEQ ID NO: 403880 - protein, 11 aa, Influenza virus
KDNAIRFGESE

SEQ ID NO: 403881 - protein, 11 aa, Influenza virus
DNAIRFGESEQ

SEQ ID NO: 403882 - protein, 11 aa, Influenza virus
NAIRFGESEQI

SEQ ID NO: 403883 - protein, 11 aa, Influenza virus
AIRFGESEQII

SEQ ID NO: 403884 - protein, 11 aa, Influenza virus
IRFGESEQIIV

SEQ ID NO: 403885 - protein, 11 aa, Influenza virus
RFGESEQVIVT

SEQ ID NO: 403886 - protein, 11 aa, Influenza virus
FGESEQVIVTR

SEQ ID NO: 403887 - protein, 11 aa, Influenza virus
GESEQVIVTRE

SEQ ID NO: 403888 - protein, 11 aa, Influenza virus
ESEQVIVTREP

SEQ ID NO: 403889 - protein, 11 aa, Influenza virus
SEQVIVTREPY

SEQ ID NO: 403890 - protein, 11 aa, Influenza virus
EQVIVTREPYV

SEQ ID NO: 403891 - protein, 11 aa, Influenza virus
QVIVTREPYVS

SEQ ID NO: 403892 - protein, 11 aa, Influenza virus
VIVTREPYVSC

SEQ ID NO: 403893 - protein, 11 aa, Influenza virus
VVTREPYVSCD

SEQ ID NO: 403894 - protein, 11 aa, Influenza virus
TREPYVSCDPL

SEQ ID NO: 403895 - protein, 11 aa, Influenza virus
SCKMYALHQGT

SEQ ID NO: 403896 - protein, 11 aa, Influenza virus
CRMYALHQGTT

SEQ ID NO: 403897 - protein, 11 aa, Influenza virus
RMYALHQGTTI

SEQ ID NO: 403898 - protein, 11 aa, Influenza virus
GTTIRNKHSNS

SEQ ID NO: 403899 - protein, 11 aa, Influenza virus
TTIRNKHSNST

SEQ ID NO: 403900 - protein, 11 aa, Influenza virus
TIRNKHSNSTT

SEQ ID NO: 403901 - protein, 11 aa, Influenza virus
IRNKHSNSTTH

SEQ ID NO: 403902 - protein, 11 aa, Influenza virus
RNKHSNSTTHD

SEQ ID NO: 403903 - protein, 11 aa, Influenza virus
NKHSNSTTHDR

SEQ ID NO: 403904 - protein, 11 aa, Influenza virus
KHSNSTTHDRT

SEQ ID NO: 403905 - protein, 11 aa, Influenza virus
HSNSTTHDRTA

SEQ ID NO: 403906 - protein, 11 aa, Influenza virus
SNSTTHDRTAF

SEQ ID NO: 403907 - protein, 11 aa, Influenza virus
NSTTHDRTAFR

SEQ ID NO: 403908 - protein, 11 aa, Influenza virus
STTHDRTAFRG

SEQ ID NO: 403909 - protein, 11 aa, Influenza virus
TTHDRTAFRGL

SEQ ID NO: 403910 - protein, 11 aa, Influenza virus
HDRTAFRGLMS

SEQ ID NO: 403911 - protein, 11 aa, Influenza virus
DRTTFRGLLST

SEQ ID NO: 403912 - protein, 11 aa, Influenza virus
SNSDFICVGWS

SEQ ID NO: 403913 - protein, 11 aa, Influenza virus
NSDFLCVGWSS

SEQ ID NO: 403914 - protein, 11 aa, Influenza virus
SDFLCVGWSST

SEQ ID NO: 403915 - protein, 11 aa, Influenza virus
DFLCVGWSSTS

SEQ ID NO: 403916 - protein, 11 aa, Influenza virus
FICVGWSSTSC

SEQ ID NO: 403917 - protein, 11 aa, Influenza virus
ICVGWSSTSCH

SEQ ID NO: 403918 - protein, 11 aa, Influenza virus
CVGWSSTSCHD

SEQ ID NO: 403919 - protein, 11 aa, Influenza virus
VGWSSTSCHDG

SEQ ID NO: 403920 - protein, 11 aa, Influenza virus
GWSSTSCHDGI

SEQ ID NO: 403921 - protein, 11 aa, Influenza virus
CHDGVGRMTIC

SEQ ID NO: 403922 - protein, 11 aa, Influenza virus
QGDNENATATV

SEQ ID NO: 403923 - protein, 11 aa, Influenza virus
GDNENATATVY

SEQ ID NO: 403924 - protein, 11 aa, Influenza virus
DNENATATVYY

SEQ ID NO: 403925 - protein, 11 aa, Influenza virus
NENATATVYYN

SEQ ID NO: 403926 - protein, 11 aa, Influenza virus
NATATVYYDRR

SEQ ID NO: 403927 - protein, 11 aa, Influenza virus
ATATVYYDRRL

SEQ ID NO: 403928 - protein, 11 aa, Influenza virus
TATVYYDRRLT

SEQ ID NO: 403929 - protein, 11 aa, Influenza virus
ATVYYDRRLTT

SEQ ID NO: 403930 - protein, 11 aa, Influenza virus
TVYYDRRLTTT

SEQ ID NO: 403931 - protein, 11 aa, Influenza virus
VYYDRRLTTTI

SEQ ID NO: 403932 - protein, 11 aa, Influenza virus
KRLTTTIKTWA

SEQ ID NO: 403933 - protein, 11 aa, Influenza virus
RLTTTIKTWAK

SEQ ID NO: 403934 - protein, 11 aa, Influenza virus
LTTTIKTWAKN

SEQ ID NO: 403935 - protein, 11 aa, Influenza virus
TTTIKTWAKNI

SEQ ID NO: 403936 - protein, 11 aa, Influenza virus
TTIKTWAKNIL

SEQ ID NO: 403937 - protein, 11 aa, Influenza virus
TIKTWAKNILR

SEQ ID NO: 403938 - protein, 11 aa, Influenza virus
IKTWAKNILRT

SEQ ID NO: 403939 - protein, 11 aa, Influenza virus
KTWAKNILRTQ

SEQ ID NO: 403940 - protein, 11 aa, Influenza virus
TWAKNILRTQE

SEQ ID NO: 403941 - protein, 11 aa, Influenza virus
WAKNILRTQES

SEQ ID NO: 403942 - protein, 11 aa, Influenza virus
AKNILRTQESE

SEQ ID NO: 403943 - protein, 11 aa, Influenza virus
KNILRTQESEC

SEQ ID NO: 403944 - protein, 11 aa, Influenza virus
NILRTQDSECV

SEQ ID NO: 403945 - protein, 11 aa, Influenza virus
ILRTQDSECVS

SEQ ID NO: 403946 - protein, 11 aa, Influenza virus
LRTQESECVRH

SEQ ID NO: 403947 - protein, 11 aa, Influenza virus
RTQESECVRHN

SEQ ID NO: 403948 - protein, 11 aa, Influenza virus
TQESECVCHNS

SEQ ID NO: 403949 - protein, 11 aa, Influenza virus
QESECVCHNST

SEQ ID NO: 403950 - protein, 11 aa, Influenza virus
ESECVCHNSTC

SEQ ID NO: 403951 - protein, 11 aa, Influenza virus
SECVCHNGTCV

SEQ ID NO: 403952 - protein, 11 aa, Influenza virus
ECVCHNGTCVV

SEQ ID NO: 403953 - protein, 11 aa, Influenza virus
HNSTCVVVMTD

SEQ ID NO: 403954 - protein, 11 aa, Influenza virus
NSTCVVVMTDG

SEQ ID NO: 403955 - protein, 11 aa, Influenza virus
LKGSAKHIEEC

SEQ ID NO: 403956 - protein, 11 aa, Influenza virus
KGSAKHIEECS

SEQ ID NO: 403957 - protein, 11 aa, Influenza virus
GSAKHIEECSC

SEQ ID NO: 403958 - protein, 11 aa, Influenza virus
SAKHIEECSCY

SEQ ID NO: 403959 - protein, 11 aa, Influenza virus
AKHIEECSCYG

SEQ ID NO: 403960 - protein, 11 aa, Influenza virus
KHIEECSCYGH

SEQ ID NO: 403961 - protein, 11 aa, Influenza virus
HIEECSCYGHS

SEQ ID NO: 403962 - protein, 11 aa, Influenza virus
ATCVCRDNWQG

SEQ ID NO: 403963 - protein, 11 aa, Influenza virus
SCVCRDNWQGA

SEQ ID NO: 403964 - protein, 11 aa, Influenza virus
CGCRDNWQGAN

SEQ ID NO: 403965 - protein, 11 aa, Influenza virus
GCRDNWQGANR

SEQ ID NO: 403966 - protein, 11 aa, Influenza virus
RDNWQGANRPV

SEQ ID NO: 403967 - protein, 11 aa, Influenza virus
DNWQGANRPVI

SEQ ID NO: 403968 - protein, 11 aa, Influenza virus
NWQGANRPVIE

SEQ ID NO: 403969 - protein, 11 aa, Influenza virus
WQGANRPVIEI

SEQ ID NO: 403970 - protein, 11 aa, Influenza virus
QGANRPVIEID

SEQ ID NO: 403971 - protein, 11 aa, Influenza virus
GANRPVIEIDM

SEQ ID NO: 403972 - protein, 11 aa, Influenza virus
ANRPVIEIDMN

SEQ ID NO: 403973 - protein, 11 aa, Influenza virus
LEHTSRYICTG

SEQ ID NO: 403974 - protein, 11 aa, Influenza virus
YLCTGVLTDTS

SEQ ID NO: 403975 - protein, 11 aa, Influenza virus
LCTGVLTDTSR

SEQ ID NO: 403976 - protein, 11 aa, Influenza virus
CTGVLTDTSRP

SEQ ID NO: 403977 - protein, 11 aa, Influenza virus
TGVLTDTSRPS

SEQ ID NO: 403978 - protein, 11 aa, Influenza virus
GVLTDTSRPSD

SEQ ID NO: 403979 - protein, 11 aa, Influenza virus
VLTDTSRPSDK

SEQ ID NO: 403980 - protein, 11 aa, Influenza virus
GDCNNPITGSP

SEQ ID NO: 403981 - protein, 11 aa, Influenza virus
DCNNPITGSPG

SEQ ID NO: 403982 - protein, 11 aa, Influenza virus
NPITGSPGVPG

SEQ ID NO: 403983 - protein, 11 aa, Influenza virus
PGVKGFGFLDS

SEQ ID NO: 403984 - protein, 11 aa, Influenza virus
GNTWLGRTISP

SEQ ID NO: 403985 - protein, 11 aa, Influenza virus
NTWLGRTISPK

SEQ ID NO: 403986 - protein, 11 aa, Influenza virus
TWLGRTISPRL

SEQ ID NO: 403987 - protein, 11 aa, Influenza virus
WLGRTISPRLR

SEQ ID NO: 403988 - protein, 11 aa, Influenza virus
LGRTISPRLRS

SEQ ID NO: 403989 - protein, 11 aa, Influenza virus
GRTISPRLRSG

SEQ ID NO: 403990 - protein, 11 aa, Influenza virus
RTISPRLRSGF

SEQ ID NO: 403991 - protein, 11 aa, Influenza virus
TISPRLRSGFE

SEQ ID NO: 403992 - protein, 11 aa, Influenza virus
ISPRLRSGFEM

SEQ ID NO: 403993 - protein, 11 aa, Influenza virus
SPRLRSGFEML

SEQ ID NO: 403994 - protein, 11 aa, Influenza virus
PRLRSGFEMLK

SEQ ID NO: 403995 - protein, 11 aa, Influenza virus
RLRSGFEMLKI

SEQ ID NO: 403996 - protein, 11 aa, Influenza virus
LRSGFEMLKIP

SEQ ID NO: 403997 - protein, 11 aa, Influenza virus
RSGFEMLRIPN

SEQ ID NO: 403998 - protein, 11 aa, Influenza virus
SGFEMLRIPNA

SEQ ID NO: 403999 - protein, 11 aa, Influenza virus
GFEMLKIPNAE

SEQ ID NO: 404000 - protein, 11 aa, Influenza virus
FEMLKIPNAET

SEQ ID NO: 404001 - protein, 11 aa, Influenza virus
EMLKIPNAETD

SEQ ID NO: 404002 - protein, 11 aa, Influenza virus
MLKIPNAETDP

SEQ ID NO: 404003 - protein, 11 aa, Influenza virus
RQEIVSNDNWS

SEQ ID NO: 404004 - protein, 11 aa, Influenza virus
QEIVSNDNWSG

SEQ ID NO: 404005 - protein, 11 aa, Influenza virus
EIVSNDNWSGY

SEQ ID NO: 404006 - protein, 11 aa, Influenza virus
IVSNDNWSGYS

SEQ ID NO: 404007 - protein, 11 aa, Influenza virus
VSNDNWSGYSG

SEQ ID NO: 404008 - protein, 11 aa, Influenza virus
SNDNWSGYSGS

SEQ ID NO: 404009 - protein, 11 aa, Influenza virus
NDNWSGYSGSF

SEQ ID NO: 404010 - protein, 11 aa, Influenza virus
DNWSGYSGSFI

SEQ ID NO: 404011 - protein, 11 aa, Influenza virus
NRSGYSGSFID

SEQ ID NO: 404012 - protein, 11 aa, Influenza virus
RSGYSGSFIDY

SEQ ID NO: 404013 - protein, 11 aa, Influenza virus
GYSGSFIDYWD

SEQ ID NO: 404014 - protein, 11 aa, Influenza virus
YSGSFIDYWDE

SEQ ID NO: 404015 - protein, 11 aa, Influenza virus
NECYNPCFYVE

SEQ ID NO: 404016 - protein, 11 aa, Influenza virus
RGRPEEAKYVE

SEQ ID NO: 404017 - protein, 11 aa, Influenza virus
GRPEEAKYVEW

SEQ ID NO: 404018 - protein, 11 aa, Influenza virus
RPEEAKYVEWT

SEQ ID NO: 404019 - protein, 11 aa, Influenza virus
PEEAKYVEWTS

SEQ ID NO: 404020 - protein, 11 aa, Influenza virus
EEAKYVEWTSN

SEQ ID NO: 404021 - protein, 11 aa, Influenza virus
EAKYVEWTSNS

SEQ ID NO: 404022 - protein, 11 aa, Influenza virus
AKYVEWTSNSL

SEQ ID NO: 404023 - protein, 11 aa, Influenza virus
KYVWWTSNSLV

SEQ ID NO: 404024 - protein, 11 aa, Influenza virus
YVWWTSNSLVA

SEQ ID NO: 404025 - protein, 11 aa, Influenza virus
VWWTSNSLVAL

SEQ ID NO: 404026 - protein, 11 aa, Influenza virus
WWTSNSLVALC

SEQ ID NO: 404027 - protein, 11 aa, Influenza virus
WTSNSLVALCG

SEQ ID NO: 404028 - protein, 11 aa, Influenza virus
TSNSLVALCGS

SEQ ID NO: 404029 - protein, 11 aa, Influenza virus
SNSLVALCGSP

SEQ ID NO: 404030 - protein, 11 aa, Influenza virus
SVGSGSFPDGA

SEQ ID NO: 404031 - protein, 11 aa, Influenza virus
VGPGSFPDGAQ

SEQ ID NO: 404032 - protein, 11 aa, Influenza virus
GPGSFPDGAQI

SEQ ID NO: 404033 - protein, 11 aa, Influenza virus
SGSFPDGAQIK

SEQ ID NO: 404034 - protein, 11 aa, Influenza virus
GSFPDGAQIKY

SEQ ID NO: 404035 - protein, 11 aa, Influenza virus
SFPDGAQIKYF

SEQ ID NO: 404036 - protein, 11 aa, Influenza virus
FPDGAQIKYFS

SEQ ID NO: 404037 - protein, 11 aa, Influenza virus
LLVSTNAYDRI

SEQ ID NO: 404038 - protein, 11 aa, Influenza virus
LVSTNAYDRIC

SEQ ID NO: 404039 - protein, 11 aa, Influenza virus
VSTNAYDRICI

SEQ ID NO: 404040 - protein, 11 aa, Influenza virus
STNAHDRICIG

SEQ ID NO: 404041 - protein, 11 aa, Influenza virus
TNAHDRICIGY

SEQ ID NO: 404042 - protein, 11 aa, Influenza virus
NAHDRICIGYQ

SEQ ID NO: 404043 - protein, 11 aa, Influenza virus
AHDRICIGYQS

SEQ ID NO: 404044 - protein, 11 aa, Influenza virus
HDRICIGYQSN

SEQ ID NO: 404045 - protein, 11 aa, Influenza virus
CIGYQSNNSTN

SEQ ID NO: 404046 - protein, 11 aa, Influenza virus
IGYQSNNSTNT

SEQ ID NO: 404047 - protein, 11 aa, Influenza virus
GYQSNNSTNTV

SEQ ID NO: 404048 - protein, 11 aa, Influenza virus
YQSNNSTDTVD

SEQ ID NO: 404049 - protein, 11 aa, Influenza virus
QSNNSTDTVDT

SEQ ID NO: 404050 - protein, 11 aa, Influenza virus
SNNSTNTVNTL

SEQ ID NO: 404051 - protein, 11 aa, Influenza virus
NNSTDTVNTLM

SEQ ID NO: 404052 - protein, 11 aa, Influenza virus
NSTNTVNTLIE

SEQ ID NO: 404053 - protein, 11 aa, Influenza virus
STDTVNTLMEQ

SEQ ID NO: 404054 - protein, 11 aa, Influenza virus
TLMEQNVPVTQ

SEQ ID NO: 404055 - protein, 11 aa, Influenza virus
EQNVPVTQAME

SEQ ID NO: 404056 - protein, 11 aa, Influenza virus
QNVPVTQAMEL

SEQ ID NO: 404057 - protein, 11 aa, Influenza virus
NVPVTQAMELV

SEQ ID NO: 404058 - protein, 11 aa, Influenza virus
VPVTQAMELVE

SEQ ID NO: 404059 - protein, 11 aa, Influenza virus
PVTQTMELVEA

SEQ ID NO: 404060 - protein, 11 aa, Influenza virus
VTQTMELVEAE

SEQ ID NO: 404061 - protein, 11 aa, Influenza virus
TQTMELVEAEK

SEQ ID NO: 404062 - protein, 11 aa, Influenza virus
QTMELVEAEKH

SEQ ID NO: 404063 - protein, 11 aa, Influenza virus
EKHSAYCNTDL

SEQ ID NO: 404064 - protein, 11 aa, Influenza virus
KHSAYCNTDLG

SEQ ID NO: 404065 - protein, 11 aa, Influenza virus
PAYCNTDLGAP

SEQ ID NO: 404066 - protein, 11 aa, Influenza virus
AYCNTDLGTPL

SEQ ID NO: 404067 - protein, 11 aa, Influenza virus
YCNTDLGTPLE

SEQ ID NO: 404068 - protein, 11 aa, Influenza virus
CNTDLGTPLEL

SEQ ID NO: 404069 - protein, 11 aa, Influenza virus
NTDLGTPLELR

SEQ ID NO: 404070 - protein, 11 aa, Influenza virus
TDLGTPLELRD

SEQ ID NO: 404071 - protein, 11 aa, Influenza virus
DLGTPLELRDC

SEQ ID NO: 404072 - protein, 11 aa, Influenza virus
LGTPLELRDCK

SEQ ID NO: 404073 - protein, 11 aa, Influenza virus
GTPLELRDCKI

SEQ ID NO: 404074 - protein, 11 aa, Influenza virus
TPLELRDCKIE

SEQ ID NO: 404075 - protein, 11 aa, Influenza virus
PLELRDCKVEA

SEQ ID NO: 404076 - protein, 11 aa, Influenza virus
LELRDCKVEAV

SEQ ID NO: 404077 - protein, 11 aa, Influenza virus
ELRDCKVEAVI

SEQ ID NO: 404078 - protein, 11 aa, Influenza virus
LRDCKVEAVIY

SEQ ID NO: 404079 - protein, 11 aa, Influenza virus
RDCKVEAVIYG

SEQ ID NO: 404080 - protein, 11 aa, Influenza virus
DCKVEAVIYGN

SEQ ID NO: 404081 - protein, 11 aa, Influenza virus
CKVEAVIYGNP

SEQ ID NO: 404082 - protein, 11 aa, Influenza virus
KVEAVIYGNPK

SEQ ID NO: 404083 - protein, 11 aa, Influenza virus
VEAVIYGNPKC

SEQ ID NO: 404084 - protein, 11 aa, Influenza virus
AVIYGNPKCDV

SEQ ID NO: 404085 - protein, 11 aa, Influenza virus
VIYGNPKCDVH

SEQ ID NO: 404086 - protein, 11 aa, Influenza virus
IYGNPKCDVHL

SEQ ID NO: 404087 - protein, 11 aa, Influenza virus
YGNPKCDVHLK

SEQ ID NO: 404088 - protein, 11 aa, Influenza virus
GNPKCDVHLKD

SEQ ID NO: 404089 - protein, 11 aa, Influenza virus
NPKCDVHLKDQ

SEQ ID NO: 404090 - protein, 11 aa, Influenza virus
HLKDQSWSYIV

SEQ ID NO: 404091 - protein, 11 aa, Influenza virus
LKDQSWSYIVE

SEQ ID NO: 404092 - protein, 11 aa, Influenza virus
KDQDWSYIVER

SEQ ID NO: 404093 - protein, 11 aa, Influenza virus
DQDWSYIVERP

SEQ ID NO: 404094 - protein, 11 aa, Influenza virus
QDWSYIVERPS

SEQ ID NO: 404095 - protein, 11 aa, Influenza virus
SWSYIVERPSA

SEQ ID NO: 404096 - protein, 11 aa, Influenza virus
SAPEGMCYPGF

SEQ ID NO: 404097 - protein, 11 aa, Influenza virus
APEGMCYPGSI

SEQ ID NO: 404098 - protein, 11 aa, Influenza virus
PEGMCYPGSIE

SEQ ID NO: 404099 - protein, 11 aa, Influenza virus
EGMCYPGSIEN

SEQ ID NO: 404100 - protein, 11 aa, Influenza virus
GMCYPGSIENL

SEQ ID NO: 404101 - protein, 11 aa, Influenza virus
MCYPGSIENLE

SEQ ID NO: 404102 - protein, 11 aa, Influenza virus
CYPGSIENLEE

SEQ ID NO: 404103 - protein, 11 aa, Influenza virus
YPGSIENLEEL

SEQ ID NO: 404104 - protein, 11 aa, Influenza virus
PGSIENLEELR

SEQ ID NO: 404105 - protein, 11 aa, Influenza virus
GSIENLEELRF

SEQ ID NO: 404106 - protein, 11 aa, Influenza virus
SIENLEELRFV

SEQ ID NO: 404107 - protein, 11 aa, Influenza virus
IENLEELRFVF

SEQ ID NO: 404108 - protein, 11 aa, Influenza virus
NLEELRFVFSS

SEQ ID NO: 404109 - protein, 11 aa, Influenza virus
LEELRFVFSSA

SEQ ID NO: 404110 - protein, 11 aa, Influenza virus
EELRFVFSSAA

SEQ ID NO: 404111 - protein, 11 aa, Influenza virus
ELRFVFSSAAS

SEQ ID NO: 404112 - protein, 11 aa, Influenza virus
LRFVFSSAASY

SEQ ID NO: 404113 - protein, 11 aa, Influenza virus
RFVFSSAASYK

SEQ ID NO: 404114 - protein, 11 aa, Influenza virus
FVFSSAASYKR

SEQ ID NO: 404115 - protein, 11 aa, Influenza virus
VFSSAASYKRI

SEQ ID NO: 404116 - protein, 11 aa, Influenza virus
FSSAASYKRIR

SEQ ID NO: 404117 - protein, 11 aa, Influenza virus
SSAASYKRIRL

SEQ ID NO: 404118 - protein, 11 aa, Influenza virus
SAASYKRIRLF

SEQ ID NO: 404119 - protein, 11 aa, Influenza virus
AASYKRVRLFD

SEQ ID NO: 404120 - protein, 11 aa, Influenza virus
ASYKRVRLFDY

SEQ ID NO: 404121 - protein, 11 aa, Influenza virus
SYKRVRLFDYS

SEQ ID NO: 404122 - protein, 11 aa, Influenza virus
YKRIRLFDYSK

SEQ ID NO: 404123 - protein, 11 aa, Influenza virus
KRIRLFDYSKW

SEQ ID NO: 404124 - protein, 11 aa, Influenza virus
RIRLFDYSKWN

SEQ ID NO: 404125 - protein, 11 aa, Influenza virus
IRLFDYSKWNV

SEQ ID NO: 404126 - protein, 11 aa, Influenza virus
RLFDYSKWNVT

SEQ ID NO: 404127 - protein, 11 aa, Influenza virus
WNVTRSGTSKA

SEQ ID NO: 404128 - protein, 11 aa, Influenza virus
NVTRSGTSKAC

SEQ ID NO: 404129 - protein, 11 aa, Influenza virus
VTRSGTSKACN

SEQ ID NO: 404130 - protein, 11 aa, Influenza virus
TRSGTSKACNA

SEQ ID NO: 404131 - protein, 11 aa, Influenza virus
RSGTSKACNAS

SEQ ID NO: 404132 - protein, 11 aa, Influenza virus
SGTSKACSAST

SEQ ID NO: 404133 - protein, 11 aa, Influenza virus
GTSKACSASTG

SEQ ID NO: 404134 - protein, 11 aa, Influenza virus
TSKACSASTGG

SEQ ID NO: 404135 - protein, 11 aa, Influenza virus
SKACSASTGGQ

SEQ ID NO: 404136 - protein, 11 aa, Influenza virus
KACNASTGGQA

SEQ ID NO: 404137 - protein, 11 aa, Influenza virus
ACNASTGGQAF

SEQ ID NO: 404138 - protein, 11 aa, Influenza virus
CNASTGGQAFY

SEQ ID NO: 404139 - protein, 11 aa, Influenza virus
NASTGGQAFYR

SEQ ID NO: 404140 - protein, 11 aa, Influenza virus
ASTGGQAFYRS

SEQ ID NO: 404141 - protein, 11 aa, Influenza virus
STGGQAFYRSI

SEQ ID NO: 404142 - protein, 11 aa, Influenza virus
TGGQAFYRSIN

SEQ ID NO: 404143 - protein, 11 aa, Influenza virus
GGQAFYRSINW

SEQ ID NO: 404144 - protein, 11 aa, Influenza virus
GQAFYRSINWL

SEQ ID NO: 404145 - protein, 11 aa, Influenza virus
QAFYRSINWLT

SEQ ID NO: 404146 - protein, 11 aa, Influenza virus
AFYRSINWLTK

SEQ ID NO: 404147 - protein, 11 aa, Influenza virus
YRSINWLTKKE

SEQ ID NO: 404148 - protein, 11 aa, Influenza virus
RSINWLTKKKN

SEQ ID NO: 404149 - protein, 11 aa, Influenza virus
SINWLTKKKNP

SEQ ID NO: 404150 - protein, 11 aa, Influenza virus
INWLTKKKNPE

SEQ ID NO: 404151 - protein, 11 aa, Influenza virus
NWLTKKKNPEA

SEQ ID NO: 404152 - protein, 11 aa, Influenza virus
WLTKKKNPEAY

SEQ ID NO: 404153 - protein, 11 aa, Influenza virus
LTKKKNPEAYN

SEQ ID NO: 404154 - protein, 11 aa, Influenza virus
TKKKNPEAYNF

SEQ ID NO: 404155 - protein, 11 aa, Influenza virus
KKKNPEAYNFN

SEQ ID NO: 404156 - protein, 11 aa, Influenza virus
KKNPEAYNFNE

SEQ ID NO: 404157 - protein, 11 aa, Influenza virus
PDTYDFNEGTY

SEQ ID NO: 404158 - protein, 11 aa, Influenza virus
NNEDGNIIFLW

SEQ ID NO: 404159 - protein, 11 aa, Influenza virus
NEDGNIIFLWG

SEQ ID NO: 404160 - protein, 11 aa, Influenza virus
EDGNIIFLWGI

SEQ ID NO: 404161 - protein, 11 aa, Influenza virus
DGNIIFLWGIH

SEQ ID NO: 404162 - protein, 11 aa, Influenza virus
GNIIFLWGIHH

SEQ ID NO: 404163 - protein, 11 aa, Influenza virus
NIIFLWGIHHP

SEQ ID NO: 404164 - protein, 11 aa, Influenza virus
IFLWGIHHPPN

SEQ ID NO: 404165 - protein, 11 aa, Influenza virus
FLWGIHHPPDA

SEQ ID NO: 404166 - protein, 11 aa, Influenza virus
LWGIHHPPDAK

SEQ ID NO: 404167 - protein, 11 aa, Influenza virus
WGIHHPPDAKE

SEQ ID NO: 404168 - protein, 11 aa, Influenza virus
GIHHPPDAKEQ

SEQ ID NO: 404169 - protein, 11 aa, Influenza virus
IHHPPDAKEQT

SEQ ID NO: 404170 - protein, 11 aa, Influenza virus
AKEQTTLYKNA

SEQ ID NO: 404171 - protein, 11 aa, Influenza virus
KEQTALYKNAN

SEQ ID NO: 404172 - protein, 11 aa, Influenza virus
EQTALYKNANT

SEQ ID NO: 404173 - protein, 11 aa, Influenza virus
QTALYKNANTL

SEQ ID NO: 404174 - protein, 11 aa, Influenza virus
TALYKNANTLS

SEQ ID NO: 404175 - protein, 11 aa, Influenza virus
ALYKNANTLSS

SEQ ID NO: 404176 - protein, 11 aa, Influenza virus
LYKNTNTLSSV

SEQ ID NO: 404177 - protein, 11 aa, Influenza virus
YKNTNTLSSVT

SEQ ID NO: 404178 - protein, 11 aa, Influenza virus
KNANTLSSVNT

SEQ ID NO: 404179 - protein, 11 aa, Influenza virus
NANTLSSVNTN

SEQ ID NO: 404180 - protein, 11 aa, Influenza virus
TNTLSSVTTNT

SEQ ID NO: 404181 - protein, 11 aa, Influenza virus
NTLSSVNTNTI

SEQ ID NO: 404182 - protein, 11 aa, Influenza virus
TLSSVNTNTIN

SEQ ID NO: 404183 - protein, 11 aa, Influenza virus
LSSVNTNTINR

SEQ ID NO: 404184 - protein, 11 aa, Influenza virus
SSVTTNTINRI

SEQ ID NO: 404185 - protein, 11 aa, Influenza virus
SVTTNTINRIF

SEQ ID NO: 404186 - protein, 11 aa, Influenza virus
VTTNTINRSFR

SEQ ID NO: 404187 - protein, 11 aa, Influenza virus
TTNTINRSFRP

SEQ ID NO: 404188 - protein, 11 aa, Influenza virus
TNTINRIFQPN

SEQ ID NO: 404189 - protein, 11 aa, Influenza virus
NTINRSFRPNI

SEQ ID NO: 404190 - protein, 11 aa, Influenza virus
TINRSFRPNIG

SEQ ID NO: 404191 - protein, 11 aa, Influenza virus
INRSFRPNIGP

SEQ ID NO: 404192 - protein, 11 aa, Influenza virus
NRSFRPNIGPR

SEQ ID NO: 404193 - protein, 11 aa, Influenza virus
RSFRPNIGPRP

SEQ ID NO: 404194 - protein, 11 aa, Influenza virus
SFRPNIGPRPL

SEQ ID NO: 404195 - protein, 11 aa, Influenza virus
FRPNIGPRPLV

SEQ ID NO: 404196 - protein, 11 aa, Influenza virus
RPNIGPRPLVR

SEQ ID NO: 404197 - protein, 11 aa, Influenza virus
PNIGPRALVRG

SEQ ID NO: 404198 - protein, 11 aa, Influenza virus
NIGPRPLVREQ

SEQ ID NO: 404199 - protein, 11 aa, Influenza virus
IGPRALVRGQQ

SEQ ID NO: 404200 - protein, 11 aa, Influenza virus
GPRALVRGQQG

SEQ ID NO: 404201 - protein, 11 aa, Influenza virus
PRPLVRGQQGT

SEQ ID NO: 404202 - protein, 11 aa, Influenza virus
RALVRGQQGRM

SEQ ID NO: 404203 - protein, 11 aa, Influenza virus
PLVRGQQGWMD

SEQ ID NO: 404204 - protein, 11 aa, Influenza virus
LVREQQGRMDY

SEQ ID NO: 404205 - protein, 11 aa, Influenza virus
VRGQQGWMDYY

SEQ ID NO: 404206 - protein, 11 aa, Influenza virus
RGQQGTMDYYW

SEQ ID NO: 404207 - protein, 11 aa, Influenza virus
GQQGTMDYYWG

SEQ ID NO: 404208 - protein, 11 aa, Influenza virus
QQGWMDYYWGI

SEQ ID NO: 404209 - protein, 11 aa, Influenza virus
QGTMDYYWGIL

SEQ ID NO: 404210 - protein, 11 aa, Influenza virus
GTMDYYWGILK

SEQ ID NO: 404211 - protein, 11 aa, Influenza virus
TMDYYWGILKR

SEQ ID NO: 404212 - protein, 11 aa, Influenza virus
LIAPEFGYLLR

SEQ ID NO: 404213 - protein, 11 aa, Influenza virus
IAPEFGYLLRG

SEQ ID NO: 404214 - protein, 11 aa, Influenza virus
APEFGYLLRGE

SEQ ID NO: 404215 - protein, 11 aa, Influenza virus
PEFGYLLRGES

SEQ ID NO: 404216 - protein, 11 aa, Influenza virus
EFGYLLKGESY

SEQ ID NO: 404217 - protein, 11 aa, Influenza virus
FGYLLKGESYG

SEQ ID NO: 404218 - protein, 11 aa, Influenza virus
GYLLKGESYGR

SEQ ID NO: 404219 - protein, 11 aa, Influenza virus
GESYGRIIQNE

SEQ ID NO: 404220 - protein, 11 aa, Influenza virus
ESYGRIIQNED

SEQ ID NO: 404221 - protein, 11 aa, Influenza virus
SYGRIIQNEDI

SEQ ID NO: 404222 - protein, 11 aa, Influenza virus
YGRIIQNEDIP

SEQ ID NO: 404223 - protein, 11 aa, Influenza virus
CRIIQNEDIPI

SEQ ID NO: 404224 - protein, 11 aa, Influenza virus
RIIQNEDIPIE

SEQ ID NO: 404225 - protein, 11 aa, Influenza virus
IIQNEDIPIGS

SEQ ID NO: 404226 - protein, 11 aa, Influenza virus
IQNEDIPIGSC

SEQ ID NO: 404227 - protein, 11 aa, Influenza virus
CNTKCQTYAGA

SEQ ID NO: 404228 - protein, 11 aa, Influenza virus
TKCQTYTGAIN

SEQ ID NO: 404229 - protein, 11 aa, Influenza virus
KCQTYTGAINS

SEQ ID NO: 404230 - protein, 11 aa, Influenza virus
CQTYTGAINSS

SEQ ID NO: 404231 - protein, 11 aa, Influenza virus
QTYTGAINSSK

SEQ ID NO: 404232 - protein, 11 aa, Influenza virus
TYTGAINSSRP

SEQ ID NO: 404233 - protein, 11 aa, Influenza virus
GAINSSRPFQN

SEQ ID NO: 404234 - protein, 11 aa, Influenza virus
AINSSRPFQNA

SEQ ID NO: 404235 - protein, 11 aa, Influenza virus
INSSRPFQNAS

SEQ ID NO: 404236 - protein, 11 aa, Influenza virus
NSSRPFQNASR

SEQ ID NO: 404237 - protein, 11 aa, Influenza virus
SSRPFQNASRH

SEQ ID NO: 404238 - protein, 11 aa, Influenza virus
PFQNASRYYMG

SEQ ID NO: 404239 - protein, 11 aa, Influenza virus
FQNTSRHYMGE

SEQ ID NO: 404240 - protein, 11 aa, Influenza virus
QNTSRHYMGEC

SEQ ID NO: 404241 - protein, 11 aa, Influenza virus
NASRYYMGECP

SEQ ID NO: 404242 - protein, 11 aa, Influenza virus
SRHYMGECPNY

SEQ ID NO: 404243 - protein, 11 aa, Influenza virus
KKESLRLAVGL

SEQ ID NO: 404244 - protein, 11 aa, Influenza virus
KESLRLAVGLR

SEQ ID NO: 404245 - protein, 11 aa, Influenza virus
ESLRLAVGLRN

SEQ ID NO: 404246 - protein, 11 aa, Influenza virus
SLRLALGLRNT

SEQ ID NO: 404247 - protein, 11 aa, Influenza virus
LRLALGLRNTP

SEQ ID NO: 404248 - protein, 11 aa, Influenza virus
RLALGLRNTPS

SEQ ID NO: 404249 - protein, 11 aa, Influenza virus
LAVGLRNTPSV

SEQ ID NO: 404250 - protein, 11 aa, Influenza virus
AVGLRNTPSVE

SEQ ID NO: 404251 - protein, 11 aa, Influenza virus
VGLRNTPSVEP

SEQ ID NO: 404252 - protein, 11 aa, Influenza virus
GLRNTPSVEPK

SEQ ID NO: 404253 - protein, 11 aa, Influenza virus
LRNTPSVEPRG

SEQ ID NO: 404254 - protein, 11 aa, Influenza virus
RNTPSVEPKGL

SEQ ID NO: 404255 - protein, 11 aa, Influenza virus
NTPSVEPKGLF

SEQ ID NO: 404256 - protein, 11 aa, Influenza virus
TPSVEPRGLFG

SEQ ID NO: 404257 - protein, 11 aa, Influenza virus
PSVEPRGLFGA

SEQ ID NO: 404258 - protein, 11 aa, Influenza virus
SVEPKGLFGAI

SEQ ID NO: 404259 - protein, 11 aa, Influenza virus
VEPRGLFGAIA

SEQ ID NO: 404260 - protein, 11 aa, Influenza virus
EPRGLFGAIAG

SEQ ID NO: 404261 - protein, 11 aa, Influenza virus
PRGLFGAIAGF

SEQ ID NO: 404262 - protein, 11 aa, Influenza virus
RGLFGAIAGFI

SEQ ID NO: 404263 - protein, 11 aa, Influenza virus
AIAGFIEGGWC

SEQ ID NO: 404264 - protein, 11 aa, Influenza virus
IAGFIEGGWCG

SEQ ID NO: 404265 - protein, 11 aa, Influenza virus
AGFIEGGWCGM

SEQ ID NO: 404266 - protein, 11 aa, Influenza virus
GFIEGGWCGMI

SEQ ID NO: 404267 - protein, 11 aa, Influenza virus
FIEGGWCGMID

SEQ ID NO: 404268 - protein, 11 aa, Influenza virus
IEGGWCGMIDG

SEQ ID NO: 404269 - protein, 11 aa, Influenza virus
EGGWCGMIDGW

SEQ ID NO: 404270 - protein, 11 aa, Influenza virus
GGWCGMIDGWY

SEQ ID NO: 404271 - protein, 11 aa, Influenza virus
GWCGMIDGWYG

SEQ ID NO: 404272 - protein, 11 aa, Influenza virus
WCGMIDGWYGF

SEQ ID NO: 404273 - protein, 11 aa, Influenza virus
CGMIDGWYGFH

SEQ ID NO: 404274 - protein, 11 aa, Influenza virus
DGWYGFHHSNA

SEQ ID NO: 404275 - protein, 11 aa, Influenza virus
GWYGFHHSNAE

SEQ ID NO: 404276 - protein, 11 aa, Influenza virus
WYGFHHSNAEG

SEQ ID NO: 404277 - protein, 11 aa, Influenza virus
YGFHHSNAEGT

SEQ ID NO: 404278 - protein, 11 aa, Influenza virus
GFHHSNAEGTG

SEQ ID NO: 404279 - protein, 11 aa, Influenza virus
FHHSNAEGTGM

SEQ ID NO: 404280 - protein, 11 aa, Influenza virus
HHSNAEGTGMA

SEQ ID NO: 404281 - protein, 11 aa, Influenza virus
HSNAEGTGMAA

SEQ ID NO: 404282 - protein, 11 aa, Influenza virus
SNAEGTGMAAD

SEQ ID NO: 404283 - protein, 11 aa, Influenza virus
NAEGTGMAADQ

SEQ ID NO: 404284 - protein, 11 aa, Influenza virus
AEGTGMAADQK

SEQ ID NO: 404285 - protein, 11 aa, Influenza virus
ADQKSTQEAIE

SEQ ID NO: 404286 - protein, 11 aa, Influenza virus
DQKSTQEAIGK

SEQ ID NO: 404287 - protein, 11 aa, Influenza virus
QKSTQEAIEKI

SEQ ID NO: 404288 - protein, 11 aa, Influenza virus
KSTQEAIGKIT

SEQ ID NO: 404289 - protein, 11 aa, Influenza virus
STQEAIEKITN

SEQ ID NO: 404290 - protein, 11 aa, Influenza virus
TQEAIEKITNK

SEQ ID NO: 404291 - protein, 11 aa, Influenza virus
QEAIDKITNKI

SEQ ID NO: 404292 - protein, 11 aa, Influenza virus
EAIDKITNKIN

SEQ ID NO: 404293 - protein, 11 aa, Influenza virus
AIDKITNKINN

SEQ ID NO: 404294 - protein, 11 aa, Influenza virus
IDKITNKINNI

SEQ ID NO: 404295 - protein, 11 aa, Influenza virus
DKITNKINNIV

SEQ ID NO: 404296 - protein, 11 aa, Influenza virus
KITNKINNIVD

SEQ ID NO: 404297 - protein, 11 aa, Influenza virus
ITNKINNIVDK

SEQ ID NO: 404298 - protein, 11 aa, Influenza virus
TNKINNIVDKM

SEQ ID NO: 404299 - protein, 11 aa, Influenza virus
NKINNIVDKMN

SEQ ID NO: 404300 - protein, 11 aa, Influenza virus
KINNIVDKMNR

SEQ ID NO: 404301 - protein, 11 aa, Influenza virus
INNIVDKMNRE

SEQ ID NO: 404302 - protein, 11 aa, Influenza virus
NIVDKMNREFG

SEQ ID NO: 404303 - protein, 11 aa, Influenza virus
IVDKMNREFGV

SEQ ID NO: 404304 - protein, 11 aa, Influenza virus
VDKMNREFGVV

SEQ ID NO: 404305 - protein, 11 aa, Influenza virus
DKMNREFGVVN

SEQ ID NO: 404306 - protein, 11 aa, Influenza virus
KMNREFGVVNH

SEQ ID NO: 404307 - protein, 11 aa, Influenza virus
MNREFGVVNHE

SEQ ID NO: 404308 - protein, 11 aa, Influenza virus
NREFGVVNHEF

SEQ ID NO: 404309 - protein, 11 aa, Influenza virus
REFGVVNHEFS

SEQ ID NO: 404310 - protein, 11 aa, Influenza virus
EKRINMISDKI

SEQ ID NO: 404311 - protein, 11 aa, Influenza virus
INMINDKINDQ

SEQ ID NO: 404312 - protein, 11 aa, Influenza virus
NMINDKINDQI

SEQ ID NO: 404313 - protein, 11 aa, Influenza virus
MINDKINDQIE

SEQ ID NO: 404314 - protein, 11 aa, Influenza virus
DKINDQIEDLW

SEQ ID NO: 404315 - protein, 11 aa, Influenza virus
KINDQIEDLWA

SEQ ID NO: 404316 - protein, 11 aa, Influenza virus
INDQIEDLWAY

SEQ ID NO: 404317 - protein, 11 aa, Influenza virus
NDQIEDLWAYN

SEQ ID NO: 404318 - protein, 11 aa, Influenza virus
DQIENLWAYNA

SEQ ID NO: 404319 - protein, 11 aa, Influenza virus
QIEGLWAYNAE

SEQ ID NO: 404320 - protein, 11 aa, Influenza virus
IEGLWAYNAEL

SEQ ID NO: 404321 - protein, 11 aa, Influenza virus
EGLWAYNAELL

SEQ ID NO: 404322 - protein, 11 aa, Influenza virus
GLWAYNAELLV

SEQ ID NO: 404323 - protein, 11 aa, Influenza virus
ELLVLLENQKI

SEQ ID NO: 404324 - protein, 11 aa, Influenza virus
LLVLLENQKIL

SEQ ID NO: 404325 - protein, 11 aa, Influenza virus
LVLLENQKILD

SEQ ID NO: 404326 - protein, 11 aa, Influenza virus
VLLENQKILDE

SEQ ID NO: 404327 - protein, 11 aa, Influenza virus
LLENQKILDEH

SEQ ID NO: 404328 - protein, 11 aa, Influenza virus
LENQKILDEHD

SEQ ID NO: 404329 - protein, 11 aa, Influenza virus
ENQKILDEHDS

SEQ ID NO: 404330 - protein, 11 aa, Influenza virus
NQKILDEHDSN

SEQ ID NO: 404331 - protein, 11 aa, Influenza virus
QKILDEHDSNV

SEQ ID NO: 404332 - protein, 11 aa, Influenza virus
KILDEHDSNVK

SEQ ID NO: 404333 - protein, 11 aa, Influenza virus
ILDEHDSNVKN

SEQ ID NO: 404334 - protein, 11 aa, Influenza virus
LDEHDSNVENL

SEQ ID NO: 404335 - protein, 11 aa, Influenza virus
DKHDSNVKNLF

SEQ ID NO: 404336 - protein, 11 aa, Influenza virus
EHDSNVENLFD

SEQ ID NO: 404337 - protein, 11 aa, Influenza virus
HDSNVENLFDE

SEQ ID NO: 404338 - protein, 11 aa, Influenza virus
DSNVENLFDEV

SEQ ID NO: 404339 - protein, 11 aa, Influenza virus
SNVKNLFDEVR

SEQ ID NO: 404340 - protein, 11 aa, Influenza virus
NVKNLFDEVRR

SEQ ID NO: 404341 - protein, 11 aa, Influenza virus
VKNLFDEVRRR

SEQ ID NO: 404342 - protein, 11 aa, Influenza virus
KNLFDEVRRRL

SEQ ID NO: 404343 - protein, 11 aa, Influenza virus
NLFDEVRRRLS

SEQ ID NO: 404344 - protein, 11 aa, Influenza virus
LFDEVKRRLST

SEQ ID NO: 404345 - protein, 11 aa, Influenza virus
FDEVKRRLSTN

SEQ ID NO: 404346 - protein, 11 aa, Influenza virus
DEVKRRLSTNA

SEQ ID NO: 404347 - protein, 11 aa, Influenza virus
NAIDTGNGCFD

SEQ ID NO: 404348 - protein, 11 aa, Influenza virus
AIDTGNGCFDI

SEQ ID NO: 404349 - protein, 11 aa, Influenza virus
IDTGNGCFDIL

SEQ ID NO: 404350 - protein, 11 aa, Influenza virus
DTGNGCFDILH

SEQ ID NO: 404351 - protein, 11 aa, Influenza virus
TGNGCFDILHK

SEQ ID NO: 404352 - protein, 11 aa, Influenza virus
GKGCFDILHKC

SEQ ID NO: 404353 - protein, 11 aa, Influenza virus
NGCFDILHKCD

SEQ ID NO: 404354 - protein, 11 aa, Influenza virus
GCFDILHKCDN

SEQ ID NO: 404355 - protein, 11 aa, Influenza virus
CFDILHKCDNE

SEQ ID NO: 404356 - protein, 11 aa, Influenza virus
FDILHKCDNEC

SEQ ID NO: 404357 - protein, 11 aa, Influenza virus
DILHKCDNECM

SEQ ID NO: 404358 - protein, 11 aa, Influenza virus
ILHKCDNECME

SEQ ID NO: 404359 - protein, 11 aa, Influenza virus
LHKCDNECMET

SEQ ID NO: 404360 - protein, 11 aa, Influenza virus
HKCDNECMETI

SEQ ID NO: 404361 - protein, 11 aa, Influenza virus
KCDNECMETIK

SEQ ID NO: 404362 - protein, 11 aa, Influenza virus
CDNECMETIKN

SEQ ID NO: 404363 - protein, 11 aa, Influenza virus
DNECMETIKNG

SEQ ID NO: 404364 - protein, 11 aa, Influenza virus
NKCMETIKNGT

SEQ ID NO: 404365 - protein, 11 aa, Influenza virus
KCMETIKNGTY

SEQ ID NO: 404366 - protein, 11 aa, Influenza virus
CMETIKNGTYD

SEQ ID NO: 404367 - protein, 11 aa, Influenza virus
METIKNGTYNH

SEQ ID NO: 404368 - protein, 11 aa, Influenza virus
ETIKNGTYNHK

SEQ ID NO: 404369 - protein, 11 aa, Influenza virus
TIKNGTYDHKE

SEQ ID NO: 404370 - protein, 11 aa, Influenza virus
IKNGTYNHKEY

SEQ ID NO: 404371 - protein, 11 aa, Influenza virus
KNGTYDHKEYE

SEQ ID NO: 404372 - protein, 11 aa, Influenza virus
NGTYDHKEYEE

SEQ ID NO: 404373 - protein, 11 aa, Influenza virus
GTYDHKEYEEE

SEQ ID NO: 404374 - protein, 11 aa, Influenza virus
TYNHKEYEEEA

SEQ ID NO: 404375 - protein, 11 aa, Influenza virus
YDHKEYEEEAK

SEQ ID NO: 404376 - protein, 11 aa, Influenza virus
DHKEYEEEAKL

SEQ ID NO: 404377 - protein, 11 aa, Influenza virus
HKDYEEEAKLE

SEQ ID NO: 404378 - protein, 11 aa, Influenza virus
KDYEEEAKLER

SEQ ID NO: 404379 - protein, 11 aa, Influenza virus
DYEEEAKLERS

SEQ ID NO: 404380 - protein, 11 aa, Influenza virus
YEEEAKLEKSR

SEQ ID NO: 404381 - protein, 11 aa, Influenza virus
EEEAKLEKSRI

SEQ ID NO: 404382 - protein, 11 aa, Influenza virus
EEAKLEKSRIN

SEQ ID NO: 404383 - protein, 11 aa, Influenza virus
EAKLERSKINE

SEQ ID NO: 404384 - protein, 11 aa, Influenza virus
AKLERSKINEV

SEQ ID NO: 404385 - protein, 11 aa, Influenza virus
KLEKSRINGVK

SEQ ID NO: 404386 - protein, 11 aa, Influenza virus
LEKSRINGVKL

SEQ ID NO: 404387 - protein, 11 aa, Influenza virus
ERSKINEVKLE

SEQ ID NO: 404388 - protein, 11 aa, Influenza virus
KSRINGVKLEE

SEQ ID NO: 404389 - protein, 11 aa, Influenza virus
SKINGVRLEEN

SEQ ID NO: 404390 - protein, 11 aa, Influenza virus
KINGVILEENT

SEQ ID NO: 404391 - protein, 11 aa, Influenza virus
INGVILEENTT

SEQ ID NO: 404392 - protein, 11 aa, Influenza virus
NEVKLEENTTY

SEQ ID NO: 404393 - protein, 11 aa, Influenza virus
VILEENTTYKI

SEQ ID NO: 404394 - protein, 11 aa, Influenza virus
RLEENTTYKIL

SEQ ID NO: 404395 - protein, 11 aa, Influenza virus
LEENTTYRILS

SEQ ID NO: 404396 - protein, 11 aa, Influenza virus
EENTTYRILSI

SEQ ID NO: 404397 - protein, 11 aa, Influenza virus
ENTTYRILSIY

SEQ ID NO: 404398 - protein, 11 aa, Influenza virus
NTSYKILSIYS

SEQ ID NO: 404399 - protein, 11 aa, Influenza virus
TSYKILSIYST

SEQ ID NO: 404400 - protein, 11 aa, Influenza virus
TYRILSIYSTV

SEQ ID NO: 404401 - protein, 11 aa, Influenza virus
YRILSIYSTVA

SEQ ID NO: 404402 - protein, 11 aa, Influenza virus
RILSIYSTVAA

SEQ ID NO: 404403 - protein, 11 aa, Influenza virus
STVAASLCLAV

SEQ ID NO: 404404 - protein, 11 aa, Influenza virus
TVAASLCLAVL

SEQ ID NO: 404405 - protein, 11 aa, Influenza virus
VAASLCLAVLI

SEQ ID NO: 404406 - protein, 11 aa, Influenza virus
AASLCLAILVA

SEQ ID NO: 404407 - protein, 11 aa, Influenza virus
ASLCLAVLIAG

SEQ ID NO: 404408 - protein, 11 aa, Influenza virus
SLCLAILVAGG

SEQ ID NO: 404409 - protein, 11 aa, Influenza virus
LCLAILVAGGL

SEQ ID NO: 404410 - protein, 11 aa, Influenza virus
CLAVLIAGGLI

SEQ ID NO: 404411 - protein, 11 aa, Influenza virus
LAVLIAGGLIL

SEQ ID NO: 404412 - protein, 11 aa, Influenza virus
AILVAGGLILG

SEQ ID NO: 404413 - protein, 11 aa, Influenza virus
ILVAGGLILGM

SEQ ID NO: 404414 - protein, 11 aa, Influenza virus
LVAGGLILGMQ

SEQ ID NO: 404415 - protein, 11 aa, Influenza virus
VAGGLILGMQN

SEQ ID NO: 404416 - protein, 11 aa, Influenza virus
GLILGMQNGSY

SEQ ID NO: 404417 - protein, 11 aa, Influenza virus
LILGMQNGSYR

SEQ ID NO: 404418 - protein, 11 aa, Influenza virus
ILGMQNGSYRC

SEQ ID NO: 404419 - protein, 11 aa, Influenza virus
LGMQNGSYRCM

SEQ ID NO: 404420 - protein, 11 aa, Influenza virus
GMQNGSYRCMF

SEQ ID NO: 404421 - protein, 11 aa, Influenza virus
MQNGSYRCMFC

SEQ ID NO: 404422 - protein, 11 aa, Influenza virus
QNGSYRCMFCI

SEQ ID NO: 404423 - protein, 11 aa, Influenza virus
EGLVYGNPSCD

SEQ ID NO: 404424 - protein, 11 aa, Influenza virus
LKPGQTLRVRS

SEQ ID NO: 404425 - protein, 11 aa, Influenza virus
RGIFGAIAGFI

SEQ ID NO: 404426 - protein, 11 aa, Influenza virus
GIFGAIAGFIE

SEQ ID NO: 404427 - protein, 11 aa, Influenza virus
IFGAIAGFIEG

SEQ ID NO: 404428 - protein, 11 aa, Influenza virus
AIAGFIEGGWP

SEQ ID NO: 404429 - protein, 11 aa, Influenza virus
IAGFIEGGWPG

SEQ ID NO: 404430 - protein, 11 aa, Influenza virus
AGFIEGGWPGL

SEQ ID NO: 404431 - protein, 11 aa, Influenza virus
GFIEGGWPGLV

SEQ ID NO: 404432 - protein, 11 aa, Influenza virus
FIEGGWPGLVA

SEQ ID NO: 404433 - protein, 11 aa, Influenza virus
IEGGWPGLVAG

SEQ ID NO: 404434 - protein, 11 aa, Influenza virus
EGGWPGLVAGW

SEQ ID NO: 404435 - protein, 11 aa, Influenza virus
GGWPGLVAGWY

SEQ ID NO: 404436 - protein, 11 aa, Influenza virus
GWPGLVAGWYG

SEQ ID NO: 404437 - protein, 11 aa, Influenza virus
WPGLVAGWYGF

SEQ ID NO: 404438 - protein, 11 aa, Influenza virus
PGLVAGWYGFQ

SEQ ID NO: 404439 - protein, 11 aa, Influenza virus
GLIAGWYGFQH

SEQ ID NO: 404440 - protein, 11 aa, Influenza virus
LIAGWYGFQHS

SEQ ID NO: 404441 - protein, 11 aa, Influenza virus
IAGWYGFQHSN

SEQ ID NO: 404442 - protein, 11 aa, Influenza virus
GWYGFQHSNAQ

SEQ ID NO: 404443 - protein, 11 aa, Influenza virus
WYGFQHSNAQG

SEQ ID NO: 404444 - protein, 11 aa, Influenza virus
DQIQDVWAYNA

SEQ ID NO: 404445 - protein, 11 aa, Influenza virus
QIQDVWAYNAE

SEQ ID NO: 404446 - protein, 11 aa, Influenza virus
IQDVWAYNAEL

SEQ ID NO: 404447 - protein, 11 aa, Influenza virus
QDVWAYNAELL

SEQ ID NO: 404448 - protein, 11 aa, Influenza virus
DVWAYNAELLV

SEQ ID NO: 404449 - protein, 11 aa, Influenza virus
VWAYNAELLVL

SEQ ID NO: 404450 - protein, 11 aa, Influenza virus
WAYNAELLVLI

SEQ ID NO: 404451 - protein, 11 aa, Influenza virus
AYNAELLVLLG

SEQ ID NO: 404452 - protein, 11 aa, Influenza virus
YNAELLVLLGN

SEQ ID NO: 404453 - protein, 11 aa, Influenza virus
NAELLVLLGNQ

SEQ ID NO: 404454 - protein, 11 aa, Influenza virus
AELLVLLGNQK

SEQ ID NO: 404455 - protein, 11 aa, Influenza virus
ELLVLLGNQKT

SEQ ID NO: 404456 - protein, 11 aa, Influenza virus
LLGNQKTLDEH

SEQ ID NO: 404457 - protein, 11 aa, Influenza virus
EDGNGCFELYH

SEQ ID NO: 404458 - protein, 11 aa, Influenza virus
GNGCFELYHKC

SEQ ID NO: 404459 - protein, 11 aa, Influenza virus
GIYKILTIYST

SEQ ID NO: 404460 - protein, 11 aa, Influenza virus
IYKILTIYSTV

SEQ ID NO: 404461 - protein, 11 aa, Influenza virus
YKILTIYSTAA

SEQ ID NO: 404462 - protein, 11 aa, Influenza virus
KILTIYSTAAS

SEQ ID NO: 404463 - protein, 11 aa, Influenza virus
ILTIYSTAASS

SEQ ID NO: 404464 - protein, 11 aa, Influenza virus
LTIYSTAASSL

SEQ ID NO: 404465 - protein, 11 aa, Influenza virus
EGLVYGNPSCD

SEQ ID NO: 404466 - protein, 11 aa, Influenza virus
LKPGQTLRVRS

SEQ ID NO: 404467 - protein, 11 aa, Influenza virus
GIFGAIAGFIE

SEQ ID NO: 404468 - protein, 11 aa, Influenza virus
AIAGFIEGGWP

SEQ ID NO: 404469 - protein, 11 aa, Influenza virus
IAGFIEGGWPG

SEQ ID NO: 404470 - protein, 11 aa, Influenza virus
AGFIEGGWPGL

SEQ ID NO: 404471 - protein, 11 aa, Influenza virus
GFIEGGWPGLV

SEQ ID NO: 404472 - protein, 11 aa, Influenza virus
FIEGGWPGLVA

SEQ ID NO: 404473 - protein, 11 aa, Influenza virus
IEGGWPGLVAG

SEQ ID NO: 404474 - protein, 11 aa, Influenza virus
EGGWPGLVAGW

SEQ ID NO: 404475 - protein, 11 aa, Influenza virus
GGWPGLVAGWY

SEQ ID NO: 404476 - protein, 11 aa, Influenza virus
GWPGLVAGWYG

SEQ ID NO: 404477 - protein, 11 aa, Influenza virus
WPGLVAGWYGF

SEQ ID NO: 404478 - protein, 11 aa, Influenza virus
PGLVAGWYGFQ

SEQ ID NO: 404479 - protein, 11 aa, Influenza virus
GLIAGWYGFQH

SEQ ID NO: 404480 - protein, 11 aa, Influenza virus
LIAGWYGFQHS

SEQ ID NO: 404481 - protein, 11 aa, Influenza virus
IAGWYGFQHSN

SEQ ID NO: 404482 - protein, 11 aa, Influenza virus
GWYGFQHSNAQ

SEQ ID NO: 404483 - protein, 11 aa, Influenza virus
WYGFQHSNAQG

SEQ ID NO: 404484 - protein, 11 aa, Influenza virus
DQIQDVWAYNA

SEQ ID NO: 404485 - protein, 11 aa, Influenza virus
QIQDVWAYNAE

SEQ ID NO: 404486 - protein, 11 aa, Influenza virus
IQDVWAYNAEL

SEQ ID NO: 404487 - protein, 11 aa, Influenza virus
QDVWAYNAELL

SEQ ID NO: 404488 - protein, 11 aa, Influenza virus
DVWAYNAELLV

SEQ ID NO: 404489 - protein, 11 aa, Influenza virus
VWAYNAELLVL

SEQ ID NO: 404490 - protein, 11 aa, Influenza virus
WAYNAELLVLI

SEQ ID NO: 404491 - protein, 11 aa, Influenza virus
AYNAELLVLLG

SEQ ID NO: 404492 - protein, 11 aa, Influenza virus
YNAELLVLLGN

SEQ ID NO: 404493 - protein, 11 aa, Influenza virus
NAELLVLLGNQ

SEQ ID NO: 404494 - protein, 11 aa, Influenza virus
AELLVLLGNQK

SEQ ID NO: 404495 - protein, 11 aa, Influenza virus
ELLVLLGNQKT

SEQ ID NO: 404496 - protein, 11 aa, Influenza virus
LLVLLGNQKTL

SEQ ID NO: 404497 - protein, 11 aa, Influenza virus
LVLLGNQKTLD

SEQ ID NO: 404498 - protein, 11 aa, Influenza virus
VLLGNQKTLDE

SEQ ID NO: 404499 - protein, 11 aa, Influenza virus
LLGNQKTLDEH

SEQ ID NO: 404500 - protein, 11 aa, Influenza virus
EDGNGCFELYH

SEQ ID NO: 404501 - protein, 11 aa, Influenza virus
GNGCFELYHKC

SEQ ID NO: 404502 - protein, 11 aa, Influenza virus
GIYKILTIYST

SEQ ID NO: 404503 - protein, 11 aa, Influenza virus
IYKILTIYSTV

SEQ ID NO: 404504 - protein, 11 aa, Influenza virus
YKILTIYSTAA

SEQ ID NO: 404505 - protein, 11 aa, Influenza virus
KILTIYSTAAS

SEQ ID NO: 404506 - protein, 11 aa, Influenza virus
ILTIYSTAASS

SEQ ID NO: 404507 - protein, 11 aa, Influenza virus
LTIYSTAASSL

SEQ ID NO: 404508 - protein, 11 aa, Influenza virus
CYQFALGHGTT

SEQ ID NO: 404509 - protein, 11 aa, Influenza virus
YQFALGHGTTL

SEQ ID NO: 404510 - protein, 11 aa, Influenza virus
PYRTLLMSELG

SEQ ID NO: 404511 - protein, 11 aa, Influenza virus
YRTLLMSELGV

SEQ ID NO: 404512 - protein, 11 aa, Influenza virus
RTLLMSELGVP

SEQ ID NO: 404513 - protein, 11 aa, Influenza virus
TLLMSELGVPF

SEQ ID NO: 404514 - protein, 11 aa, Influenza virus
LLMSELGVPFH

SEQ ID NO: 404515 - protein, 11 aa, Influenza virus
QVCMAWSSSSC

SEQ ID NO: 404516 - protein, 11 aa, Influenza virus
VCMAWSSSSCH

SEQ ID NO: 404517 - protein, 11 aa, Influenza virus
CMAWSSSSCHD

SEQ ID NO: 404518 - protein, 11 aa, Influenza virus
MAWSSSSCHDG

SEQ ID NO: 404519 - protein, 11 aa, Influenza virus
AWSSSSCHDGR

SEQ ID NO: 404520 - protein, 11 aa, Influenza virus
WSSSSCHDGRA

SEQ ID NO: 404521 - protein, 11 aa, Influenza virus
SSSSCHDGRAW

SEQ ID NO: 404522 - protein, 11 aa, Influenza virus
SSSCHDGRAWL

SEQ ID NO: 404523 - protein, 11 aa, Influenza virus
ILRTQESECIC

SEQ ID NO: 404524 - protein, 11 aa, Influenza virus
GSAQHIEECSC

SEQ ID NO: 404525 - protein, 11 aa, Influenza virus
SAQHIEECSCY

SEQ ID NO: 404526 - protein, 11 aa, Influenza virus
AQHIEECSCYP

SEQ ID NO: 404527 - protein, 11 aa, Influenza virus
VCRDNWRGSNR

SEQ ID NO: 404528 - protein, 11 aa, Influenza virus
CRDNWRGSNRP

SEQ ID NO: 404529 - protein, 11 aa, Influenza virus
YLCSGLVGDTP

SEQ ID NO: 404530 - protein, 11 aa, Influenza virus
LCSGLVGDTPR

SEQ ID NO: 404531 - protein, 11 aa, Influenza virus
CSGLVGDTPRS

SEQ ID NO: 404532 - protein, 11 aa, Influenza virus
CVNRCFYVELI

SEQ ID NO: 404533 - protein, 11 aa, Influenza virus
VNRCFYVELIR

SEQ ID NO: 404534 - protein, 11 aa, Influenza virus
NRCFYVELVRG

SEQ ID NO: 404535 - protein, 11 aa, Influenza virus
RCFYVELVRGR

SEQ ID NO: 404536 - protein, 11 aa, Influenza virus
CFYVELVRGRP

SEQ ID NO: 404537 - protein, 11 aa, Influenza virus
YGTGSWPDGAD

SEQ ID NO: 404538 - protein, 11 aa, Influenza virus
SQLTEVETYVL

SEQ ID NO: 404539 - protein, 11 aa, Influenza virus
QLTEVETYVLS

SEQ ID NO: 404540 - protein, 11 aa, Influenza virus
LTEVETYVLSV

SEQ ID NO: 404541 - protein, 11 aa, Influenza virus
TEVETYVLSII

SEQ ID NO: 404542 - protein, 11 aa, Influenza virus
EVETYVLSIIP

SEQ ID NO: 404543 - protein, 11 aa, Influenza virus
VETYVLSIIPS

SEQ ID NO: 404544 - protein, 11 aa, Influenza virus
ETYVLSIIPSG

SEQ ID NO: 404545 - protein, 11 aa, Influenza virus
TYVLSIIPSGP

SEQ ID NO: 404546 - protein, 11 aa, Influenza virus
YVLSIIPSGPL

SEQ ID NO: 404547 - protein, 11 aa, Influenza virus
VLSIIPSGPLK

SEQ ID NO: 404548 - protein, 11 aa, Influenza virus
LSIIPSGPLKA

SEQ ID NO: 404549 - protein, 11 aa, Influenza virus
SIIPSGPLKAE

SEQ ID NO: 404550 - protein, 11 aa, Influenza virus
IIPSGPLKAEI

SEQ ID NO: 404551 - protein, 11 aa, Influenza virus
IPSGPLKAEIA

SEQ ID NO: 404552 - protein, 11 aa, Influenza virus
SGPLKAEIAQK

SEQ ID NO: 404553 - protein, 11 aa, Influenza virus
GPLKAEIAQKL

SEQ ID NO: 404554 - protein, 11 aa, Influenza virus
PLKAEIAQKLE

SEQ ID NO: 404555 - protein, 11 aa, Influenza virus
LKAEIAQRLES

SEQ ID NO: 404556 - protein, 11 aa, Influenza virus
KAEIAQRLESV

SEQ ID NO: 404557 - protein, 11 aa, Influenza virus
AEIAQRLESVF

SEQ ID NO: 404558 - protein, 11 aa, Influenza virus
EIAQRLESVFA

SEQ ID NO: 404559 - protein, 11 aa, Influenza virus
IAQRLESVFAG

SEQ ID NO: 404560 - protein, 11 aa, Influenza virus
AQRLESVFAGK

SEQ ID NO: 404561 - protein, 11 aa, Influenza virus
VFAGKNADLEA

SEQ ID NO: 404562 - protein, 11 aa, Influenza virus
FAGKNADLEAL

SEQ ID NO: 404563 - protein, 11 aa, Influenza virus
AGKNADLEALM

SEQ ID NO: 404564 - protein, 11 aa, Influenza virus
GKNADLEALME

SEQ ID NO: 404565 - protein, 11 aa, Influenza virus
KNADLEALMEW

SEQ ID NO: 404566 - protein, 11 aa, Influenza virus
NTDLEALMEWI

SEQ ID NO: 404567 - protein, 11 aa, Influenza virus
TDLEALMEWIK

SEQ ID NO: 404568 - protein, 11 aa, Influenza virus
DLEALMEWIKT

SEQ ID NO: 404569 - protein, 11 aa, Influenza virus
LEALMEWIKTR

SEQ ID NO: 404570 - protein, 11 aa, Influenza virus
EALMEWIKTRP

SEQ ID NO: 404571 - protein, 11 aa, Influenza virus
ALMEWIKTRPI

SEQ ID NO: 404572 - protein, 11 aa, Influenza virus
LMEWIKTRPIL

SEQ ID NO: 404573 - protein, 11 aa, Influenza virus
MEWIKTRPILS

SEQ ID NO: 404574 - protein, 11 aa, Influenza virus
EWIKTRPILSP

SEQ ID NO: 404575 - protein, 11 aa, Influenza virus
WIKTRPILSPL

SEQ ID NO: 404576 - protein, 11 aa, Influenza virus
IKTRPILSPLT

SEQ ID NO: 404577 - protein, 11 aa, Influenza virus
RPILSPLTKGM

SEQ ID NO: 404578 - protein, 11 aa, Influenza virus
PILSPLTKGML

SEQ ID NO: 404579 - protein, 11 aa, Influenza virus
ILSPLTKGMLG

SEQ ID NO: 404580 - protein, 11 aa, Influenza virus
LSPLTKGMLGF

SEQ ID NO: 404581 - protein, 11 aa, Influenza virus
SPLTKGMLGFV

SEQ ID NO: 404582 - protein, 11 aa, Influenza virus
PLTKGMLGFVF

SEQ ID NO: 404583 - protein, 11 aa, Influenza virus
LTKGMLGFVFT

SEQ ID NO: 404584 - protein, 11 aa, Influenza virus
TKGMLGFVFTL

SEQ ID NO: 404585 - protein, 11 aa, Influenza virus
KGMLGFVFTLT

SEQ ID NO: 404586 - protein, 11 aa, Influenza virus
GMLGFVFTLTV

SEQ ID NO: 404587 - protein, 11 aa, Influenza virus
MLGFVFTLTVP

SEQ ID NO: 404588 - protein, 11 aa, Influenza virus
SERGLQRRRFI

SEQ ID NO: 404589 - protein, 11 aa, Influenza virus
ERGLQRRRFIQ

SEQ ID NO: 404590 - protein, 11 aa, Influenza virus
RGLQRRRFIQN

SEQ ID NO: 404591 - protein, 11 aa, Influenza virus
GLQRRRFIQNA

SEQ ID NO: 404592 - protein, 11 aa, Influenza virus
LQRRRFIQNAL

SEQ ID NO: 404593 - protein, 11 aa, Influenza virus
QRRRFVQNALS

SEQ ID NO: 404594 - protein, 11 aa, Influenza virus
RRRFVQNALSG

SEQ ID NO: 404595 - protein, 11 aa, Influenza virus
RRFVQNALSGN

SEQ ID NO: 404596 - protein, 11 aa, Influenza virus
RFVQNALSGNG

SEQ ID NO: 404597 - protein, 11 aa, Influenza virus
FVQNALSGNGD

SEQ ID NO: 404598 - protein, 11 aa, Influenza virus
VQNALSGNGDP

SEQ ID NO: 404599 - protein, 11 aa, Influenza virus
QNALSGNGDPN

SEQ ID NO: 404600 - protein, 11 aa, Influenza virus
NALSGNGDPNN

SEQ ID NO: 404601 - protein, 11 aa, Influenza virus
ALSGNGDPNNM

SEQ ID NO: 404602 - protein, 11 aa, Influenza virus
LSGNGDPNNMD

SEQ ID NO: 404603 - protein, 11 aa, Influenza virus
NGNGDPNNMDK

SEQ ID NO: 404604 - protein, 11 aa, Influenza virus
GNGDPNNMDKA

SEQ ID NO: 404605 - protein, 11 aa, Influenza virus
NGDPNNMDKAV

SEQ ID NO: 404606 - protein, 11 aa, Influenza virus
GDPNNMDKAVK

SEQ ID NO: 404607 - protein, 11 aa, Influenza virus
DPNNMDKAVKL

SEQ ID NO: 404608 - protein, 11 aa, Influenza virus
PNNMDKAVKLY

SEQ ID NO: 404609 - protein, 11 aa, Influenza virus
NMDRAVKLYKK

SEQ ID NO: 404610 - protein, 11 aa, Influenza virus
MDRAVKLYKKL

SEQ ID NO: 404611 - protein, 11 aa, Influenza virus
DRAVKLYKKLK

SEQ ID NO: 404612 - protein, 11 aa, Influenza virus
RAVKLYKKLKR

SEQ ID NO: 404613 - protein, 11 aa, Influenza virus
AVKLYKKLKRE

SEQ ID NO: 404614 - protein, 11 aa, Influenza virus
VKLYKKLKREI

SEQ ID NO: 404615 - protein, 11 aa, Influenza virus
KLYKKLKREIT

SEQ ID NO: 404616 - protein, 11 aa, Influenza virus
LYKKLKREITF

SEQ ID NO: 404617 - protein, 11 aa, Influenza virus
YKKLKREITFH

SEQ ID NO: 404618 - protein, 11 aa, Influenza virus
KKLKREITFHG

SEQ ID NO: 404619 - protein, 11 aa, Influenza virus
KLKREMTFHGA

SEQ ID NO: 404620 - protein, 11 aa, Influenza virus
LKREMTFHGAK

SEQ ID NO: 404621 - protein, 11 aa, Influenza virus
KREMTFHGAKE

SEQ ID NO: 404622 - protein, 11 aa, Influenza virus
REITFHGAKEI

SEQ ID NO: 404623 - protein, 11 aa, Influenza virus
ALSYSAGALAS

SEQ ID NO: 404624 - protein, 11 aa, Influenza virus
LSYSAGALASC

SEQ ID NO: 404625 - protein, 11 aa, Influenza virus
SYSAGALASCM

SEQ ID NO: 404626 - protein, 11 aa, Influenza virus
YSAGALASCMG

SEQ ID NO: 404627 - protein, 11 aa, Influenza virus
SAGALASCMGL

SEQ ID NO: 404628 - protein, 11 aa, Influenza virus
AGALASCMGLI

SEQ ID NO: 404629 - protein, 11 aa, Influenza virus
CMGLIYNRMGA

SEQ ID NO: 404630 - protein, 11 aa, Influenza virus
MGLIYNRMGAV

SEQ ID NO: 404631 - protein, 11 aa, Influenza virus
GLIYNRMGAVT

SEQ ID NO: 404632 - protein, 11 aa, Influenza virus
AFGLICATCEQ

SEQ ID NO: 404633 - protein, 11 aa, Influenza virus
FGLICATCEQI

SEQ ID NO: 404634 - protein, 11 aa, Influenza virus
GLICATCEQIA

SEQ ID NO: 404635 - protein, 11 aa, Influenza virus
LICATCEQIAD

SEQ ID NO: 404636 - protein, 11 aa, Influenza virus
ICATCEQIADS

SEQ ID NO: 404637 - protein, 11 aa, Influenza virus
CATCEQIADAQ

SEQ ID NO: 404638 - protein, 11 aa, Influenza virus
ATCEQIADAQH

SEQ ID NO: 404639 - protein, 11 aa, Influenza virus
TCEQIADSQHK

SEQ ID NO: 404640 - protein, 11 aa, Influenza virus
CEQIADSQHKS

SEQ ID NO: 404641 - protein, 11 aa, Influenza virus
EQIADSQHKSH

SEQ ID NO: 404642 - protein, 11 aa, Influenza virus
QIADSQHKSHR

SEQ ID NO: 404643 - protein, 11 aa, Influenza virus
IADSQHKSHRQ

SEQ ID NO: 404644 - protein, 11 aa, Influenza virus
ADSQHKSHRQM

SEQ ID NO: 404645 - protein, 11 aa, Influenza virus
ATTNPLIKHEN

SEQ ID NO: 404646 - protein, 11 aa, Influenza virus
TTNPLIKHENR

SEQ ID NO: 404647 - protein, 11 aa, Influenza virus
TNPLIKHENRM

SEQ ID NO: 404648 - protein, 11 aa, Influenza virus
NPLIKHENRMV

SEQ ID NO: 404649 - protein, 11 aa, Influenza virus
PLIKHENRMVL

SEQ ID NO: 404650 - protein, 11 aa, Influenza virus
LIKHENRMVLA

SEQ ID NO: 404651 - protein, 11 aa, Influenza virus
IKHENRMVLAS

SEQ ID NO: 404652 - protein, 11 aa, Influenza virus
KHENRMVLAST

SEQ ID NO: 404653 - protein, 11 aa, Influenza virus
HENRMVIASTT

SEQ ID NO: 404654 - protein, 11 aa, Influenza virus
ENRMVIASTTA

SEQ ID NO: 404655 - protein, 11 aa, Influenza virus
NRMVIASTTAK

SEQ ID NO: 404656 - protein, 11 aa, Influenza virus
RMVIASTTAKA

SEQ ID NO: 404657 - protein, 11 aa, Influenza virus
MVIASTTAKAM

SEQ ID NO: 404658 - protein, 11 aa, Influenza virus
VIASTTAKAME

SEQ ID NO: 404659 - protein, 11 aa, Influenza virus
IASTTAKAMEQ

SEQ ID NO: 404660 - protein, 11 aa, Influenza virus
ASTTAKAMEQV

SEQ ID NO: 404661 - protein, 11 aa, Influenza virus
STTAKAMEQVA

SEQ ID NO: 404662 - protein, 11 aa, Influenza virus
TTAKAMEQVAG

SEQ ID NO: 404663 - protein, 11 aa, Influenza virus
TAKAMEQVAGS

SEQ ID NO: 404664 - protein, 11 aa, Influenza virus
AKAMEQVAGSS

SEQ ID NO: 404665 - protein, 11 aa, Influenza virus
KAMEQVAGSSE

SEQ ID NO: 404666 - protein, 11 aa, Influenza virus
AMEQVAGSSEQ

SEQ ID NO: 404667 - protein, 11 aa, Influenza virus
MEQVAGSSEQA

SEQ ID NO: 404668 - protein, 11 aa, Influenza virus
EQVAGSSEQAA

SEQ ID NO: 404669 - protein, 11 aa, Influenza virus
QVAGSSEQAAE

SEQ ID NO: 404670 - protein, 11 aa, Influenza virus
VAGSSEQAAEA

SEQ ID NO: 404671 - protein, 11 aa, Influenza virus
AGSSEQAAEAI

SEQ ID NO: 404672 - protein, 11 aa, Influenza virus
GSSEQAAEAMD

SEQ ID NO: 404673 - protein, 11 aa, Influenza virus
SEQAAEAMEIA

SEQ ID NO: 404674 - protein, 11 aa, Influenza virus
LLENLQTYQKR

SEQ ID NO: 404675 - protein, 11 aa, Influenza virus
LENLQTYQKRM

SEQ ID NO: 404676 - protein, 11 aa, Influenza virus
ENLQTYQKRMG

SEQ ID NO: 404677 - protein, 11 aa, Influenza virus
NLQTYQKRMGV

SEQ ID NO: 404678 - protein, 11 aa, Influenza virus
LQTYQKRMGVQ

SEQ ID NO: 404679 - protein, 11 aa, Influenza virus
QTYQKRMGVQM

SEQ ID NO: 404680 - protein, 11 aa, Influenza virus
YQKRMGVQLQR

SEQ ID NO: 404681 - protein, 11 aa, Influenza virus
DGHFVNIELED

SEQ ID NO: 404682 - protein, 11 aa, Influenza virus
MSDINIMASQG

SEQ ID NO: 404683 - protein, 11 aa, Influenza virus
SDINIMASQGT

SEQ ID NO: 404684 - protein, 11 aa, Influenza virus
DINIMASQGTK

SEQ ID NO: 404685 - protein, 11 aa, Influenza virus
INIMASQGTKR

SEQ ID NO: 404686 - protein, 11 aa, Influenza virus
NIMASQGTKRS

SEQ ID NO: 404687 - protein, 11 aa, Influenza virus
IMASQGTKRSY

SEQ ID NO: 404688 - protein, 11 aa, Influenza virus
MASQGTKRSHE

SEQ ID NO: 404689 - protein, 11 aa, Influenza virus
ASQGTKRSHEQ

SEQ ID NO: 404690 - protein, 11 aa, Influenza virus
SQGTKRSHEQM

SEQ ID NO: 404691 - protein, 11 aa, Influenza virus
QGTKRSHEQME

SEQ ID NO: 404692 - protein, 11 aa, Influenza virus
GTKRSHEQMET

SEQ ID NO: 404693 - protein, 11 aa, Influenza virus
TKRSYEQMETD

SEQ ID NO: 404694 - protein, 11 aa, Influenza virus
KRSYEQMETDG

SEQ ID NO: 404695 - protein, 11 aa, Influenza virus
GIGRFYVQMCT

SEQ ID NO: 404696 - protein, 11 aa, Influenza virus
IGRFYVQMCTE

SEQ ID NO: 404697 - protein, 11 aa, Influenza virus
GRFYVQMCTEL

SEQ ID NO: 404698 - protein, 11 aa, Influenza virus
RFYVQMCTELK

SEQ ID NO: 404699 - protein, 11 aa, Influenza virus
FYVQMCTELKL

SEQ ID NO: 404700 - protein, 11 aa, Influenza virus
YIQMCTELKLN

SEQ ID NO: 404701 - protein, 11 aa, Influenza virus
GRLIQNSLTIE

SEQ ID NO: 404702 - protein, 11 aa, Influenza virus
TIEKMVLSAFD

SEQ ID NO: 404703 - protein, 11 aa, Influenza virus
IEKMVLSAFDE

SEQ ID NO: 404704 - protein, 11 aa, Influenza virus
EKMVLSAFDER

SEQ ID NO: 404705 - protein, 11 aa, Influenza virus
KMVLSAFDERR

SEQ ID NO: 404706 - protein, 11 aa, Influenza virus
VLSAFDERRNR

SEQ ID NO: 404707 - protein, 11 aa, Influenza virus
LSAFDERRNRY

SEQ ID NO: 404708 - protein, 11 aa, Influenza virus
SAFDERRNRYL

SEQ ID NO: 404709 - protein, 11 aa, Influenza virus
AFDERRNRYLE

SEQ ID NO: 404710 - protein, 11 aa, Influenza virus
FDERRNRYLEE

SEQ ID NO: 404711 - protein, 11 aa, Influenza virus
DERRNRYLEEH

SEQ ID NO: 404712 - protein, 11 aa, Influenza virus
ERRNRYLEEHP

SEQ ID NO: 404713 - protein, 11 aa, Influenza virus
RRNRYLEEHPS

SEQ ID NO: 404714 - protein, 11 aa, Influenza virus
RNRYLEEHPSA

SEQ ID NO: 404715 - protein, 11 aa, Influenza virus
NRYLEEHPSAG

SEQ ID NO: 404716 - protein, 11 aa, Influenza virus
YLEEHPNAGKD

SEQ ID NO: 404717 - protein, 11 aa, Influenza virus
LEEHPNAGKDP

SEQ ID NO: 404718 - protein, 11 aa, Influenza virus
EEHPNAGKDPK

SEQ ID NO: 404719 - protein, 11 aa, Influenza virus
EHPNAGKDPKK

SEQ ID NO: 404720 - protein, 11 aa, Influenza virus
HPNAGKDPKKT

SEQ ID NO: 404721 - protein, 11 aa, Influenza virus
PNAGKDPKKTG

SEQ ID NO: 404722 - protein, 11 aa, Influenza virus
NAGKDPKKTGG

SEQ ID NO: 404723 - protein, 11 aa, Influenza virus
TGKDPKKTGGP

SEQ ID NO: 404724 - protein, 11 aa, Influenza virus
DPKKTGGPIYK

SEQ ID NO: 404725 - protein, 11 aa, Influenza virus
PKKTGGPIYKR

SEQ ID NO: 404726 - protein, 11 aa, Influenza virus
AGLTHLMIWHS

SEQ ID NO: 404727 - protein, 11 aa, Influenza virus
GLTHLMIWHSN

SEQ ID NO: 404728 - protein, 11 aa, Influenza virus
LTHLMIWHSNL

SEQ ID NO: 404729 - protein, 11 aa, Influenza virus
THLMIWHSNLN

SEQ ID NO: 404730 - protein, 11 aa, Influenza virus
HLMIWHSNLND

SEQ ID NO: 404731 - protein, 11 aa, Influenza virus
IMIWHSNLNDA

SEQ ID NO: 404732 - protein, 11 aa, Influenza virus
MIWHSNLNDTT

SEQ ID NO: 404733 - protein, 11 aa, Influenza virus
IWHSNLNDTTY

SEQ ID NO: 404734 - protein, 11 aa, Influenza virus
WHSNLNDTTYQ

SEQ ID NO: 404735 - protein, 11 aa, Influenza virus
HSNLNDTTYQR

SEQ ID NO: 404736 - protein, 11 aa, Influenza virus
SNLNDTTYQRT

SEQ ID NO: 404737 - protein, 11 aa, Influenza virus
NLNDTTYQRTR

SEQ ID NO: 404738 - protein, 11 aa, Influenza virus
LNDTTYQRTRA

SEQ ID NO: 404739 - protein, 11 aa, Influenza virus
NDTTYQRTRAL

SEQ ID NO: 404740 - protein, 11 aa, Influenza virus
DTTYQRTRALV

SEQ ID NO: 404741 - protein, 11 aa, Influenza virus
TTYQRTRALVR

SEQ ID NO: 404742 - protein, 11 aa, Influenza virus
TYQRTRALVRS

SEQ ID NO: 404743 - protein, 11 aa, Influenza virus
YQRTRALVRSG

SEQ ID NO: 404744 - protein, 11 aa, Influenza virus
QRTRALVRSGM

SEQ ID NO: 404745 - protein, 11 aa, Influenza virus
RTRALVRSGMD

SEQ ID NO: 404746 - protein, 11 aa, Influenza virus
TRALVRSGMDP

SEQ ID NO: 404747 - protein, 11 aa, Influenza virus
RALVRSGMDPR

SEQ ID NO: 404748 - protein, 11 aa, Influenza virus
ALVRSGMDPRM

SEQ ID NO: 404749 - protein, 11 aa, Influenza virus
LVRSGMDPRMC

SEQ ID NO: 404750 - protein, 11 aa, Influenza virus
VRSGMDPRMCS

SEQ ID NO: 404751 - protein, 11 aa, Influenza virus
RSGMDPRMCSL

SEQ ID NO: 404752 - protein, 11 aa, Influenza virus
SGMDPRMCSLM

SEQ ID NO: 404753 - protein, 11 aa, Influenza virus
PRRSGAAGAAI

SEQ ID NO: 404754 - protein, 11 aa, Influenza virus
RRSGAAGAAIK

SEQ ID NO: 404755 - protein, 11 aa, Influenza virus
RSGAAGAAIKG

SEQ ID NO: 404756 - protein, 11 aa, Influenza virus
SGAAGAAVKGI

SEQ ID NO: 404757 - protein, 11 aa, Influenza virus
GAAGAAVKGIG

SEQ ID NO: 404758 - protein, 11 aa, Influenza virus
AAGAAVKGIGT

SEQ ID NO: 404759 - protein, 11 aa, Influenza virus
AGAAVKGVGTI

SEQ ID NO: 404760 - protein, 11 aa, Influenza virus
AMELIRMIKRG

SEQ ID NO: 404761 - protein, 11 aa, Influenza virus
MELIRMVKRGI

SEQ ID NO: 404762 - protein, 11 aa, Influenza virus
ELIRMVKRGIN

SEQ ID NO: 404763 - protein, 11 aa, Influenza virus
LIRMVKRGIND

SEQ ID NO: 404764 - protein, 11 aa, Influenza virus
IRMVKRGINDR

SEQ ID NO: 404765 - protein, 11 aa, Influenza virus
RMVKRGINDRN

SEQ ID NO: 404766 - protein, 11 aa, Influenza virus
MVKRGINDRNF

SEQ ID NO: 404767 - protein, 11 aa, Influenza virus
VKRGINDRNFW

SEQ ID NO: 404768 - protein, 11 aa, Influenza virus
KRGVNDRNFWR

SEQ ID NO: 404769 - protein, 11 aa, Influenza virus
RGVNDRNFWRG

SEQ ID NO: 404770 - protein, 11 aa, Influenza virus
GVNDRNFWRGE

SEQ ID NO: 404771 - protein, 11 aa, Influenza virus
VNDRNFWRGEN

SEQ ID NO: 404772 - protein, 11 aa, Influenza virus
NDRNFWRGDNG

SEQ ID NO: 404773 - protein, 11 aa, Influenza virus
DRNFWRGDNGR

SEQ ID NO: 404774 - protein, 11 aa, Influenza virus
RNFWRGENGRK

SEQ ID NO: 404775 - protein, 11 aa, Influenza virus
NFWRGENGRKT

SEQ ID NO: 404776 - protein, 11 aa, Influenza virus
FWRGENGRKTR

SEQ ID NO: 404777 - protein, 11 aa, Influenza virus
TRVAYERMCNI

SEQ ID NO: 404778 - protein, 11 aa, Influenza virus
RVAYERMCNIL

SEQ ID NO: 404779 - protein, 11 aa, Influenza virus
VAYERMCNILK

SEQ ID NO: 404780 - protein, 11 aa, Influenza virus
LKGKFQTAAQK

SEQ ID NO: 404781 - protein, 11 aa, Influenza virus
KGKFQTAAQKA

SEQ ID NO: 404782 - protein, 11 aa, Influenza virus
GKFQTAAQKAM

SEQ ID NO: 404783 - protein, 11 aa, Influenza virus
KFQTAAQRAMV

SEQ ID NO: 404784 - protein, 11 aa, Influenza virus
FQTAAQRAMVD

SEQ ID NO: 404785 - protein, 11 aa, Influenza virus
QTAAQRAMVDQ

SEQ ID NO: 404786 - protein, 11 aa, Influenza virus
TAAQRAMVDQV

SEQ ID NO: 404787 - protein, 11 aa, Influenza virus
AAQRAMVDQVR

SEQ ID NO: 404788 - protein, 11 aa, Influenza virus
AQRAMVDQVRE

SEQ ID NO: 404789 - protein, 11 aa, Influenza virus
QRAMVDQVRES

SEQ ID NO: 404790 - protein, 11 aa, Influenza virus
RAMVDQVRESR

SEQ ID NO: 404791 - protein, 11 aa, Influenza virus
AMVDQVRESRN

SEQ ID NO: 404792 - protein, 11 aa, Influenza virus
MVDQVRESRNP

SEQ ID NO: 404793 - protein, 11 aa, Influenza virus
VDQVRESRNPG

SEQ ID NO: 404794 - protein, 11 aa, Influenza virus
DQVREGRNPGN

SEQ ID NO: 404795 - protein, 11 aa, Influenza virus
QVREGRNPGNA

SEQ ID NO: 404796 - protein, 11 aa, Influenza virus
VREGRNPGNAE

SEQ ID NO: 404797 - protein, 11 aa, Influenza virus
REGRNPGNAEI

SEQ ID NO: 404798 - protein, 11 aa, Influenza virus
EGRNPGNAEIE

SEQ ID NO: 404799 - protein, 11 aa, Influenza virus
GRNPGNAEIED

SEQ ID NO: 404800 - protein, 11 aa, Influenza virus
RSPGNAEIEDL

SEQ ID NO: 404801 - protein, 11 aa, Influenza virus
NPGNAEIEDLT

SEQ ID NO: 404802 - protein, 11 aa, Influenza virus
PGNAEIEDLTF

SEQ ID NO: 404803 - protein, 11 aa, Influenza virus
GNAEIEDLTFL

SEQ ID NO: 404804 - protein, 11 aa, Influenza virus
NAEIEDLTFLA

SEQ ID NO: 404805 - protein, 11 aa, Influenza virus
AEIEDLTFLAR

SEQ ID NO: 404806 - protein, 11 aa, Influenza virus
EIEDLTFLARS

SEQ ID NO: 404807 - protein, 11 aa, Influenza virus
IEDLTFLARSA

SEQ ID NO: 404808 - protein, 11 aa, Influenza virus
EDLTFLARSAL

SEQ ID NO: 404809 - protein, 11 aa, Influenza virus
DLTFLARSALI

SEQ ID NO: 404810 - protein, 11 aa, Influenza virus
LTFLARSALIL

SEQ ID NO: 404811 - protein, 11 aa, Influenza virus
TFLARSALILR

SEQ ID NO: 404812 - protein, 11 aa, Influenza virus
FSARSALILRG

SEQ ID NO: 404813 - protein, 11 aa, Influenza virus
SARSALILRGS

SEQ ID NO: 404814 - protein, 11 aa, Influenza virus
ARSALILRGSI

SEQ ID NO: 404815 - protein, 11 aa, Influenza virus
RSALILRGSIA

SEQ ID NO: 404816 - protein, 11 aa, Influenza virus
SALILRGSIAH

SEQ ID NO: 404817 - protein, 11 aa, Influenza virus
ALILRGSIAHK

SEQ ID NO: 404818 - protein, 11 aa, Influenza virus
LILRGSIAHKS

SEQ ID NO: 404819 - protein, 11 aa, Influenza virus
ILRGSIAHKSC

SEQ ID NO: 404820 - protein, 11 aa, Influenza virus
LRGSIAHKSCL

SEQ ID NO: 404821 - protein, 11 aa, Influenza virus
RGSIAHKSCLP

SEQ ID NO: 404822 - protein, 11 aa, Influenza virus
GSIAHKSCLPA

SEQ ID NO: 404823 - protein, 11 aa, Influenza virus
SIAHKSCLPAC

SEQ ID NO: 404824 - protein, 11 aa, Influenza virus
VAHKSCLPACA

SEQ ID NO: 404825 - protein, 11 aa, Influenza virus
AHKSCLPACAY

SEQ ID NO: 404826 - protein, 11 aa, Influenza virus
HKSCLPACAYG

SEQ ID NO: 404827 - protein, 11 aa, Influenza virus
KSCLPACVYGP

SEQ ID NO: 404828 - protein, 11 aa, Influenza virus
SCLPACVYGPA

SEQ ID NO: 404829 - protein, 11 aa, Influenza virus
GHDFEREGYSL

SEQ ID NO: 404830 - protein, 11 aa, Influenza virus
HDFEREGYSLV

SEQ ID NO: 404831 - protein, 11 aa, Influenza virus
DFEKEGYSLVG

SEQ ID NO: 404832 - protein, 11 aa, Influenza virus
FEKEGYSLVGI

SEQ ID NO: 404833 - protein, 11 aa, Influenza virus
EKEGYSLVGID

SEQ ID NO: 404834 - protein, 11 aa, Influenza virus
KEGYSLVGIDP

SEQ ID NO: 404835 - protein, 11 aa, Influenza virus
EGYSLVGVDPF

SEQ ID NO: 404836 - protein, 11 aa, Influenza virus
GYSLVGIDPFR

SEQ ID NO: 404837 - protein, 11 aa, Influenza virus
YSLVGIDPFRL

SEQ ID NO: 404838 - protein, 11 aa, Influenza virus
SLVGIDPFRLL

SEQ ID NO: 404839 - protein, 11 aa, Influenza virus
LVGIDPFRLLQ

SEQ ID NO: 404840 - protein, 11 aa, Influenza virus
DPFKLLQNSQV

SEQ ID NO: 404841 - protein, 11 aa, Influenza virus
RSNENPAHKSQ

SEQ ID NO: 404842 - protein, 11 aa, Influenza virus
SNENPAHKSQL

SEQ ID NO: 404843 - protein, 11 aa, Influenza virus
KENPAHKSQLV

SEQ ID NO: 404844 - protein, 11 aa, Influenza virus
ENPVHKSQLIW

SEQ ID NO: 404845 - protein, 11 aa, Influenza virus
NPVHKSQLIWM

SEQ ID NO: 404846 - protein, 11 aa, Influenza virus
PVHKSQLIWMA

SEQ ID NO: 404847 - protein, 11 aa, Influenza virus
VHKSQLIWMAC

SEQ ID NO: 404848 - protein, 11 aa, Influenza virus
HKSQLVWMACN

SEQ ID NO: 404849 - protein, 11 aa, Influenza virus
KSQLVWMACNS

SEQ ID NO: 404850 - protein, 11 aa, Influenza virus
SQLVWMACNSA

SEQ ID NO: 404851 - protein, 11 aa, Influenza virus
QLVWMACNSAA

SEQ ID NO: 404852 - protein, 11 aa, Influenza virus
LVWMACNSAAF

SEQ ID NO: 404853 - protein, 11 aa, Influenza virus
VWMACNSAAFE

SEQ ID NO: 404854 - protein, 11 aa, Influenza virus
WMACNSAAFED

SEQ ID NO: 404855 - protein, 11 aa, Influenza virus
MACNSAAFEDL

SEQ ID NO: 404856 - protein, 11 aa, Influenza virus
ACNSAAFEDLR

SEQ ID NO: 404857 - protein, 11 aa, Influenza virus
CHSAAFEDLRL

SEQ ID NO: 404858 - protein, 11 aa, Influenza virus
LSTRGVQVASN

SEQ ID NO: 404859 - protein, 11 aa, Influenza virus
STRGVQVASNE

SEQ ID NO: 404860 - protein, 11 aa, Influenza virus
TRGVQVASNEN

SEQ ID NO: 404861 - protein, 11 aa, Influenza virus
TLELRSGYWAI

SEQ ID NO: 404862 - protein, 11 aa, Influenza virus
LELRSGYWAIR

SEQ ID NO: 404863 - protein, 11 aa, Influenza virus
ELRSGYWAIRT

SEQ ID NO: 404864 - protein, 11 aa, Influenza virus
LRSGYWAIRTR

SEQ ID NO: 404865 - protein, 11 aa, Influenza virus
RSGYWAIRTRS

SEQ ID NO: 404866 - protein, 11 aa, Influenza virus
SGYWAIRTRSG

SEQ ID NO: 404867 - protein, 11 aa, Influenza virus
GYWAIRTRSGG

SEQ ID NO: 404868 - protein, 11 aa, Influenza virus
WAIRTKSGGNT

SEQ ID NO: 404869 - protein, 11 aa, Influenza virus
AIRTRSGGNTS

SEQ ID NO: 404870 - protein, 11 aa, Influenza virus
IRTRSGGNTSQ

SEQ ID NO: 404871 - protein, 11 aa, Influenza virus
STQPTFSVQRN

SEQ ID NO: 404872 - protein, 11 aa, Influenza virus
TQPTFSVQRNL

SEQ ID NO: 404873 - protein, 11 aa, Influenza virus
QPAFSVQRNLP

SEQ ID NO: 404874 - protein, 11 aa, Influenza virus
PAFSVQRNLPF

SEQ ID NO: 404875 - protein, 11 aa, Influenza virus
TFSVQRNLPFD

SEQ ID NO: 404876 - protein, 11 aa, Influenza virus
FSVQRNLPFEK

SEQ ID NO: 404877 - protein, 11 aa, Influenza virus
EGRTSDMRAEI

SEQ ID NO: 404878 - protein, 11 aa, Influenza virus
GRTSDMRAEII

SEQ ID NO: 404879 - protein, 11 aa, Influenza virus
DLSFQGRGVFE

SEQ ID NO: 404880 - protein, 11 aa, Influenza virus
LSFQGRGVFEL

SEQ ID NO: 404881 - protein, 11 aa, Influenza virus
SFRGRGVFELS

SEQ ID NO: 404882 - protein, 11 aa, Influenza virus
FRGRGVFELSD

SEQ ID NO: 404883 - protein, 11 aa, Influenza virus
RGRGVFELSDE

SEQ ID NO: 404884 - protein, 11 aa, Influenza virus
GRGVFELSDER

SEQ ID NO: 404885 - protein, 11 aa, Influenza virus
RGVFELSDERA

SEQ ID NO: 404886 - protein, 11 aa, Influenza virus
GVFELSDERAT

SEQ ID NO: 404887 - protein, 11 aa, Influenza virus
MNNEGSYFFGD

SEQ ID NO: 404888 - protein, 11 aa, Influenza virus
NNEGSYFFGDN

SEQ ID NO: 404889 - protein, 11 aa, Influenza virus
KEGSYFFGDNA

SEQ ID NO: 404890 - protein, 11 aa, Influenza virus
EGSYFFGDSAE

SEQ ID NO: 404891 - protein, 11 aa, Influenza virus
GSYFFGDNAKE

SEQ ID NO: 404892 - protein, 11 aa, Influenza virus
SYFFGDNAEEF

SEQ ID NO: 404893 - protein, 11 aa, Influenza virus
FQVDCFLWHIR

SEQ ID NO: 404894 - protein, 11 aa, Influenza virus
SDAPFLDRLRR

SEQ ID NO: 404895 - protein, 11 aa, Influenza virus
DAPFDDRLRRD

SEQ ID NO: 404896 - protein, 11 aa, Influenza virus
APFDDRLRRDQ

SEQ ID NO: 404897 - protein, 11 aa, Influenza virus
SSLLLQANLCR

SEQ ID NO: 404898 - protein, 11 aa, Influenza virus
SLLLQANLCRF

SEQ ID NO: 404899 - protein, 11 aa, Influenza virus
IASVPASRYLT

SEQ ID NO: 404900 - protein, 11 aa, Influenza virus
ASVPASRYLTD

SEQ ID NO: 404901 - protein, 11 aa, Influenza virus
SVPASRYLIDM

SEQ ID NO: 404902 - protein, 11 aa, Influenza virus
VPASRYLIDMT

SEQ ID NO: 404903 - protein, 11 aa, Influenza virus
PASRYLTDMTL

SEQ ID NO: 404904 - protein, 11 aa, Influenza virus
SEVRGDQMAHC

SEQ ID NO: 404905 - protein, 11 aa, Influenza virus
EVRHRLKITEN

SEQ ID NO: 404906 - protein, 11 aa, Influenza virus
VRRDQMAHCRM

SEQ ID NO: 404907 - protein, 11 aa, Influenza virus
FQVDCFLWHVR

SEQ ID NO: 404908 - protein, 11 aa, Influenza virus
QVDCFLWHVRK

SEQ ID NO: 404909 - protein, 11 aa, Influenza virus
VDCFLWHVRKR

SEQ ID NO: 404910 - protein, 11 aa, Influenza virus
DCFLWHVRKRF

SEQ ID NO: 404911 - protein, 11 aa, Influenza virus
CFLWHVRKRFA

SEQ ID NO: 404912 - protein, 11 aa, Influenza virus
LKMTIASDILK

SEQ ID NO: 404913 - protein, 11 aa, Influenza virus
KMTIASDILTR

SEQ ID NO: 404914 - protein, 11 aa, Influenza virus
MTIASDILTRM

SEQ ID NO: 404915 - protein, 11 aa, Influenza virus
TIASDILTRMS

SEQ ID NO: 404916 - protein, 11 aa, Influenza virus
IASDILKRMSK

SEQ ID NO: 404917 - protein, 11 aa, Influenza virus
ASDILKRMSKM

SEQ ID NO: 404918 - protein, 11 aa, Influenza virus
TENSFEQITFL

SEQ ID NO: 404919 - protein, 11 aa, Influenza virus
ENSFEQITFLQ

SEQ ID NO: 404920 - protein, 11 aa, Influenza virus
NSFEQITFLQA

SEQ ID NO: 404921 - protein, 11 aa, Influenza virus
SFEQITFLQAL

SEQ ID NO: 404922 - protein, 11 aa, Influenza virus
FEQITFLQALQ

SEQ ID NO: 404923 - protein, 11 aa, Influenza virus
EQITFLQALQL

SEQ ID NO: 404924 - protein, 11 aa, Influenza virus
QITFLQALQLL

SEQ ID NO: 404925 - protein, 11 aa, Influenza virus
ITFMQALQLLF

SEQ ID NO: 404926 - protein, 11 aa, Influenza virus
TFMQALQLLFE

SEQ ID NO: 404927 - protein, 11 aa, Influenza virus
FMQALQLLFEV

SEQ ID NO: 404928 - protein, 11 aa, Influenza virus
MQALQLLFEVE

SEQ ID NO: 404929 - protein, 11 aa, Influenza virus
QALQLLFEVEQ

SEQ ID NO: 404930 - protein, 11 aa, Influenza virus
ALQLLFEVEQE

SEQ ID NO: 404931 - protein, 11 aa, Influenza virus
EIRTFSFQLIN

SEQ ID NO: 404932 - protein, 11 aa, Influenza virus
IRTFSFQLILI

SEQ ID NO: 404933 - protein, 11 aa, Influenza virus
MENFVRQCFNP

SEQ ID NO: 404934 - protein, 11 aa, Influenza virus
RQCFNPMIIEL

SEQ ID NO: 404935 - protein, 11 aa, Influenza virus
QCFNPMIIELA

SEQ ID NO: 404936 - protein, 11 aa, Influenza virus
CFNPMIIELAE

SEQ ID NO: 404937 - protein, 11 aa, Influenza virus
ELAEKTMKEYG

SEQ ID NO: 404938 - protein, 11 aa, Influenza virus
LAEKTMKEYGE

SEQ ID NO: 404939 - protein, 11 aa, Influenza virus
ETNKLAAICTH

SEQ ID NO: 404940 - protein, 11 aa, Influenza virus
TNKFAAICTHM

SEQ ID NO: 404941 - protein, 11 aa, Influenza virus
NKFAAICTHME

SEQ ID NO: 404942 - protein, 11 aa, Influenza virus
AAICTHMEVCF

SEQ ID NO: 404943 - protein, 11 aa, Influenza virus
AICTHMEVCFM

SEQ ID NO: 404944 - protein, 11 aa, Influenza virus
ICTHMEVCFMY

SEQ ID NO: 404945 - protein, 11 aa, Influenza virus
CTHMEVCFMYS

SEQ ID NO: 404946 - protein, 11 aa, Influenza virus
THMEVCFMYSD

SEQ ID NO: 404947 - protein, 11 aa, Influenza virus
HMEVCFMYSDF

SEQ ID NO: 404948 - protein, 11 aa, Influenza virus
MEVCFMYSDFH

SEQ ID NO: 404949 - protein, 11 aa, Influenza virus
EICFMYSDFHF

SEQ ID NO: 404950 - protein, 11 aa, Influenza virus
ICFMYSDFHFI

SEQ ID NO: 404951 - protein, 11 aa, Influenza virus
CFMYSDFHFIN

SEQ ID NO: 404952 - protein, 11 aa, Influenza virus
FMYSDFHFINE

SEQ ID NO: 404953 - protein, 11 aa, Influenza virus
MYSDFHFINEQ

SEQ ID NO: 404954 - protein, 11 aa, Influenza virus
DSNALLKHRFE

SEQ ID NO: 404955 - protein, 11 aa, Influenza virus
SNALLKHRFEI

SEQ ID NO: 404956 - protein, 11 aa, Influenza virus
NVLLKHRFEII

SEQ ID NO: 404957 - protein, 11 aa, Influenza virus
VLLKHRFEIIE

SEQ ID NO: 404958 - protein, 11 aa, Influenza virus
RFEIIEGRDRI

SEQ ID NO: 404959 - protein, 11 aa, Influenza virus
KPRFLPDLYDY

SEQ ID NO: 404960 - protein, 11 aa, Influenza virus
PRFLPDLYDYK

SEQ ID NO: 404961 - protein, 11 aa, Influenza virus
LPDLYDYKEDR

SEQ ID NO: 404962 - protein, 11 aa, Influenza virus
PDLYDYKEDRF

SEQ ID NO: 404963 - protein, 11 aa, Influenza virus
RFVEIGVTRRE

SEQ ID NO: 404964 - protein, 11 aa, Influenza virus
IGVTRREVHTY

SEQ ID NO: 404965 - protein, 11 aa, Influenza virus
GVTRREVHTYY

SEQ ID NO: 404966 - protein, 11 aa, Influenza virus
VTRREVHTYYL

SEQ ID NO: 404967 - protein, 11 aa, Influenza virus
TRREVHTYYLE

SEQ ID NO: 404968 - protein, 11 aa, Influenza virus
RREVHTYYLEK

SEQ ID NO: 404969 - protein, 11 aa, Influenza virus
YYLEKANKIKT

SEQ ID NO: 404970 - protein, 11 aa, Influenza virus
THIHIFSFNGE

SEQ ID NO: 404971 - protein, 11 aa, Influenza virus
HIHIFSFNGEE

SEQ ID NO: 404972 - protein, 11 aa, Influenza virus
IHIFSFNGEEM

SEQ ID NO: 404973 - protein, 11 aa, Influenza virus
HIFSFNGEEMA

SEQ ID NO: 404974 - protein, 11 aa, Influenza virus
IFSFNGEEMAT

SEQ ID NO: 404975 - protein, 11 aa, Influenza virus
FSFTGEEMATR

SEQ ID NO: 404976 - protein, 11 aa, Influenza virus
DYTIDEESRAR

SEQ ID NO: 404977 - protein, 11 aa, Influenza virus
YTIDEESRARI

SEQ ID NO: 404978 - protein, 11 aa, Influenza virus
TIDEESRARIK

SEQ ID NO: 404979 - protein, 11 aa, Influenza virus
IDEESRARIKT

SEQ ID NO: 404980 - protein, 11 aa, Influenza virus
IKTRLYTIRQE

SEQ ID NO: 404981 - protein, 11 aa, Influenza virus
KTRLFTIRQEL

SEQ ID NO: 404982 - protein, 11 aa, Influenza virus
TRLFTIRQELA

SEQ ID NO: 404983 - protein, 11 aa, Influenza virus
RLFTIRQEMAN

SEQ ID NO: 404984 - protein, 11 aa, Influenza virus
RSLWDSFRQSE

SEQ ID NO: 404985 - protein, 11 aa, Influenza virus
SLWDSFRQSER

SEQ ID NO: 404986 - protein, 11 aa, Influenza virus
LWDPFRQSERG

SEQ ID NO: 404987 - protein, 11 aa, Influenza virus
DSFRQSERGED

SEQ ID NO: 404988 - protein, 11 aa, Influenza virus
SFRQSERGEDT

SEQ ID NO: 404989 - protein, 11 aa, Influenza virus
FRQSERGEDTI

SEQ ID NO: 404990 - protein, 11 aa, Influenza virus
RQSERGEDTIE

SEQ ID NO: 404991 - protein, 11 aa, Influenza virus
QSERGEDTIEE

SEQ ID NO: 404992 - protein, 11 aa, Influenza virus
SERGEETIEEK

SEQ ID NO: 404993 - protein, 11 aa, Influenza virus
ERGEETIEEKF

SEQ ID NO: 404994 - protein, 11 aa, Influenza virus
RGEETIEEKFE

SEQ ID NO: 404995 - protein, 11 aa, Influenza virus
GEETIEEKFEI

SEQ ID NO: 404996 - protein, 11 aa, Influenza virus
LANQSLPPNFS

SEQ ID NO: 404997 - protein, 11 aa, Influenza virus
FRAYVDGFKPN

SEQ ID NO: 404998 - protein, 11 aa, Influenza virus
YVDGFEPNGYI

SEQ ID NO: 404999 - protein, 11 aa, Influenza virus
VDGFEPNGYIE

SEQ ID NO: 405000 - protein, 11 aa, Influenza virus
FEPNGYIEGKL

SEQ ID NO: 405001 - protein, 11 aa, Influenza virus
PNGYIEGKLSQ

SEQ ID NO: 405002 - protein, 11 aa, Influenza virus
NGYIEGKLSQM

SEQ ID NO: 405003 - protein, 11 aa, Influenza virus
GYIEGKLSQMS

SEQ ID NO: 405004 - protein, 11 aa, Influenza virus
YIEGKLSQMSK

SEQ ID NO: 405005 - protein, 11 aa, Influenza virus
CHQRSKFLLMD

SEQ ID NO: 405006 - protein, 11 aa, Influenza virus
QRSKFLLMDSL

SEQ ID NO: 405007 - protein, 11 aa, Influenza virus
RSKFLLMDSLK

SEQ ID NO: 405008 - protein, 11 aa, Influenza virus
SKFLLMDSLKL

SEQ ID NO: 405009 - protein, 11 aa, Influenza virus
KFLLMDSLKLS

SEQ ID NO: 405010 - protein, 11 aa, Influenza virus
FLLMDSLKLSI

SEQ ID NO: 405011 - protein, 11 aa, Influenza virus
LLMDSLKLSIE

SEQ ID NO: 405012 - protein, 11 aa, Influenza virus
LMDSLKLSIED

SEQ ID NO: 405013 - protein, 11 aa, Influenza virus
MDSLKLSIEDP

SEQ ID NO: 405014 - protein, 11 aa, Influenza virus
KLSIEDPNHEG

SEQ ID NO: 405015 - protein, 11 aa, Influenza virus
LSIEDPNHEGE

SEQ ID NO: 405016 - protein, 11 aa, Influenza virus
SIEDPNHEGEG

SEQ ID NO: 405017 - protein, 11 aa, Influenza virus
IEDPNHEGEGI

SEQ ID NO: 405018 - protein, 11 aa, Influenza virus
EDPNHEGEGIP

SEQ ID NO: 405019 - protein, 11 aa, Influenza virus
DPNHEGEGIPL

SEQ ID NO: 405020 - protein, 11 aa, Influenza virus
PNHEGEGIPLY

SEQ ID NO: 405021 - protein, 11 aa, Influenza virus
NHEGEGIPLYD

SEQ ID NO: 405022 - protein, 11 aa, Influenza virus
HEGEGIPLHDA

SEQ ID NO: 405023 - protein, 11 aa, Influenza virus
EGEGIPLYDAV

SEQ ID NO: 405024 - protein, 11 aa, Influenza virus
GEGIPLYDAVR

SEQ ID NO: 405025 - protein, 11 aa, Influenza virus
EGIPLYDAVRC

SEQ ID NO: 405026 - protein, 11 aa, Influenza virus
LRWALGENMAP

SEQ ID NO: 405027 - protein, 11 aa, Influenza virus
RWALGENMAPE

SEQ ID NO: 405028 - protein, 11 aa, Influenza virus
WVLGENMAPEK

SEQ ID NO: 405029 - protein, 11 aa, Influenza virus
LGENMAPEKMD

SEQ ID NO: 405030 - protein, 11 aa, Influenza virus
GENMAPEKMDF

SEQ ID NO: 405031 - protein, 11 aa, Influenza virus
WIQNEFNKACE

SEQ ID NO: 405032 - protein, 11 aa, Influenza virus
IQNEFNKACEL

SEQ ID NO: 405033 - protein, 11 aa, Influenza virus
QSEFNKACELT

SEQ ID NO: 405034 - protein, 11 aa, Influenza virus
SEFNKACELTD

SEQ ID NO: 405035 - protein, 11 aa, Influenza virus
FNKACELTDSI

SEQ ID NO: 405036 - protein, 11 aa, Influenza virus
NKACELTDSIW

SEQ ID NO: 405037 - protein, 11 aa, Influenza virus
ELDEIGEDIAP

SEQ ID NO: 405038 - protein, 11 aa, Influenza virus
LDEIGEDIAPI

SEQ ID NO: 405039 - protein, 11 aa, Influenza virus
DEIGEDIAPIE

SEQ ID NO: 405040 - protein, 11 aa, Influenza virus
EIGEDVAPIEY

SEQ ID NO: 405041 - protein, 11 aa, Influenza virus
APIEYIASMRR

SEQ ID NO: 405042 - protein, 11 aa, Influenza virus
YFTAEISHCRA

SEQ ID NO: 405043 - protein, 11 aa, Influenza virus
FTAEISHCRAT

SEQ ID NO: 405044 - protein, 11 aa, Influenza virus
TAEISHCRATE

SEQ ID NO: 405045 - protein, 11 aa, Influenza virus
AEISHCRATEY

SEQ ID NO: 405046 - protein, 11 aa, Influenza virus
EISHCRATEYI

SEQ ID NO: 405047 - protein, 11 aa, Influenza virus
ISHCRATEYIM

SEQ ID NO: 405048 - protein, 11 aa, Influenza virus
SYCRATEYIMK

SEQ ID NO: 405049 - protein, 11 aa, Influenza virus
YCRATEYIMKG

SEQ ID NO: 405050 - protein, 11 aa, Influenza virus
CRATEYMMKGV

SEQ ID NO: 405051 - protein, 11 aa, Influenza virus
RATEYMMKGVY

SEQ ID NO: 405052 - protein, 11 aa, Influenza virus
KGVYVNTALLN

SEQ ID NO: 405053 - protein, 11 aa, Influenza virus
GVYVNTALLNA

SEQ ID NO: 405054 - protein, 11 aa, Influenza virus
VYVNTALLNAS

SEQ ID NO: 405055 - protein, 11 aa, Influenza virus
YVNTALLNASC

SEQ ID NO: 405056 - protein, 11 aa, Influenza virus
VNTALLNASCA

SEQ ID NO: 405057 - protein, 11 aa, Influenza virus
NTAMLNASCAA

SEQ ID NO: 405058 - protein, 11 aa, Influenza virus
TAMLNASCAAM

SEQ ID NO: 405059 - protein, 11 aa, Influenza virus
AMLNASCAAMD

SEQ ID NO: 405060 - protein, 11 aa, Influenza virus
LLNASCAAMDE

SEQ ID NO: 405061 - protein, 11 aa, Influenza virus
LNASCAAMDEF

SEQ ID NO: 405062 - protein, 11 aa, Influenza virus
NASCAAMDEFQ

SEQ ID NO: 405063 - protein, 11 aa, Influenza virus
ASCAAMDEFQL

SEQ ID NO: 405064 - protein, 11 aa, Influenza virus
SCAAMDEFQLI

SEQ ID NO: 405065 - protein, 11 aa, Influenza virus
CAAMDEFQLIP

SEQ ID NO: 405066 - protein, 11 aa, Influenza virus
AAMDEFQLIPM

SEQ ID NO: 405067 - protein, 11 aa, Influenza virus
AMDEFQLIPMI

SEQ ID NO: 405068 - protein, 11 aa, Influenza virus
MDEFQLIPMIS

SEQ ID NO: 405069 - protein, 11 aa, Influenza virus
DEFQLIPMISK

SEQ ID NO: 405070 - protein, 11 aa, Influenza virus
EFQLIPMISKC

SEQ ID NO: 405071 - protein, 11 aa, Influenza virus
FQLIPMISKCK

SEQ ID NO: 405072 - protein, 11 aa, Influenza virus
QLIPMISKCKT

SEQ ID NO: 405073 - protein, 11 aa, Influenza virus
LIPMISKCRTR

SEQ ID NO: 405074 - protein, 11 aa, Influenza virus
IPMISKCRTRE

SEQ ID NO: 405075 - protein, 11 aa, Influenza virus
PMISKCRTREG

SEQ ID NO: 405076 - protein, 11 aa, Influenza virus
MISKCRTREGR

SEQ ID NO: 405077 - protein, 11 aa, Influenza virus
ISKCRTREGRR

SEQ ID NO: 405078 - protein, 11 aa, Influenza virus
SKCRTREGRRK

SEQ ID NO: 405079 - protein, 11 aa, Influenza virus
KCRTREGRRKT

SEQ ID NO: 405080 - protein, 11 aa, Influenza virus
CRTREGRRKTN

SEQ ID NO: 405081 - protein, 11 aa, Influenza virus
RTREGRRKTNL

SEQ ID NO: 405082 - protein, 11 aa, Influenza virus
TREGRRKTNLY

SEQ ID NO: 405083 - protein, 11 aa, Influenza virus
REGRRKTNLYG

SEQ ID NO: 405084 - protein, 11 aa, Influenza virus
EGRRRTNLYGF

SEQ ID NO: 405085 - protein, 11 aa, Influenza virus
GRRRTNLYGFI

SEQ ID NO: 405086 - protein, 11 aa, Influenza virus
RRKTNLYGFIV

SEQ ID NO: 405087 - protein, 11 aa, Influenza virus
RKTNLYGFIVK

SEQ ID NO: 405088 - protein, 11 aa, Influenza virus
KTNLYGFIVKG

SEQ ID NO: 405089 - protein, 11 aa, Influenza virus
TNLYGFIVKGR

SEQ ID NO: 405090 - protein, 11 aa, Influenza virus
NLYGFIVKGRS

SEQ ID NO: 405091 - protein, 11 aa, Influenza virus
LYGFIVKGRSH

SEQ ID NO: 405092 - protein, 11 aa, Influenza virus
YGFIVKGRSHL

SEQ ID NO: 405093 - protein, 11 aa, Influenza virus
GFIVKGRSHLR

SEQ ID NO: 405094 - protein, 11 aa, Influenza virus
FIVKGRSHLRN

SEQ ID NO: 405095 - protein, 11 aa, Influenza virus
IVKGRSHLRND

SEQ ID NO: 405096 - protein, 11 aa, Influenza virus
VKGRSHLRNDT

SEQ ID NO: 405097 - protein, 11 aa, Influenza virus
HLRNDTDVVNY

SEQ ID NO: 405098 - protein, 11 aa, Influenza virus
LRNDTDVVNYV

SEQ ID NO: 405099 - protein, 11 aa, Influenza virus
RNDTDVVNYVS

SEQ ID NO: 405100 - protein, 11 aa, Influenza virus
NDTDVVNYVSM

SEQ ID NO: 405101 - protein, 11 aa, Influenza virus
DTDVVNYVSME

SEQ ID NO: 405102 - protein, 11 aa, Influenza virus
TDVVNYVSMEF

SEQ ID NO: 405103 - protein, 11 aa, Influenza virus
DVVNYVSMEFS

SEQ ID NO: 405104 - protein, 11 aa, Influenza virus
VVNYVSMEFSL

SEQ ID NO: 405105 - protein, 11 aa, Influenza virus
VNYVSMEFSLT

SEQ ID NO: 405106 - protein, 11 aa, Influenza virus
NYVSMEFSLTD

SEQ ID NO: 405107 - protein, 11 aa, Influenza virus
YVSMEFSLTDP

SEQ ID NO: 405108 - protein, 11 aa, Influenza virus
LSMEFSLTDPR

SEQ ID NO: 405109 - protein, 11 aa, Influenza virus
SMEFSLTDPRF

SEQ ID NO: 405110 - protein, 11 aa, Influenza virus
MEFSLTDPRFE

SEQ ID NO: 405111 - protein, 11 aa, Influenza virus
MFLYIRTNGTS

SEQ ID NO: 405112 - protein, 11 aa, Influenza virus
FLYIRTNGTSK

SEQ ID NO: 405113 - protein, 11 aa, Influenza virus
LYVRTNGTSKV

SEQ ID NO: 405114 - protein, 11 aa, Influenza virus
YVRTNGTSKVK

SEQ ID NO: 405115 - protein, 11 aa, Influenza virus
VRTNGTSKVKM

SEQ ID NO: 405116 - protein, 11 aa, Influenza virus
RTNGTSKVKMK

SEQ ID NO: 405117 - protein, 11 aa, Influenza virus
TNGTSKVKMKW

SEQ ID NO: 405118 - protein, 11 aa, Influenza virus
NGTSKVKMKWG

SEQ ID NO: 405119 - protein, 11 aa, Influenza virus
GTSKVKMKWGM

SEQ ID NO: 405120 - protein, 11 aa, Influenza virus
TSKVKMKWGME

SEQ ID NO: 405121 - protein, 11 aa, Influenza virus
SKVKMKWGMEM

SEQ ID NO: 405122 - protein, 11 aa, Influenza virus
KVKMKWGMEMR

SEQ ID NO: 405123 - protein, 11 aa, Influenza virus
VKMKWGMEMRR

SEQ ID NO: 405124 - protein, 11 aa, Influenza virus
KMKWGMELRRC

SEQ ID NO: 405125 - protein, 11 aa, Influenza virus
MKWGMELRRCL

SEQ ID NO: 405126 - protein, 11 aa, Influenza virus
KWGMELRRCLL

SEQ ID NO: 405127 - protein, 11 aa, Influenza virus
WGMELRRCLLQ

SEQ ID NO: 405128 - protein, 11 aa, Influenza virus
GMELRRCLLQS

SEQ ID NO: 405129 - protein, 11 aa, Influenza virus
MELRRCLLQSL

SEQ ID NO: 405130 - protein, 11 aa, Influenza virus
ELRRCLLQSLQ

SEQ ID NO: 405131 - protein, 11 aa, Influenza virus
LRRCLLQSLQQ

SEQ ID NO: 405132 - protein, 11 aa, Influenza virus
LLQSLQQIESI

SEQ ID NO: 405133 - protein, 11 aa, Influenza virus
LQSLQQIESMV

SEQ ID NO: 405134 - protein, 11 aa, Influenza virus
QSLQQIESMVE

SEQ ID NO: 405135 - protein, 11 aa, Influenza virus
SLQQIESMVEA

SEQ ID NO: 405136 - protein, 11 aa, Influenza virus
LQQIESMVEAE

SEQ ID NO: 405137 - protein, 11 aa, Influenza virus
QQIESMVEAES

SEQ ID NO: 405138 - protein, 11 aa, Influenza virus
QIESMVEAESS

SEQ ID NO: 405139 - protein, 11 aa, Influenza virus
IESMIEAESSI

SEQ ID NO: 405140 - protein, 11 aa, Influenza virus
ESMIEAESSIK

SEQ ID NO: 405141 - protein, 11 aa, Influenza virus
MIEAESSIKEK

SEQ ID NO: 405142 - protein, 11 aa, Influenza virus
IEAESSIKEKD

SEQ ID NO: 405143 - protein, 11 aa, Influenza virus
EAESSIKEKDM

SEQ ID NO: 405144 - protein, 11 aa, Influenza virus
AESSIKEKDMT

SEQ ID NO: 405145 - protein, 11 aa, Influenza virus
ESSIKEKDMTK

SEQ ID NO: 405146 - protein, 11 aa, Influenza virus
VEESSIGKVCR

SEQ ID NO: 405147 - protein, 11 aa, Influenza virus
EESSIGKVCRT

SEQ ID NO: 405148 - protein, 11 aa, Influenza virus
ESSIGKVCRTL

SEQ ID NO: 405149 - protein, 11 aa, Influenza virus
SSIGKVCRTLL

SEQ ID NO: 405150 - protein, 11 aa, Influenza virus
SIGKVCRALLA

SEQ ID NO: 405151 - protein, 11 aa, Influenza virus
IGKVCRALLAK

SEQ ID NO: 405152 - protein, 11 aa, Influenza virus
GKVCRALLAKS

SEQ ID NO: 405153 - protein, 11 aa, Influenza virus
KVCRALLAKSV

SEQ ID NO: 405154 - protein, 11 aa, Influenza virus
VCRALLAKSVF

SEQ ID NO: 405155 - protein, 11 aa, Influenza virus
CRALLAKSVFN

SEQ ID NO: 405156 - protein, 11 aa, Influenza virus
RTLLAKSVFNC

SEQ ID NO: 405157 - protein, 11 aa, Influenza virus
TLLAKSVFNCL

SEQ ID NO: 405158 - protein, 11 aa, Influenza virus
LLAKSVFNCLY

SEQ ID NO: 405159 - protein, 11 aa, Influenza virus
LAKSVFNCLYA

SEQ ID NO: 405160 - protein, 11 aa, Influenza virus
AKSVFNCLYAS

SEQ ID NO: 405161 - protein, 11 aa, Influenza virus
FNSLYASSQLE

SEQ ID NO: 405162 - protein, 11 aa, Influenza virus
NSLYASSQLEG

SEQ ID NO: 405163 - protein, 11 aa, Influenza virus
SLYASSQLEGF

SEQ ID NO: 405164 - protein, 11 aa, Influenza virus
LYASSQLEGFS

SEQ ID NO: 405165 - protein, 11 aa, Influenza virus
YASSQLEGFSA

SEQ ID NO: 405166 - protein, 11 aa, Influenza virus
ASSQLEGFSAE

SEQ ID NO: 405167 - protein, 11 aa, Influenza virus
SSQLEGFSAES

SEQ ID NO: 405168 - protein, 11 aa, Influenza virus
SQLEGFSAESR

SEQ ID NO: 405169 - protein, 11 aa, Influenza virus
LEGFSAESRKM

SEQ ID NO: 405170 - protein, 11 aa, Influenza virus
EGFSAESRKML

SEQ ID NO: 405171 - protein, 11 aa, Influenza virus
GFSAESRKMLL

SEQ ID NO: 405172 - protein, 11 aa, Influenza virus
FSAESRKLLLV

SEQ ID NO: 405173 - protein, 11 aa, Influenza virus
AESRKLLLVVQ

SEQ ID NO: 405174 - protein, 11 aa, Influenza virus
ESRKLLLVVQA

SEQ ID NO: 405175 - protein, 11 aa, Influenza virus
QALRDSLEPGT

SEQ ID NO: 405176 - protein, 11 aa, Influenza virus
ALRDSLEPGTF

SEQ ID NO: 405177 - protein, 11 aa, Influenza virus
LRDSLEPGTFD

SEQ ID NO: 405178 - protein, 11 aa, Influenza virus
RDNLEPGTFDI

SEQ ID NO: 405179 - protein, 11 aa, Influenza virus
LEPGTFDLEGL

SEQ ID NO: 405180 - protein, 11 aa, Influenza virus
EPGTFDLEGLY

SEQ ID NO: 405181 - protein, 11 aa, Influenza virus
GLYESIEECLI

SEQ ID NO: 405182 - protein, 11 aa, Influenza virus
LYESIEECLIN

SEQ ID NO: 405183 - protein, 11 aa, Influenza virus
YESIEECLIND

SEQ ID NO: 405184 - protein, 11 aa, Influenza virus
ESIEECLINDP

SEQ ID NO: 405185 - protein, 11 aa, Influenza virus
SIEECLINDPW

SEQ ID NO: 405186 - protein, 11 aa, Influenza virus
VEECLINDPWV

SEQ ID NO: 405187 - protein, 11 aa, Influenza virus
LNASWFNSFLA

SEQ ID NO: 405188 - protein, 11 aa, Influenza virus
NASWFNSFLAH

SEQ ID NO: 405189 - protein, 11 aa, Influenza virus
FNSFLAHALKL

SEQ ID NO: 405190 - protein, 11 aa, Influenza virus
NSFLAHALKLV

SEQ ID NO: 405191 - protein, 11 aa, Influenza virus
SFLAHALKLVV

SEQ ID NO: 405192 - protein, 11 aa, Influenza virus
FLAHALKLVVA

SEQ ID NO: 405193 - protein, 11 aa, Influenza virus
LAHALKLVVAM

SEQ ID NO: 405194 - protein, 11 aa, Influenza virus
AHALKLVVAML

SEQ ID NO: 405195 - protein, 11 aa, Influenza virus
MDVNPTLLFLE

SEQ ID NO: 405196 - protein, 11 aa, Influenza virus
PVQNAISTTFP

SEQ ID NO: 405197 - protein, 11 aa, Influenza virus
VQNAISTTFPY

SEQ ID NO: 405198 - protein, 11 aa, Influenza virus
TGTGYTMDTVS

SEQ ID NO: 405199 - protein, 11 aa, Influenza virus
GTGYTMDTVSR

SEQ ID NO: 405200 - protein, 11 aa, Influenza virus
TGYTMDTVSRT

SEQ ID NO: 405201 - protein, 11 aa, Influenza virus
GYTMDTVSRTH

SEQ ID NO: 405202 - protein, 11 aa, Influenza virus
YTMDTVSRTHQ

SEQ ID NO: 405203 - protein, 11 aa, Influenza virus
TMDTVSRTHQY

SEQ ID NO: 405204 - protein, 11 aa, Influenza virus
MDTVSRTHQYS

SEQ ID NO: 405205 - protein, 11 aa, Influenza virus
TVNRTHQYSER

SEQ ID NO: 405206 - protein, 11 aa, Influenza virus
VNRTHQYSERG

SEQ ID NO: 405207 - protein, 11 aa, Influenza virus
NRTHQYSERGR

SEQ ID NO: 405208 - protein, 11 aa, Influenza virus
RTHQYSERGRW

SEQ ID NO: 405209 - protein, 11 aa, Influenza virus
EIGAPQLNPID

SEQ ID NO: 405210 - protein, 11 aa, Influenza virus
IGAPQLNPIDG

SEQ ID NO: 405211 - protein, 11 aa, Influenza virus
KAPQLNPIDGP

SEQ ID NO: 405212 - protein, 11 aa, Influenza virus
ALQLNPIDGPL

SEQ ID NO: 405213 - protein, 11 aa, Influenza virus
LQLNPIDGPLP

SEQ ID NO: 405214 - protein, 11 aa, Influenza virus
QLNPIDGPLPK

SEQ ID NO: 405215 - protein, 11 aa, Influenza virus
NEPTGYAQTDC

SEQ ID NO: 405216 - protein, 11 aa, Influenza virus
EPTGYAQTDCV

SEQ ID NO: 405217 - protein, 11 aa, Influenza virus
PTGYAQTDCVL

SEQ ID NO: 405218 - protein, 11 aa, Influenza virus
TGYAQTDCVLE

SEQ ID NO: 405219 - protein, 11 aa, Influenza virus
QTDCVLEAMAL

SEQ ID NO: 405220 - protein, 11 aa, Influenza virus
TDCVLEAMALL

SEQ ID NO: 405221 - protein, 11 aa, Influenza virus
DCVLEAMALLE

SEQ ID NO: 405222 - protein, 11 aa, Influenza virus
CVLEAMAFLEK

SEQ ID NO: 405223 - protein, 11 aa, Influenza virus
VLEAMAFLEKS

SEQ ID NO: 405224 - protein, 11 aa, Influenza virus
EAMAFLEKSHP

SEQ ID NO: 405225 - protein, 11 aa, Influenza virus
SHPGIFENSCI

SEQ ID NO: 405226 - protein, 11 aa, Influenza virus
HPGIFENSCIE

SEQ ID NO: 405227 - protein, 11 aa, Influenza virus
IQQTRVDKLTQ

SEQ ID NO: 405228 - protein, 11 aa, Influenza virus
QQTRVDRLTQG

SEQ ID NO: 405229 - protein, 11 aa, Influenza virus
QTRVDRLTQGR

SEQ ID NO: 405230 - protein, 11 aa, Influenza virus
TRVDRLTQGRQ

SEQ ID NO: 405231 - protein, 11 aa, Influenza virus
RVDRLTQGRQT

SEQ ID NO: 405232 - protein, 11 aa, Influenza virus
VDKLTQGRQTF

SEQ ID NO: 405233 - protein, 11 aa, Influenza virus
DKLTQGRQTFD

SEQ ID NO: 405234 - protein, 11 aa, Influenza virus
KLTQGRQTFDW

SEQ ID NO: 405235 - protein, 11 aa, Influenza virus
LTQGRQTFDWT

SEQ ID NO: 405236 - protein, 11 aa, Influenza virus
TQGRQTFDWTL

SEQ ID NO: 405237 - protein, 11 aa, Influenza virus
QGRQTFDWTLN

SEQ ID NO: 405238 - protein, 11 aa, Influenza virus
GRQTFDWTLNR

SEQ ID NO: 405239 - protein, 11 aa, Influenza virus
RQTFDWTLNRN

SEQ ID NO: 405240 - protein, 11 aa, Influenza virus
QTFDWTLNRNQ

SEQ ID NO: 405241 - protein, 11 aa, Influenza virus
TFDWTLNRNQP

SEQ ID NO: 405242 - protein, 11 aa, Influenza virus
FDWTLNRNQPA

SEQ ID NO: 405243 - protein, 11 aa, Influenza virus
AATALANTIEI

SEQ ID NO: 405244 - protein, 11 aa, Influenza virus
ATALANTIEIF

SEQ ID NO: 405245 - protein, 11 aa, Influenza virus
TALANTIEIFR

SEQ ID NO: 405246 - protein, 11 aa, Influenza virus
ALANTIEIFRS

SEQ ID NO: 405247 - protein, 11 aa, Influenza virus
LANTIEIFRSN

SEQ ID NO: 405248 - protein, 11 aa, Influenza virus
SESGRLIDFLK

SEQ ID NO: 405249 - protein, 11 aa, Influenza virus
ESGRLMDFLKD

SEQ ID NO: 405250 - protein, 11 aa, Influenza virus
SGRLMDFLKDV

SEQ ID NO: 405251 - protein, 11 aa, Influenza virus
GRLIDFLKDVI

SEQ ID NO: 405252 - protein, 11 aa, Influenza virus
THFQRKRRIRD

SEQ ID NO: 405253 - protein, 11 aa, Influenza virus
HFQRKRRIRDN

SEQ ID NO: 405254 - protein, 11 aa, Influenza virus
GYLIRALTLNT

SEQ ID NO: 405255 - protein, 11 aa, Influenza virus
YLIRTLTLNTM

SEQ ID NO: 405256 - protein, 11 aa, Influenza virus
LIRTLTLNTMT

SEQ ID NO: 405257 - protein, 11 aa, Influenza virus
IRTLTLNTMTK

SEQ ID NO: 405258 - protein, 11 aa, Influenza virus
RTLTLNTMTKD

SEQ ID NO: 405259 - protein, 11 aa, Influenza virus
TLTLNTMTKDA

SEQ ID NO: 405260 - protein, 11 aa, Influenza virus
TPGMQIRGFVH

SEQ ID NO: 405261 - protein, 11 aa, Influenza virus
PGMQIRGFVHF

SEQ ID NO: 405262 - protein, 11 aa, Influenza virus
GMQIRGFVHFV

SEQ ID NO: 405263 - protein, 11 aa, Influenza virus
MQIRGFVHFVE

SEQ ID NO: 405264 - protein, 11 aa, Influenza virus
QIRGFVYFVEA

SEQ ID NO: 405265 - protein, 11 aa, Influenza virus
IRGFVYFVEAL

SEQ ID NO: 405266 - protein, 11 aa, Influenza virus
RGFVYFVEALA

SEQ ID NO: 405267 - protein, 11 aa, Influenza virus
LARRICEKLEQ

SEQ ID NO: 405268 - protein, 11 aa, Influenza virus
ARRICEKLEQS

SEQ ID NO: 405269 - protein, 11 aa, Influenza virus
RRICEKLEQSG

SEQ ID NO: 405270 - protein, 11 aa, Influenza virus
RICEKLEQSGL

SEQ ID NO: 405271 - protein, 11 aa, Influenza virus
LANVVRKMMTS

SEQ ID NO: 405272 - protein, 11 aa, Influenza virus
ANVVRKMMTSS

SEQ ID NO: 405273 - protein, 11 aa, Influenza virus
NVVRKMMTSSQ

SEQ ID NO: 405274 - protein, 11 aa, Influenza virus
VVRKMMTSSQD

SEQ ID NO: 405275 - protein, 11 aa, Influenza virus
VRKMMTSSQDT

SEQ ID NO: 405276 - protein, 11 aa, Influenza virus
RKMMTSSQDTE

SEQ ID NO: 405277 - protein, 11 aa, Influenza virus
SQDTEISFTIT

SEQ ID NO: 405278 - protein, 11 aa, Influenza virus
QDTEISFTITG

SEQ ID NO: 405279 - protein, 11 aa, Influenza virus
DTEISFTITGD

SEQ ID NO: 405280 - protein, 11 aa, Influenza virus
TEISFTITGDN

SEQ ID NO: 405281 - protein, 11 aa, Influenza virus
EISFTITGDNT

SEQ ID NO: 405282 - protein, 11 aa, Influenza virus
ISFTITGDNTK

SEQ ID NO: 405283 - protein, 11 aa, Influenza virus
TKWNENQNPRV

SEQ ID NO: 405284 - protein, 11 aa, Influenza virus
KWNENQNPRVF

SEQ ID NO: 405285 - protein, 11 aa, Influenza virus
WNENQNPRVFL

SEQ ID NO: 405286 - protein, 11 aa, Influenza virus
NENQNPRIFLA

SEQ ID NO: 405287 - protein, 11 aa, Influenza virus
ENQNPRIFLAM

SEQ ID NO: 405288 - protein, 11 aa, Influenza virus
NQNPRIFLAMI

SEQ ID NO: 405289 - protein, 11 aa, Influenza virus
QNPRIFLAMIT

SEQ ID NO: 405290 - protein, 11 aa, Influenza virus
NPRIFLAMITY

SEQ ID NO: 405291 - protein, 11 aa, Influenza virus
PRIFLAMITYI

SEQ ID NO: 405292 - protein, 11 aa, Influenza virus
RIFLAMITYIT

SEQ ID NO: 405293 - protein, 11 aa, Influenza virus
WFRNILSMAPI

SEQ ID NO: 405294 - protein, 11 aa, Influenza virus
FRNILSMAPIM

SEQ ID NO: 405295 - protein, 11 aa, Influenza virus
RNILSMAPIMF

SEQ ID NO: 405296 - protein, 11 aa, Influenza virus
NILSMAPIMFS

SEQ ID NO: 405297 - protein, 11 aa, Influenza virus
ILSMAPIMFSN

SEQ ID NO: 405298 - protein, 11 aa, Influenza virus
LSMAPIMFSNK

SEQ ID NO: 405299 - protein, 11 aa, Influenza virus
SMAPIMFSNKM

SEQ ID NO: 405300 - protein, 11 aa, Influenza virus
MAPIMFSNKMA

SEQ ID NO: 405301 - protein, 11 aa, Influenza virus
APIMFSNKVAR

SEQ ID NO: 405302 - protein, 11 aa, Influenza virus
PIMFSNKVARL

SEQ ID NO: 405303 - protein, 11 aa, Influenza virus
IMFSNKVARLG

SEQ ID NO: 405304 - protein, 11 aa, Influenza virus
MFSNKMARLGR

SEQ ID NO: 405305 - protein, 11 aa, Influenza virus
FSNKMARLGRG

SEQ ID NO: 405306 - protein, 11 aa, Influenza virus
SNKMARLGRGY

SEQ ID NO: 405307 - protein, 11 aa, Influenza virus
NKMARLGRGYM

SEQ ID NO: 405308 - protein, 11 aa, Influenza virus
KMARLGRGYMF

SEQ ID NO: 405309 - protein, 11 aa, Influenza virus
MARLGRGYMFE

SEQ ID NO: 405310 - protein, 11 aa, Influenza virus
ARLGRGYMFES

SEQ ID NO: 405311 - protein, 11 aa, Influenza virus
RLGRGYMFESK

SEQ ID NO: 405312 - protein, 11 aa, Influenza virus
GAASLSPGMMM

SEQ ID NO: 405313 - protein, 11 aa, Influenza virus
AASLSPGMMMG

SEQ ID NO: 405314 - protein, 11 aa, Influenza virus
VSLSPGMMMGM

SEQ ID NO: 405315 - protein, 11 aa, Influenza virus
NMLSTVLGVSV

SEQ ID NO: 405316 - protein, 11 aa, Influenza virus
MLSTVLGVSVL

SEQ ID NO: 405317 - protein, 11 aa, Influenza virus
LSTVLGVSVLN

SEQ ID NO: 405318 - protein, 11 aa, Influenza virus
STVLGVSVLNL

SEQ ID NO: 405319 - protein, 11 aa, Influenza virus
TVLGVSVLNLG

SEQ ID NO: 405320 - protein, 11 aa, Influenza virus
VLGVSVLNLGQ

SEQ ID NO: 405321 - protein, 11 aa, Influenza virus
LGVSILNLGQR

SEQ ID NO: 405322 - protein, 11 aa, Influenza virus
TIYWWDGLQSS

SEQ ID NO: 405323 - protein, 11 aa, Influenza virus
IYWWDGLQSSD

SEQ ID NO: 405324 - protein, 11 aa, Influenza virus
LQSSDDFALIL

SEQ ID NO: 405325 - protein, 11 aa, Influenza virus
QSSDDFALILN

SEQ ID NO: 405326 - protein, 11 aa, Influenza virus
SSDDFALILNA

SEQ ID NO: 405327 - protein, 11 aa, Influenza virus
SDDFALIVNAS

SEQ ID NO: 405328 - protein, 11 aa, Influenza virus
GIQAGVNRFYR

SEQ ID NO: 405329 - protein, 11 aa, Influenza virus
IQAGVDRFYRI

SEQ ID NO: 405330 - protein, 11 aa, Influenza virus
QAGVDRFYRIC

SEQ ID NO: 405331 - protein, 11 aa, Influenza virus
AGVDRFYRICK

SEQ ID NO: 405332 - protein, 11 aa, Influenza virus
GVDRFYRICKL

SEQ ID NO: 405333 - protein, 11 aa, Influenza virus
DRFYRTCKLLG

SEQ ID NO: 405334 - protein, 11 aa, Influenza virus
RFYRTCKLLGI

SEQ ID NO: 405335 - protein, 11 aa, Influenza virus
FYRTCKLLGIN

SEQ ID NO: 405336 - protein, 11 aa, Influenza virus
YRTCKLLGINM

SEQ ID NO: 405337 - protein, 11 aa, Influenza virus
RTCKLLGINMS

SEQ ID NO: 405338 - protein, 11 aa, Influenza virus
TCKLLGINMSK

SEQ ID NO: 405339 - protein, 11 aa, Influenza virus
CKLLGINMSKK

SEQ ID NO: 405340 - protein, 11 aa, Influenza virus
KLLGINMSKKK

SEQ ID NO: 405341 - protein, 11 aa, Influenza virus
LLGINMSKKKS

SEQ ID NO: 405342 - protein, 11 aa, Influenza virus
LGINMSKKKSY

SEQ ID NO: 405343 - protein, 11 aa, Influenza virus
GINMSKRKSYI

SEQ ID NO: 405344 - protein, 11 aa, Influenza virus
INMSKRKSYIN

SEQ ID NO: 405345 - protein, 11 aa, Influenza virus
NMSKKKSYINK

SEQ ID NO: 405346 - protein, 11 aa, Influenza virus
MSKKKSYINKT

SEQ ID NO: 405347 - protein, 11 aa, Influenza virus
SKKKSYINKTG

SEQ ID NO: 405348 - protein, 11 aa, Influenza virus
KKKSYINKTGT

SEQ ID NO: 405349 - protein, 11 aa, Influenza virus
KKSYINKTGTF

SEQ ID NO: 405350 - protein, 11 aa, Influenza virus
KSYINKTGTFE

SEQ ID NO: 405351 - protein, 11 aa, Influenza virus
SYINKTGTFEF

SEQ ID NO: 405352 - protein, 11 aa, Influenza virus
YINKTGTFEFT

SEQ ID NO: 405353 - protein, 11 aa, Influenza virus
INKTGTFEFTS

SEQ ID NO: 405354 - protein, 11 aa, Influenza virus
NKTGTFEFTSF

SEQ ID NO: 405355 - protein, 11 aa, Influenza virus
KTGTFEFTSFF

SEQ ID NO: 405356 - protein, 11 aa, Influenza virus
MELPSFGVSGV

SEQ ID NO: 405357 - protein, 11 aa, Influenza virus
ELPSFGVSGVN

SEQ ID NO: 405358 - protein, 11 aa, Influenza virus
LPSFGVSGVNE

SEQ ID NO: 405359 - protein, 11 aa, Influenza virus
PSFGVSGVNES

SEQ ID NO: 405360 - protein, 11 aa, Influenza virus
SFGVSGVNESA

SEQ ID NO: 405361 - protein, 11 aa, Influenza virus
FGVSGVNESAD

SEQ ID NO: 405362 - protein, 11 aa, Influenza virus
GVSGVNESADM

SEQ ID NO: 405363 - protein, 11 aa, Influenza virus
VSGVNESADMS

SEQ ID NO: 405364 - protein, 11 aa, Influenza virus
SGVNESADMSI

SEQ ID NO: 405365 - protein, 11 aa, Influenza virus
GVNESADMSIG

SEQ ID NO: 405366 - protein, 11 aa, Influenza virus
VNESADMSIGV

SEQ ID NO: 405367 - protein, 11 aa, Influenza virus
NESADMSIGIT

SEQ ID NO: 405368 - protein, 11 aa, Influenza virus
ESADMSIGITV

SEQ ID NO: 405369 - protein, 11 aa, Influenza virus
SADMSIGITVI

SEQ ID NO: 405370 - protein, 11 aa, Influenza virus
ADMSIGITVIK

SEQ ID NO: 405371 - protein, 11 aa, Influenza virus
DMSIGITVIKN

SEQ ID NO: 405372 - protein, 11 aa, Influenza virus
MSIGITVIKNN

SEQ ID NO: 405373 - protein, 11 aa, Influenza virus
SIGITVIKNNM

SEQ ID NO: 405374 - protein, 11 aa, Influenza virus
IGITVIKNNMI

SEQ ID NO: 405375 - protein, 11 aa, Influenza virus
GITVIKNNMIN

SEQ ID NO: 405376 - protein, 11 aa, Influenza virus
TVIRNNMINND

SEQ ID NO: 405377 - protein, 11 aa, Influenza virus
VIRNNMINNDL

SEQ ID NO: 405378 - protein, 11 aa, Influenza virus
IRNNMINNDLG

SEQ ID NO: 405379 - protein, 11 aa, Influenza virus
RNNMINNDLGP

SEQ ID NO: 405380 - protein, 11 aa, Influenza virus
NNMVNNDLGPA

SEQ ID NO: 405381 - protein, 11 aa, Influenza virus
KDYRYTYRCHK

SEQ ID NO: 405382 - protein, 11 aa, Influenza virus
DYRYTYRCHKG

SEQ ID NO: 405383 - protein, 11 aa, Influenza virus
YRYTYRCHKGD

SEQ ID NO: 405384 - protein, 11 aa, Influenza virus
RYTYRCHKGDT

SEQ ID NO: 405385 - protein, 11 aa, Influenza virus
YTYRCHKGDTQ

SEQ ID NO: 405386 - protein, 11 aa, Influenza virus
GLLISDGGPNL

SEQ ID NO: 405387 - protein, 11 aa, Influenza virus
LLISDGGPNLY

SEQ ID NO: 405388 - protein, 11 aa, Influenza virus
LISDGGPNLYN

SEQ ID NO: 405389 - protein, 11 aa, Influenza virus
ISDGGPNLYNI

SEQ ID NO: 405390 - protein, 11 aa, Influenza virus
ADGGPNLYNIR

SEQ ID NO: 405391 - protein, 11 aa, Influenza virus
SNLYNIRNLHI

SEQ ID NO: 405392 - protein, 11 aa, Influenza virus
YNIRNLHIPEA

SEQ ID NO: 405393 - protein, 11 aa, Influenza virus
NIRNLHIPEAG

SEQ ID NO: 405394 - protein, 11 aa, Influenza virus
IRNLHIPEAGL

SEQ ID NO: 405395 - protein, 11 aa, Influenza virus
RNLHIPEAGLK

SEQ ID NO: 405396 - protein, 11 aa, Influenza virus
NLHIPEAGLKW

SEQ ID NO: 405397 - protein, 11 aa, Influenza virus
LHIPEVCLKWD

SEQ ID NO: 405398 - protein, 11 aa, Influenza virus
HIPEVCLKWDL

SEQ ID NO: 405399 - protein, 11 aa, Influenza virus
IPEVCLKWDLM

SEQ ID NO: 405400 - protein, 11 aa, Influenza virus
PEVCLKWDLMD

SEQ ID NO: 405401 - protein, 11 aa, Influenza virus
YRGRLCNPLNP

SEQ ID NO: 405402 - protein, 11 aa, Influenza virus
RGRLCNPLNPF

SEQ ID NO: 405403 - protein, 11 aa, Influenza virus
GRLCNPMNPFV

SEQ ID NO: 405404 - protein, 11 aa, Influenza virus
RLCNPLNPFVN

SEQ ID NO: 405405 - protein, 11 aa, Influenza virus
LCNPLNPFVNH

SEQ ID NO: 405406 - protein, 11 aa, Influenza virus
IEYDAVATTHS

SEQ ID NO: 405407 - protein, 11 aa, Influenza virus
YDAVATTHSWV

SEQ ID NO: 405408 - protein, 11 aa, Influenza virus
DAVATTHSWVP

SEQ ID NO: 405409 - protein, 11 aa, Influenza virus
AVATTHSWVPK

SEQ ID NO: 405410 - protein, 11 aa, Influenza virus
VATTHSWVPKR

SEQ ID NO: 405411 - protein, 11 aa, Influenza virus
ATTHSWVPKRN

SEQ ID NO: 405412 - protein, 11 aa, Influenza virus
TTHSWVPKRNR

SEQ ID NO: 405413 - protein, 11 aa, Influenza virus
THSWVPKRNRS

SEQ ID NO: 405414 - protein, 11 aa, Influenza virus
HSWVPKRNRSI

SEQ ID NO: 405415 - protein, 11 aa, Influenza virus
SWVPKRNRSIL

SEQ ID NO: 405416 - protein, 11 aa, Influenza virus
WVPKRNRSILN

SEQ ID NO: 405417 - protein, 11 aa, Influenza virus
VPKRNRSILNT

SEQ ID NO: 405418 - protein, 11 aa, Influenza virus
RSILNTSQRGV

SEQ ID NO: 405419 - protein, 11 aa, Influenza virus
SILNTSQRGVL

SEQ ID NO: 405420 - protein, 11 aa, Influenza virus
ILNTSQRGVLE

SEQ ID NO: 405421 - protein, 11 aa, Influenza virus
LNTSQRGVLED

SEQ ID NO: 405422 - protein, 11 aa, Influenza virus
NTSQRGVLEDE

SEQ ID NO: 405423 - protein, 11 aa, Influenza virus
TSQRGVLEDEQ

SEQ ID NO: 405424 - protein, 11 aa, Influenza virus
SQRGVLEDEQM

SEQ ID NO: 405425 - protein, 11 aa, Influenza virus
QRGVLEDEQMY

SEQ ID NO: 405426 - protein, 11 aa, Influenza virus
RGVLEDEQMYQ

SEQ ID NO: 405427 - protein, 11 aa, Influenza virus
GILEDEQMYQR

SEQ ID NO: 405428 - protein, 11 aa, Influenza virus
ILEDEQMYQRC

SEQ ID NO: 405429 - protein, 11 aa, Influenza virus
LEDEQMYQRCC

SEQ ID NO: 405430 - protein, 11 aa, Influenza virus
EDEQMYQRCCN

SEQ ID NO: 405431 - protein, 11 aa, Influenza virus
DEQMYQRCCNL

SEQ ID NO: 405432 - protein, 11 aa, Influenza virus
EQMYQRCCNLF

SEQ ID NO: 405433 - protein, 11 aa, Influenza virus
MYQRCCNLFEK

SEQ ID NO: 405434 - protein, 11 aa, Influenza virus
YQRCCNLFEKF

SEQ ID NO: 405435 - protein, 11 aa, Influenza virus
QRCCNLFEKFF

SEQ ID NO: 405436 - protein, 11 aa, Influenza virus
RCCNLFEKFFP

SEQ ID NO: 405437 - protein, 11 aa, Influenza virus
CCSLFEKFFPS

SEQ ID NO: 405438 - protein, 11 aa, Influenza virus
CSLFEKFFPSS

SEQ ID NO: 405439 - protein, 11 aa, Influenza virus
SLFEKFFPSSS

SEQ ID NO: 405440 - protein, 11 aa, Influenza virus
FFPSSSYRRPI

SEQ ID NO: 405441 - protein, 11 aa, Influenza virus
FPSSSYRRPIG

SEQ ID NO: 405442 - protein, 11 aa, Influenza virus
PSSSYRRPIGI

SEQ ID NO: 405443 - protein, 11 aa, Influenza virus
SSSYRRPIGIS

SEQ ID NO: 405444 - protein, 11 aa, Influenza virus
SSYRRPIGISS

SEQ ID NO: 405445 - protein, 11 aa, Influenza virus
SYRRPIGISSM

SEQ ID NO: 405446 - protein, 11 aa, Influenza virus
YRRPIGISSMV

SEQ ID NO: 405447 - protein, 11 aa, Influenza virus
RRPIGISSMVE

SEQ ID NO: 405448 - protein, 11 aa, Influenza virus
RPIGISSMVEA

SEQ ID NO: 405449 - protein, 11 aa, Influenza virus
PIGISSMVEAM

SEQ ID NO: 405450 - protein, 11 aa, Influenza virus
GISSMMEAMVS

SEQ ID NO: 405451 - protein, 11 aa, Influenza virus
ISSMMEAMVSR

SEQ ID NO: 405452 - protein, 11 aa, Influenza virus
SSMMEAMVSRA

SEQ ID NO: 405453 - protein, 11 aa, Influenza virus
SMMEAMVSRAR

SEQ ID NO: 405454 - protein, 11 aa, Influenza virus
MMEAMVSRARI

SEQ ID NO: 405455 - protein, 11 aa, Influenza virus
MEAMVSRARID

SEQ ID NO: 405456 - protein, 11 aa, Influenza virus
EAMISRARIDA

SEQ ID NO: 405457 - protein, 11 aa, Influenza virus
AMISRARIDAR

SEQ ID NO: 405458 - protein, 11 aa, Influenza virus
MVSRARIDARV

SEQ ID NO: 405459 - protein, 11 aa, Influenza virus
VSRARIDARVD

SEQ ID NO: 405460 - protein, 11 aa, Influenza virus
SRARIDARVDF

SEQ ID NO: 405461 - protein, 11 aa, Influenza virus
RARIDARVDFE

SEQ ID NO: 405462 - protein, 11 aa, Influenza virus
ARIDARVDFES

SEQ ID NO: 405463 - protein, 11 aa, Influenza virus
RIDARVDFESG

SEQ ID NO: 405464 - protein, 11 aa, Influenza virus
IDARVDFESGR

SEQ ID NO: 405465 - protein, 11 aa, Influenza virus
GKKEEFSEIMR

SEQ ID NO: 405466 - protein, 11 aa, Influenza virus
TIEELRRQKSL

SEQ ID NO: 405467 - protein, 11 aa, Influenza virus
IEELRRQKSLI

SEQ ID NO: 405468 - protein, 11 aa, Influenza virus
EELRRQKWWVW

SEQ ID NO: 405469 - protein, 11 aa, Influenza virus
ELRRQKSLIWL

SEQ ID NO: 405470 - protein, 11 aa, Influenza virus
LRRQKWWVWLW

SEQ ID NO: 405471 - protein, 11 aa, Influenza virus
RRQKWWVWLWL

SEQ ID NO: 405472 - protein, 11 aa, Influenza virus
RQKWWVWLWLV

SEQ ID NO: 405473 - protein, 11 aa, Influenza virus
QKSLIWLWLVL

SEQ ID NO: 405474 - protein, 11 aa, Influenza virus
KWWVWLWLVLR

SEQ ID NO: 405475 - protein, 11 aa, Influenza virus
SLIWLWLVLRE

SEQ ID NO: 405476 - protein, 11 aa, Influenza virus
WVWLWLVLREK

SEQ ID NO: 405477 - protein, 11 aa, Influenza virus
SKSRSNIFNME

SEQ ID NO: 405478 - protein, 11 aa, Influenza virus
KSRSNIFNMER

SEQ ID NO: 405479 - protein, 11 aa, Influenza virus
SRSIIFNMERI

SEQ ID NO: 405480 - protein, 11 aa, Influenza virus
RSIIFNMERIK

SEQ ID NO: 405481 - protein, 11 aa, Influenza virus
SIIFNMERIKE

SEQ ID NO: 405482 - protein, 11 aa, Influenza virus
IIFNMERIKEL

SEQ ID NO: 405483 - protein, 11 aa, Influenza virus
FNMERIKELRY

SEQ ID NO: 405484 - protein, 11 aa, Influenza virus
NMERIKELRYL

SEQ ID NO: 405485 - protein, 11 aa, Influenza virus
LMLQSRTREIL

SEQ ID NO: 405486 - protein, 11 aa, Influenza virus
MLQSRTREILT

SEQ ID NO: 405487 - protein, 11 aa, Influenza virus
SRTREILTRTT

SEQ ID NO: 405488 - protein, 11 aa, Influenza virus
RTREILTRTTV

SEQ ID NO: 405489 - protein, 11 aa, Influenza virus
TREILTRTTVD

SEQ ID NO: 405490 - protein, 11 aa, Influenza virus
REILTRTTVDH

SEQ ID NO: 405491 - protein, 11 aa, Influenza virus
EILTRTTVDHM

SEQ ID NO: 405492 - protein, 11 aa, Influenza virus
ILTRTTVDHMA

SEQ ID NO: 405493 - protein, 11 aa, Influenza virus
LTRTTVDHMAI

SEQ ID NO: 405494 - protein, 11 aa, Influenza virus
TRTTVDHMAII

SEQ ID NO: 405495 - protein, 11 aa, Influenza virus
RTTVDHMAIIK

SEQ ID NO: 405496 - protein, 11 aa, Influenza virus
ITVDHMAIIKK

SEQ ID NO: 405497 - protein, 11 aa, Influenza virus
TVDHMAIIKRY

SEQ ID NO: 405498 - protein, 11 aa, Influenza virus
VDHMAIIKRYT

SEQ ID NO: 405499 - protein, 11 aa, Influenza virus
DHMAIIKRYTS

SEQ ID NO: 405500 - protein, 11 aa, Influenza virus
HMAIIKKYTSA

SEQ ID NO: 405501 - protein, 11 aa, Influenza virus
MAIIKKYTSAR

SEQ ID NO: 405502 - protein, 11 aa, Influenza virus
AIIKKYTSARQ

SEQ ID NO: 405503 - protein, 11 aa, Influenza virus
IIKKYTSARQE

SEQ ID NO: 405504 - protein, 11 aa, Influenza virus
IKKYTSARQEK

SEQ ID NO: 405505 - protein, 11 aa, Influenza virus
KKYTSARQEKN

SEQ ID NO: 405506 - protein, 11 aa, Influenza virus
KYTSARQEKNP

SEQ ID NO: 405507 - protein, 11 aa, Influenza virus
YTSGRQEKNPS

SEQ ID NO: 405508 - protein, 11 aa, Influenza virus
TSGRQEKNPSL

SEQ ID NO: 405509 - protein, 11 aa, Influenza virus
SGRQEKNPSLR

SEQ ID NO: 405510 - protein, 11 aa, Influenza virus
GRQEKNPSLRM

SEQ ID NO: 405511 - protein, 11 aa, Influenza virus
RQEKNPSLRMK

SEQ ID NO: 405512 - protein, 11 aa, Influenza virus
QEKNPSLRMKW

SEQ ID NO: 405513 - protein, 11 aa, Influenza virus
EKNPSLRMKWM

SEQ ID NO: 405514 - protein, 11 aa, Influenza virus
KNPSLRMKWMM

SEQ ID NO: 405515 - protein, 11 aa, Influenza virus
NPSLRMKWMMA

SEQ ID NO: 405516 - protein, 11 aa, Influenza virus
PSLRMKWMMAM

SEQ ID NO: 405517 - protein, 11 aa, Influenza virus
SLRMKWMMAMK

SEQ ID NO: 405518 - protein, 11 aa, Influenza virus
LRMKWMMAMRY

SEQ ID NO: 405519 - protein, 11 aa, Influenza virus
RMKWMMAMRYP

SEQ ID NO: 405520 - protein, 11 aa, Influenza virus
MKWMMAMRYPI

SEQ ID NO: 405521 - protein, 11 aa, Influenza virus
KWMMAMRYPIT

SEQ ID NO: 405522 - protein, 11 aa, Influenza virus
WMMAMRYPITA

SEQ ID NO: 405523 - protein, 11 aa, Influenza virus
MMAMRYPITAD

SEQ ID NO: 405524 - protein, 11 aa, Influenza virus
MISPLAVTWWN

SEQ ID NO: 405525 - protein, 11 aa, Influenza virus
ISPLAVTWWNR

SEQ ID NO: 405526 - protein, 11 aa, Influenza virus
SPLAVTWWNRK

SEQ ID NO: 405527 - protein, 11 aa, Influenza virus
PLAVTWWNRKG

SEQ ID NO: 405528 - protein, 11 aa, Influenza virus
LAVTWWNRKGP

SEQ ID NO: 405529 - protein, 11 aa, Influenza virus
GTFGPVHFQNQ

SEQ ID NO: 405530 - protein, 11 aa, Influenza virus
FGPVHFRNQIK

SEQ ID NO: 405531 - protein, 11 aa, Influenza virus
GPVHFRNQIKI

SEQ ID NO: 405532 - protein, 11 aa, Influenza virus
PVHFRNQIKIR

SEQ ID NO: 405533 - protein, 11 aa, Influenza virus
VHFRNQIKIRR

SEQ ID NO: 405534 - protein, 11 aa, Influenza virus
HFRNQIKIRRR

SEQ ID NO: 405535 - protein, 11 aa, Influenza virus
FRNQIKIRRRV

SEQ ID NO: 405536 - protein, 11 aa, Influenza virus
RNQIKIRRRVD

SEQ ID NO: 405537 - protein, 11 aa, Influenza virus
QVKIRRRVDTN

SEQ ID NO: 405538 - protein, 11 aa, Influenza virus
VKIRRRVDTNP

SEQ ID NO: 405539 - protein, 11 aa, Influenza virus
KIRRRVDTNPG

SEQ ID NO: 405540 - protein, 11 aa, Influenza virus
IRRRVDTNPGH

SEQ ID NO: 405541 - protein, 11 aa, Influenza virus
RRRVDTNPGHA

SEQ ID NO: 405542 - protein, 11 aa, Influenza virus
SKEAQDVIMEV

SEQ ID NO: 405543 - protein, 11 aa, Influenza virus
KEAQDVIMEIV

SEQ ID NO: 405544 - protein, 11 aa, Influenza virus
EAQDVIMEIVF

SEQ ID NO: 405545 - protein, 11 aa, Influenza virus
QDVIMEIVFPN

SEQ ID NO: 405546 - protein, 11 aa, Influenza virus
EVVFPNEVGAK

SEQ ID NO: 405547 - protein, 11 aa, Influenza virus
VVFPNEVGAKI

SEQ ID NO: 405548 - protein, 11 aa, Influenza virus
VFPNEVGAKIL

SEQ ID NO: 405549 - protein, 11 aa, Influenza virus
FPNEVGAKILT

SEQ ID NO: 405550 - protein, 11 aa, Influenza virus
PNEVGAKILTS

SEQ ID NO: 405551 - protein, 11 aa, Influenza virus
NEVGAKILTSE

SEQ ID NO: 405552 - protein, 11 aa, Influenza virus
EVGAKILTSES

SEQ ID NO: 405553 - protein, 11 aa, Influenza virus
VGAKILTSESQ

SEQ ID NO: 405554 - protein, 11 aa, Influenza virus
GAKILTSESQL

SEQ ID NO: 405555 - protein, 11 aa, Influenza virus
ISPLMVAYMLE

SEQ ID NO: 405556 - protein, 11 aa, Influenza virus
SPLMVAYMLER

SEQ ID NO: 405557 - protein, 11 aa, Influenza virus
LMMAYMLEREL

SEQ ID NO: 405558 - protein, 11 aa, Influenza virus
MMAYMLERELV

SEQ ID NO: 405559 - protein, 11 aa, Influenza virus
LVRKTRFLPVS

SEQ ID NO: 405560 - protein, 11 aa, Influenza virus
VRKTRFLPVSG

SEQ ID NO: 405561 - protein, 11 aa, Influenza virus
RKTRFLPVSGG

SEQ ID NO: 405562 - protein, 11 aa, Influenza virus
KTRFLPVSGGT

SEQ ID NO: 405563 - protein, 11 aa, Influenza virus
TRFLPVAGGTG

SEQ ID NO: 405564 - protein, 11 aa, Influenza virus
RFLPVAGGTGS

SEQ ID NO: 405565 - protein, 11 aa, Influenza virus
GGTGSVYIEVL

SEQ ID NO: 405566 - protein, 11 aa, Influenza virus
GTGSVYIEVLH

SEQ ID NO: 405567 - protein, 11 aa, Influenza virus
TGSVYIEVLHL

SEQ ID NO: 405568 - protein, 11 aa, Influenza virus
GSVYIEVLHLT

SEQ ID NO: 405569 - protein, 11 aa, Influenza virus
SIYIEVLHLTQ

SEQ ID NO: 405570 - protein, 11 aa, Influenza virus
IYIEVLHLTQG

SEQ ID NO: 405571 - protein, 11 aa, Influenza virus
YIEVLHLTQGA

SEQ ID NO: 405572 - protein, 11 aa, Influenza virus
IEVLHLTQGAC

SEQ ID NO: 405573 - protein, 11 aa, Influenza virus
EVLHLTQGACW

SEQ ID NO: 405574 - protein, 11 aa, Influenza virus
VLHLTQGACWE

SEQ ID NO: 405575 - protein, 11 aa, Influenza virus
LHLTQGACWEQ

SEQ ID NO: 405576 - protein, 11 aa, Influenza virus
HLTQGACWEQL

SEQ ID NO: 405577 - protein, 11 aa, Influenza virus
LTQGACWEQLY

SEQ ID NO: 405578 - protein, 11 aa, Influenza virus
TQGACWEQLYT

SEQ ID NO: 405579 - protein, 11 aa, Influenza virus
QGACWEQLYTP

SEQ ID NO: 405580 - protein, 11 aa, Influenza virus
GACWEQLYTPG

SEQ ID NO: 405581 - protein, 11 aa, Influenza virus
ACWEQLYTPGG

SEQ ID NO: 405582 - protein, 11 aa, Influenza virus
CWEQMYTPGGG

SEQ ID NO: 405583 - protein, 11 aa, Influenza virus
WEQMYTPGGGV

SEQ ID NO: 405584 - protein, 11 aa, Influenza virus
NDDIDQSLIIA

SEQ ID NO: 405585 - protein, 11 aa, Influenza virus
DDIDQSLIIAA

SEQ ID NO: 405586 - protein, 11 aa, Influenza virus
DIDQSLIIAAR

SEQ ID NO: 405587 - protein, 11 aa, Influenza virus
IDQSLIIAARN

SEQ ID NO: 405588 - protein, 11 aa, Influenza virus
DQSLIIAARSI

SEQ ID NO: 405589 - protein, 11 aa, Influenza virus
QSLIIAARSIV

SEQ ID NO: 405590 - protein, 11 aa, Influenza virus
SLIIAARSIVR

SEQ ID NO: 405591 - protein, 11 aa, Influenza virus
LIIAARSIVRR

SEQ ID NO: 405592 - protein, 11 aa, Influenza virus
IIAARSIVRRA

SEQ ID NO: 405593 - protein, 11 aa, Influenza virus
IAARNIVRRAT

SEQ ID NO: 405594 - protein, 11 aa, Influenza virus
AARNIVRRATV

SEQ ID NO: 405595 - protein, 11 aa, Influenza virus
ARNIVRRATVS

SEQ ID NO: 405596 - protein, 11 aa, Influenza virus
RNIVRRATVSA

SEQ ID NO: 405597 - protein, 11 aa, Influenza virus
NIVRRATVSAD

SEQ ID NO: 405598 - protein, 11 aa, Influenza virus
IVRRATVSADP

SEQ ID NO: 405599 - protein, 11 aa, Influenza virus
VRRATVSADPL

SEQ ID NO: 405600 - protein, 11 aa, Influenza virus
RRATVSADPLA

SEQ ID NO: 405601 - protein, 11 aa, Influenza virus
RATVSADPLAS

SEQ ID NO: 405602 - protein, 11 aa, Influenza virus
ATVSADPLASL

SEQ ID NO: 405603 - protein, 11 aa, Influenza virus
VSADPLLSLLE

SEQ ID NO: 405604 - protein, 11 aa, Influenza virus
SADPLLSLLEM

SEQ ID NO: 405605 - protein, 11 aa, Influenza virus
ADPLLSLLEMC

SEQ ID NO: 405606 - protein, 11 aa, Influenza virus
DPLLSLLEMCH

SEQ ID NO: 405607 - protein, 11 aa, Influenza virus
PLLSLLEMCHS

SEQ ID NO: 405608 - protein, 11 aa, Influenza virus
LASLLEMCHGT

SEQ ID NO: 405609 - protein, 11 aa, Influenza virus
ASLLEMCHSTR

SEQ ID NO: 405610 - protein, 11 aa, Influenza virus
SLLEMCHSTRI

SEQ ID NO: 405611 - protein, 11 aa, Influenza virus
LLEMCHSTRIG

SEQ ID NO: 405612 - protein, 11 aa, Influenza virus
LEMCHSTRIGG

SEQ ID NO: 405613 - protein, 11 aa, Influenza virus
DILKQNPTEEQ

SEQ ID NO: 405614 - protein, 11 aa, Influenza virus
ILKQNPTEEQA

SEQ ID NO: 405615 - protein, 11 aa, Influenza virus
LKQNPTEEQAV

SEQ ID NO: 405616 - protein, 11 aa, Influenza virus
QNPTEEQAVGI

SEQ ID NO: 405617 - protein, 11 aa, Influenza virus
NPTEEQAVGIC

SEQ ID NO: 405618 - protein, 11 aa, Influenza virus
PTEEQAVGICK

SEQ ID NO: 405619 - protein, 11 aa, Influenza virus
TEEQAVGICKA

SEQ ID NO: 405620 - protein, 11 aa, Influenza virus
EEQAVGICKAA

SEQ ID NO: 405621 - protein, 11 aa, Influenza virus
EQAVDICKAAI

SEQ ID NO: 405622 - protein, 11 aa, Influenza virus
QAVDICKAAIG

SEQ ID NO: 405623 - protein, 11 aa, Influenza virus
ICKAAIGLRIS

SEQ ID NO: 405624 - protein, 11 aa, Influenza virus
CKAAIGLRISS

SEQ ID NO: 405625 - protein, 11 aa, Influenza virus
KAAIGLRISSS

SEQ ID NO: 405626 - protein, 11 aa, Influenza virus
AAIGLRISSSF

SEQ ID NO: 405627 - protein, 11 aa, Influenza virus
AIGLRISSSFS

SEQ ID NO: 405628 - protein, 11 aa, Influenza virus
IGLRISSSFSF

SEQ ID NO: 405629 - protein, 11 aa, Influenza virus
GLKISSSFSFG

SEQ ID NO: 405630 - protein, 11 aa, Influenza virus
LKISSSFSFGG

SEQ ID NO: 405631 - protein, 11 aa, Influenza virus
KISSSFSFGGF

SEQ ID NO: 405632 - protein, 11 aa, Influenza virus
SFGGFTFKRTK

SEQ ID NO: 405633 - protein, 11 aa, Influenza virus
FGGFTFKRTKG

SEQ ID NO: 405634 - protein, 11 aa, Influenza virus
EEEMLTGNLQT

SEQ ID NO: 405635 - protein, 11 aa, Influenza virus
EEMLTGNLQTL

SEQ ID NO: 405636 - protein, 11 aa, Influenza virus
EVLTGNLQTLR

SEQ ID NO: 405637 - protein, 11 aa, Influenza virus
VVAMVFSQEDC

SEQ ID NO: 405638 - protein, 11 aa, Influenza virus
VAMVFSQEECM

SEQ ID NO: 405639 - protein, 11 aa, Influenza virus
CMVKAVRGDLN

SEQ ID NO: 405640 - protein, 11 aa, Influenza virus
MVKAVRGDLNF

SEQ ID NO: 405641 - protein, 11 aa, Influenza virus
VKAVRGDLNFV

SEQ ID NO: 405642 - protein, 11 aa, Influenza virus
FVNRANQRLNT

SEQ ID NO: 405643 - protein, 11 aa, Influenza virus
VNRANQRLNTM

SEQ ID NO: 405644 - protein, 11 aa, Influenza virus
NRANQRLNTMH

SEQ ID NO: 405645 - protein, 11 aa, Influenza virus
RANQRLNTMHQ

SEQ ID NO: 405646 - protein, 11 aa, Influenza virus
ANQRLNTMHQL

SEQ ID NO: 405647 - protein, 11 aa, Influenza virus
NQRLNTMHQLL

SEQ ID NO: 405648 - protein, 11 aa, Influenza virus
QRLNTMHQLLR

SEQ ID NO: 405649 - protein, 11 aa, Influenza virus
RLNTMHQLLRH

SEQ ID NO: 405650 - protein, 11 aa, Influenza virus
LNTMHQLLRHF

SEQ ID NO: 405651 - protein, 11 aa, Influenza virus
NTMHQLLRHFQ

SEQ ID NO: 405652 - protein, 11 aa, Influenza virus
TMHQLLRHFQK

SEQ ID NO: 405653 - protein, 11 aa, Influenza virus
MHQLLRHFQKN

SEQ ID NO: 405654 - protein, 11 aa, Influenza virus
HQLLRHFQKNA

SEQ ID NO: 405655 - protein, 11 aa, Influenza virus
QLLRHFQKDAR

SEQ ID NO: 405656 - protein, 11 aa, Influenza virus
LLRHFQKDAKI

SEQ ID NO: 405657 - protein, 11 aa, Influenza virus
LRHFQKDAKIL

SEQ ID NO: 405658 - protein, 11 aa, Influenza virus
VNIDRFLRVRD

SEQ ID NO: 405659 - protein, 11 aa, Influenza virus
NIDRFLRVRDQ

SEQ ID NO: 405660 - protein, 11 aa, Influenza virus
DRFLRVRDQQG

SEQ ID NO: 405661 - protein, 11 aa, Influenza virus
GNILLSPEEVS

SEQ ID NO: 405662 - protein, 11 aa, Influenza virus
NILLSPEEVSE

SEQ ID NO: 405663 - protein, 11 aa, Influenza virus
ILLSPEEVSET

SEQ ID NO: 405664 - protein, 11 aa, Influenza virus
LLSPEEVSEAQ

SEQ ID NO: 405665 - protein, 11 aa, Influenza virus
LSPEEVSEAQG

SEQ ID NO: 405666 - protein, 11 aa, Influenza virus
SPEEVSETQGI

SEQ ID NO: 405667 - protein, 11 aa, Influenza virus
PEEVSETQGIE

SEQ ID NO: 405668 - protein, 11 aa, Influenza virus
ERLTITYSSSM

SEQ ID NO: 405669 - protein, 11 aa, Influenza virus
RLTITYSSSMM

SEQ ID NO: 405670 - protein, 11 aa, Influenza virus
LTITYSSSLMW

SEQ ID NO: 405671 - protein, 11 aa, Influenza virus
TITYSSSLMWE

SEQ ID NO: 405672 - protein, 11 aa, Influenza virus
ITYSSSLMWEI

SEQ ID NO: 405673 - protein, 11 aa, Influenza virus
TYSSSLMWEIN

SEQ ID NO: 405674 - protein, 11 aa, Influenza virus
YSSSLMWEING

SEQ ID NO: 405675 - protein, 11 aa, Influenza virus
SSSLMWEINGP

SEQ ID NO: 405676 - protein, 11 aa, Influenza virus
SSLMWEINGPE

SEQ ID NO: 405677 - protein, 11 aa, Influenza virus
SLMWEINGPES

SEQ ID NO: 405678 - protein, 11 aa, Influenza virus
LMWEINGPESV

SEQ ID NO: 405679 - protein, 11 aa, Influenza virus
MWEVNGPESVL

SEQ ID NO: 405680 - protein, 11 aa, Influenza virus
WEINGPESVLI

SEQ ID NO: 405681 - protein, 11 aa, Influenza virus
EINGPESVLIN

SEQ ID NO: 405682 - protein, 11 aa, Influenza virus
INGPESVLINT

SEQ ID NO: 405683 - protein, 11 aa, Influenza virus
NGPESVLINTY

SEQ ID NO: 405684 - protein, 11 aa, Influenza virus
GPESVLINTYQ

SEQ ID NO: 405685 - protein, 11 aa, Influenza virus
PESVLINTYQW

SEQ ID NO: 405686 - protein, 11 aa, Influenza virus
ESVLINTYQWI

SEQ ID NO: 405687 - protein, 11 aa, Influenza virus
SVLINTYQWII

SEQ ID NO: 405688 - protein, 11 aa, Influenza virus
VLINTYQWIIR

SEQ ID NO: 405689 - protein, 11 aa, Influenza virus
LINTYQWIIRN

SEQ ID NO: 405690 - protein, 11 aa, Influenza virus
INTYQWIIRNW

SEQ ID NO: 405691 - protein, 11 aa, Influenza virus
NTYQWVIRNWE

SEQ ID NO: 405692 - protein, 11 aa, Influenza virus
LYNKIEFEPFQ

SEQ ID NO: 405693 - protein, 11 aa, Influenza virus
YNKIEFEPFQS

SEQ ID NO: 405694 - protein, 11 aa, Influenza virus
NKIEFEPFQSL

SEQ ID NO: 405695 - protein, 11 aa, Influenza virus
KIEFEPFQSLV

SEQ ID NO: 405696 - protein, 11 aa, Influenza virus
IEFEPFQSLVP

SEQ ID NO: 405697 - protein, 11 aa, Influenza virus
EFEPFQSLVPR

SEQ ID NO: 405698 - protein, 11 aa, Influenza virus
FEPFQSLVPRA

SEQ ID NO: 405699 - protein, 11 aa, Influenza virus
RYSGFVRTLFQ

SEQ ID NO: 405700 - protein, 11 aa, Influenza virus
VRTLFQQMRDI

SEQ ID NO: 405701 - protein, 11 aa, Influenza virus
RTLFQQMRDIL

SEQ ID NO: 405702 - protein, 11 aa, Influenza virus
TLFQQMRDILG

SEQ ID NO: 405703 - protein, 11 aa, Influenza virus
LFQQMRDILGT

SEQ ID NO: 405704 - protein, 11 aa, Influenza virus
FQQMRDILGTF

SEQ ID NO: 405705 - protein, 11 aa, Influenza virus
QQMRDILGTFD

SEQ ID NO: 405706 - protein, 11 aa, Influenza virus
QMRDILGTFDT

SEQ ID NO: 405707 - protein, 11 aa, Influenza virus
QVIKLLPFAAA

SEQ ID NO: 405708 - protein, 11 aa, Influenza virus
VIKLLPFAAAP

SEQ ID NO: 405709 - protein, 11 aa, Influenza virus
IKLLPFASAPP

SEQ ID NO: 405710 - protein, 11 aa, Influenza virus
KLLPFAAAPPK

SEQ ID NO: 405711 - protein, 11 aa, Influenza virus
LLPFAAAPPKQ

SEQ ID NO: 405712 - protein, 11 aa, Influenza virus
LPFAAAPPKQS

SEQ ID NO: 405713 - protein, 11 aa, Influenza virus
PPKQSRMQFSS

SEQ ID NO: 405714 - protein, 11 aa, Influenza virus
QSKMQFSSLTV

SEQ ID NO: 405715 - protein, 11 aa, Influenza virus
KMQFSSLTVNV

SEQ ID NO: 405716 - protein, 11 aa, Influenza virus
MQFSSLTVSVR

SEQ ID NO: 405717 - protein, 11 aa, Influenza virus
QFSSLTVSVRG

SEQ ID NO: 405718 - protein, 11 aa, Influenza virus
FSSLTVNVRGT

SEQ ID NO: 405719 - protein, 11 aa, Influenza virus
SSLTVNVRGTG

SEQ ID NO: 405720 - protein, 11 aa, Influenza virus
SLTVNVRGSGL

SEQ ID NO: 405721 - protein, 11 aa, Influenza virus
LTVNVRGSGLR

SEQ ID NO: 405722 - protein, 11 aa, Influenza virus
TVNVRGSGLRI

SEQ ID NO: 405723 - protein, 11 aa, Influenza virus
VNVRGSGLRIL

SEQ ID NO: 405724 - protein, 11 aa, Influenza virus
RGSGLRILVRG

SEQ ID NO: 405725 - protein, 11 aa, Influenza virus
GLRILVRGNSP

SEQ ID NO: 405726 - protein, 11 aa, Influenza virus
LIRGNSPVFNY

SEQ ID NO: 405727 - protein, 11 aa, Influenza virus
IRGNSPVFNYN

SEQ ID NO: 405728 - protein, 11 aa, Influenza virus
RGNSPVFNYNR

SEQ ID NO: 405729 - protein, 11 aa, Influenza virus
KRLTILGKDAG

SEQ ID NO: 405730 - protein, 11 aa, Influenza virus
SGVESAVLRGF

SEQ ID NO: 405731 - protein, 11 aa, Influenza virus
ESAVLRGFLII

SEQ ID NO: 405732 - protein, 11 aa, Influenza virus
SAVLRGFLIIG

SEQ ID NO: 405733 - protein, 11 aa, Influenza virus
AVLRGFLIIGK

SEQ ID NO: 405734 - protein, 11 aa, Influenza virus
VLRGFLIIGKE

SEQ ID NO: 405735 - protein, 11 aa, Influenza virus
LRGFLIIGKED

SEQ ID NO: 405736 - protein, 11 aa, Influenza virus
RGFLIIGKEDR

SEQ ID NO: 405737 - protein, 11 aa, Influenza virus
EDRRYGPALSI

SEQ ID NO: 405738 - protein, 11 aa, Influenza virus
RRYGPALSINE

SEQ ID NO: 405739 - protein, 11 aa, Influenza virus
RYGPALSISEL

SEQ ID NO: 405740 - protein, 11 aa, Influenza virus
YGPALSISELS

SEQ ID NO: 405741 - protein, 11 aa, Influenza virus
LTKGEKANVLI

SEQ ID NO: 405742 - protein, 11 aa, Influenza virus
TKGEKANVLIG

SEQ ID NO: 405743 - protein, 11 aa, Influenza virus
RGEKANVLIGQ

SEQ ID NO: 405744 - protein, 11 aa, Influenza virus
KANVLIGQGDI

SEQ ID NO: 405745 - protein, 11 aa, Influenza virus
ANVLIGQGDIV

SEQ ID NO: 405746 - protein, 11 aa, Influenza virus
NVLIGQGDIVL

SEQ ID NO: 405747 - protein, 11 aa, Influenza virus
VLIGQGDIVLV

SEQ ID NO: 405748 - protein, 11 aa, Influenza virus
LIGQGDIVLVM

SEQ ID NO: 405749 - protein, 11 aa, Influenza virus
IGQGDIVLVMK

SEQ ID NO: 405750 - protein, 11 aa, Influenza virus
GQGDIVLVMKR

SEQ ID NO: 405751 - protein, 11 aa, Influenza virus
QGDIVLVMKRK

SEQ ID NO: 405752 - protein, 11 aa, Influenza virus
GDIVLVMKRKR

SEQ ID NO: 405753 - protein, 11 aa, Influenza virus
DIVLVMKRKRD

SEQ ID NO: 405754 - protein, 11 aa, Influenza virus
IVLVMKRKRDS

SEQ ID NO: 405755 - protein, 11 aa, Influenza virus
VLVMKRKRNSS

SEQ ID NO: 405756 - protein, 11 aa, Influenza virus
LVMKRKRNSSI

SEQ ID NO: 405757 - protein, 11 aa, Influenza virus
VMKRKRNSSIL

SEQ ID NO: 405758 - protein, 11 aa, Influenza virus
MKRKRNSSILT

SEQ ID NO: 405759 - protein, 11 aa, Influenza virus
KRKRNSSILTD

SEQ ID NO: 405760 - protein, 11 aa, Influenza virus
RKRNSSILTDS

SEQ ID NO: 405761 - protein, 11 aa, Influenza virus
KRNSSILTDSQ

SEQ ID NO: 405762 - protein, 11 aa, Influenza virus
RNSSILTDSQT

SEQ ID NO: 405763 - protein, 11 aa, Influenza virus
NSSILTDSQTA

SEQ ID NO: 405764 - protein, 11 aa, Influenza virus
LTDSQTATKRL

SEQ ID NO: 405765 - protein, 11 aa, Influenza virus
TDSQTATKRLR

SEQ ID NO: 405766 - protein, 11 aa, Influenza virus
DSQTATKRLRM

SEQ ID NO: 405767 - protein, 11 aa, Influenza virus
SQTATKRLRMA

SEQ ID NO: 405768 - protein, 11 aa, Influenza virus
QTATKRLRMAI

SEQ ID NO: 405769 - protein, 11 aa, Influenza virus
IKRIRMATNEC

SEQ ID NO: 405770 - protein, 11 aa, Influenza virus
KRIRMAINWGR

SEQ ID NO: 405771 - protein, 11 aa, Influenza virus
RIRMAINWGRI

SEQ ID NO: 405772 - protein, 11 aa, Influenza virus
IRMATNECRII

SEQ ID NO: 405773 - protein, 11 aa, Influenza virus
IFNFILLTHWA

SEQ ID NO: 405774 - protein, 11 aa, Influenza virus
FIFLLLTHWAY

SEQ ID NO: 405775 - protein, 11 aa, Influenza virus
DNNKNATNPLT

SEQ ID NO: 405776 - protein, 11 aa, Influenza virus
NNNKGAVFKSN

SEQ ID NO: 405777 - protein, 11 aa, Influenza virus
IHKQLTHHMRK

SEQ ID NO: 405778 - protein, 11 aa, Influenza virus
RKTRGLFGAIA

SEQ ID NO: 405779 - protein, 11 aa, Influenza virus
KTRGLFGAIAG

SEQ ID NO: 405780 - protein, 11 aa, Influenza virus
KRGLFGAIAGF

SEQ ID NO: 405781 - protein, 11 aa, Influenza virus
KGLFGAIAGFI

SEQ ID NO: 405782 - protein, 11 aa, Influenza virus
LFGAIAGFIEN

SEQ ID NO: 405783 - protein, 11 aa, Influenza virus
CILDQNFRNIR

SEQ ID NO: 405784 - protein, 11 aa, Influenza virus
VFREQKQEFKM

SEQ ID NO: 405785 - protein, 11 aa, Influenza virus
SGSQKQEFKMN

SEQ ID NO: 405786 - protein, 11 aa, Influenza virus
QKQEIKMNPNQ

SEQ ID NO: 405787 - protein, 11 aa, Influenza virus
KQEIKMNPNQK

SEQ ID NO: 405788 - protein, 11 aa, Influenza virus
QEIKMNPNQKI

SEQ ID NO: 405789 - protein, 11 aa, Influenza virus
GVKMNPNQKII

SEQ ID NO: 405790 - protein, 11 aa, Influenza virus
KMNPNQKIIII

SEQ ID NO: 405791 - protein, 11 aa, Influenza virus
VMGQASYKIFK

SEQ ID NO: 405792 - protein, 11 aa, Influenza virus
GKRGKWVKSVQ

SEQ ID NO: 405793 - protein, 11 aa, Influenza virus
IQHLEECSCYT

SEQ ID NO: 405794 - protein, 11 aa, Influenza virus
VFREQKQEFKM

SEQ ID NO: 405795 - protein, 11 aa, Influenza virus
SGSQKQEFKMN

SEQ ID NO: 405796 - protein, 11 aa, Influenza virus
QKQEIKMNPNQ

SEQ ID NO: 405797 - protein, 11 aa, Influenza virus
KQEIKMNPNQK

SEQ ID NO: 405798 - protein, 11 aa, Influenza virus
QEIKMNPNQKI

SEQ ID NO: 405799 - protein, 11 aa, Influenza virus
EIKMNPNQKII

SEQ ID NO: 405800 - protein, 11 aa, Influenza virus
FKMNPNQKIIT

SEQ ID NO: 405801 - protein, 11 aa, Influenza virus
KMNPNQKIIII

SEQ ID NO: 405802 - protein, 11 aa, Influenza virus
IRIGSKGDIFV

SEQ ID NO: 405803 - protein, 11 aa, Influenza virus
FVVREPFISCS

SEQ ID NO: 405804 - protein, 11 aa, Influenza virus
MECRTFFLTQG

SEQ ID NO: 405805 - protein, 11 aa, Influenza virus
ECRTFFLTQGS

SEQ ID NO: 405806 - protein, 11 aa, Influenza virus
RTFFLTQGSLL

SEQ ID NO: 405807 - protein, 11 aa, Influenza virus
GSLLNDKHSNG

SEQ ID NO: 405808 - protein, 11 aa, Influenza virus
SLLNDKHSNGT

SEQ ID NO: 405809 - protein, 11 aa, Influenza virus
LLNDRHSNGTV

SEQ ID NO: 405810 - protein, 11 aa, Influenza virus
RSPHRTLMSCP

SEQ ID NO: 405811 - protein, 11 aa, Influenza virus
GEAPSPYNSKF

SEQ ID NO: 405812 - protein, 11 aa, Influenza virus
EAPSPYNSKFE

SEQ ID NO: 405813 - protein, 11 aa, Influenza virus
APSPYNSKFES

SEQ ID NO: 405814 - protein, 11 aa, Influenza virus
AWSASACHDGT

SEQ ID NO: 405815 - protein, 11 aa, Influenza virus
GWLTIGISGPD

SEQ ID NO: 405816 - protein, 11 aa, Influenza virus
TIGISGPDNEA

SEQ ID NO: 405817 - protein, 11 aa, Influenza virus
IGISGPDNEAV

SEQ ID NO: 405818 - protein, 11 aa, Influenza virus
GISGPDNEAVA

SEQ ID NO: 405819 - protein, 11 aa, Influenza virus
ISGPDNEAVAV

SEQ ID NO: 405820 - protein, 11 aa, Influenza virus
SGPDNEAVAVL

SEQ ID NO: 405821 - protein, 11 aa, Influenza virus
GPDNEAVAVLK

SEQ ID NO: 405822 - protein, 11 aa, Influenza virus
PDNEAVAVLKY

SEQ ID NO: 405823 - protein, 11 aa, Influenza virus
IMRTQESECAC

SEQ ID NO: 405824 - protein, 11 aa, Influenza virus
NGSCFTVLTDG

SEQ ID NO: 405825 - protein, 11 aa, Influenza virus
GSCFTVLTDGP

SEQ ID NO: 405826 - protein, 11 aa, Influenza virus
GKRGKWVKSVQ

SEQ ID NO: 405827 - protein, 11 aa, Influenza virus
APNFYYEECSC

SEQ ID NO: 405828 - protein, 11 aa, Influenza virus
PNFYYEECSCY

SEQ ID NO: 405829 - protein, 11 aa, Influenza virus
NFYYEECSCYP

SEQ ID NO: 405830 - protein, 11 aa, Influenza virus
DNWHASNRPWI

SEQ ID NO: 405831 - protein, 11 aa, Influenza virus
NWHASNRPWIS

SEQ ID NO: 405832 - protein, 11 aa, Influenza virus
WHASNRPWISF

SEQ ID NO: 405833 - protein, 11 aa, Influenza virus
GYICSGVFGDS

SEQ ID NO: 405834 - protein, 11 aa, Influenza virus
YICSGVFGDSP

SEQ ID NO: 405835 - protein, 11 aa, Influenza virus
ICSGVFGDSPR

SEQ ID NO: 405836 - protein, 11 aa, Influenza virus
YGDGVWIGRTK

SEQ ID NO: 405837 - protein, 11 aa, Influenza virus
GFEMVWDPNGW

SEQ ID NO: 405838 - protein, 11 aa, Influenza virus
TDWSGYSGSFI

SEQ ID NO: 405839 - protein, 11 aa, Influenza virus
DWSGYSGSFIQ

SEQ ID NO: 405840 - protein, 11 aa, Influenza virus
SFIQHPELTGL

SEQ ID NO: 405841 - protein, 11 aa, Influenza virus
NCIRPCFWVEL

SEQ ID NO: 405842 - protein, 11 aa, Influenza virus
CMRPCFWVELI

SEQ ID NO: 405843 - protein, 11 aa, Influenza virus
MRPCFWVELIR

SEQ ID NO: 405844 - protein, 11 aa, Influenza virus
KPCFWVELIRG

SEQ ID NO: 405845 - protein, 11 aa, Influenza virus
PCFWVELIRGQ

SEQ ID NO: 405846 - protein, 11 aa, Influenza virus
CFWVELIRGQP

SEQ ID NO: 405847 - protein, 11 aa, Influenza virus
TVWTSGSSISF

SEQ ID NO: 405848 - protein, 11 aa, Influenza virus
VWTSGSSISFC

SEQ ID NO: 405849 - protein, 11 aa, Influenza virus
WTSGSIISFCG

SEQ ID NO: 405850 - protein, 11 aa, Influenza virus
TSGSIISFCGV

SEQ ID NO: 405851 - protein, 11 aa, Influenza virus
SGSSISFCGVS

SEQ ID NO: 405852 - protein, 11 aa, Influenza virus
WSWPDGAEVPF

SEQ ID NO: 405853 - protein, 11 aa, Influenza virus
KNNQVILCGPT

SEQ ID NO: 405854 - protein, 11 aa, Influenza virus
KDNSVRLSAGG

SEQ ID NO: 405855 - protein, 11 aa, Influenza virus
IWVTRELYVSC

SEQ ID NO: 405856 - protein, 11 aa, Influenza virus
NCYQFALGQGT

SEQ ID NO: 405857 - protein, 11 aa, Influenza virus
PHRTLLMSELG

SEQ ID NO: 405858 - protein, 11 aa, Influenza virus
HRTLLMSELGV

SEQ ID NO: 405859 - protein, 11 aa, Influenza virus
RTLLMNELGIP

SEQ ID NO: 405860 - protein, 11 aa, Influenza virus
TLLMNELGIPF

SEQ ID NO: 405861 - protein, 11 aa, Influenza virus
LLMNELGIPFH

SEQ ID NO: 405862 - protein, 11 aa, Influenza virus
LMNELGIPFHL

SEQ ID NO: 405863 - protein, 11 aa, Influenza virus
MSELGVPFHLG

SEQ ID NO: 405864 - protein, 11 aa, Influenza virus
SELGVPFHLGT

SEQ ID NO: 405865 - protein, 11 aa, Influenza virus
ELGVPFHLATK

SEQ ID NO: 405866 - protein, 11 aa, Influenza virus
LGVPFHLATKQ

SEQ ID NO: 405867 - protein, 11 aa, Influenza virus
GVPFHLATKQV

SEQ ID NO: 405868 - protein, 11 aa, Influenza virus
VPFHLATKQVC

SEQ ID NO: 405869 - protein, 11 aa, Influenza virus
KQVCMAWSSSS

SEQ ID NO: 405870 - protein, 11 aa, Influenza virus
QVCVAWSSSSC

SEQ ID NO: 405871 - protein, 11 aa, Influenza virus
VCVAWSSSSCH

SEQ ID NO: 405872 - protein, 11 aa, Influenza virus
CVAWSSSSCHD

SEQ ID NO: 405873 - protein, 11 aa, Influenza virus
VAWSSSSCHDG

SEQ ID NO: 405874 - protein, 11 aa, Influenza virus
AWSSSSCYDGK

SEQ ID NO: 405875 - protein, 11 aa, Influenza virus
WSSSSCYDGKA

SEQ ID NO: 405876 - protein, 11 aa, Influenza virus
SSSSCYDGKAW

SEQ ID NO: 405877 - protein, 11 aa, Influenza virus
SSSCYDGKAWL

SEQ ID NO: 405878 - protein, 11 aa, Influenza virus
SSCYDGKAWLH

SEQ ID NO: 405879 - protein, 11 aa, Influenza virus
RTQESECICIN

SEQ ID NO: 405880 - protein, 11 aa, Influenza virus
CTVVMTDGNAS

SEQ ID NO: 405881 - protein, 11 aa, Influenza virus
GNAQHVEECSC

SEQ ID NO: 405882 - protein, 11 aa, Influenza virus
NAQHVEECSCY

SEQ ID NO: 405883 - protein, 11 aa, Influenza virus
QHVEECSCYPQ

SEQ ID NO: 405884 - protein, 11 aa, Influenza virus
VRCVCRDNWRG

SEQ ID NO: 405885 - protein, 11 aa, Influenza virus
RCVCRDNWRGS

SEQ ID NO: 405886 - protein, 11 aa, Influenza virus
CVCRDNWRGSN

SEQ ID NO: 405887 - protein, 11 aa, Influenza virus
VCRDNWRGSNR

SEQ ID NO: 405888 - protein, 11 aa, Influenza virus
RDNWRGSNRPV

SEQ ID NO: 405889 - protein, 11 aa, Influenza virus
YMCSGLVGDTP

SEQ ID NO: 405890 - protein, 11 aa, Influenza virus
MCSGLVGDTPR

SEQ ID NO: 405891 - protein, 11 aa, Influenza virus
CSGLVGDTPRS

SEQ ID NO: 405892 - protein, 11 aa, Influenza virus
RCFYVELVRGR

SEQ ID NO: 405893 - protein, 11 aa, Influenza virus
TSNSIVAFCGT

SEQ ID NO: 405894 - protein, 11 aa, Influenza virus
IAFCGTSGTYG

SEQ ID NO: 405895 - protein, 11 aa, Influenza virus
VFCGTSGTYGS

SEQ ID NO: 405896 - protein, 11 aa, Influenza virus
FCGTSGTYGAG

SEQ ID NO: 405897 - protein, 11 aa, Influenza virus
CGTSGTYGAGS

SEQ ID NO: 405898 - protein, 11 aa, Influenza virus
GTSGTYGAGSW

SEQ ID NO: 405899 - protein, 11 aa, Influenza virus
TSGTYGAGSWP

SEQ ID NO: 405900 - protein, 11 aa, Influenza virus
SGTYGAGSWPD

SEQ ID NO: 405901 - protein, 11 aa, Influenza virus
GTYGAGSWPDG

SEQ ID NO: 405902 - protein, 11 aa, Influenza virus
TYGAGSWPDGA

SEQ ID NO: 405903 - protein, 11 aa, Influenza virus
GADINLMPIYS

SEQ ID NO: 405904 - protein, 11 aa, Influenza virus
ADIKSHAYISF

SEQ ID NO: 405905 - protein, 11 aa, Influenza virus
SISCLYKLSQF

SEQ ID NO: 405906 - protein, 11 aa, Influenza virus
LPLCPFQGFFP

SEQ ID NO: 405907 - protein, 11 aa, Influenza virus
PLCPFQGFFPF

SEQ ID NO: 405908 - protein, 11 aa, Influenza virus
LCPFQGFFPFH

SEQ ID NO: 405909 - protein, 11 aa, Influenza virus
CPFQGFFPFHK

SEQ ID NO: 405910 - protein, 11 aa, Influenza virus
PFQGFFPFHKD

SEQ ID NO: 405911 - protein, 11 aa, Influenza virus
FQGFFPFHKDN

SEQ ID NO: 405912 - protein, 11 aa, Influenza virus
KGFFPFHKDNA

SEQ ID NO: 405913 - protein, 11 aa, Influenza virus
GFFPFHKDNAV

SEQ ID NO: 405914 - protein, 11 aa, Influenza virus
FFPFHKDNAVR

SEQ ID NO: 405915 - protein, 11 aa, Influenza virus
FPFHKDNAVRL

SEQ ID NO: 405916 - protein, 11 aa, Influenza virus
PFHKDNAVRLG

SEQ ID NO: 405917 - protein, 11 aa, Influenza virus
FHKDNAVRLGE

SEQ ID NO: 405918 - protein, 11 aa, Influenza virus
HKDNAVRLGEN

SEQ ID NO: 405919 - protein, 11 aa, Influenza virus
LVTREPYISCD

SEQ ID NO: 405920 - protein, 11 aa, Influenza virus
VTREPYVSCDY

SEQ ID NO: 405921 - protein, 11 aa, Influenza virus
CWSFALAQGVL

SEQ ID NO: 405922 - protein, 11 aa, Influenza virus
WSFALAQGTLL

SEQ ID NO: 405923 - protein, 11 aa, Influenza virus
SFALAQGTLLG

SEQ ID NO: 405924 - protein, 11 aa, Influenza virus
FALAQGTLLGT

SEQ ID NO: 405925 - protein, 11 aa, Influenza virus
DRTSYRSLIRF

SEQ ID NO: 405926 - protein, 11 aa, Influenza virus
RTSYRSLIRFP

SEQ ID NO: 405927 - protein, 11 aa, Influenza virus
CAAWSSSSCFD

SEQ ID NO: 405928 - protein, 11 aa, Influenza virus
AAWSSSSCFDG

SEQ ID NO: 405929 - protein, 11 aa, Influenza virus
WSSTSCFDGKE

SEQ ID NO: 405930 - protein, 11 aa, Influenza virus
SSSCFDGREWM

SEQ ID NO: 405931 - protein, 11 aa, Influenza virus
SSCFDGREWMH

SEQ ID NO: 405932 - protein, 11 aa, Influenza virus
SCFDGREWMHV

SEQ ID NO: 405933 - protein, 11 aa, Influenza virus
CFDGKEWLHVC

SEQ ID NO: 405934 - protein, 11 aa, Influenza virus
NNILRTQESEC

SEQ ID NO: 405935 - protein, 11 aa, Influenza virus
RIQHLEECSCY

SEQ ID NO: 405936 - protein, 11 aa, Influenza virus
IQHLEECSCYT

SEQ ID NO: 405937 - protein, 11 aa, Influenza virus
QHLEECSCYTD

SEQ ID NO: 405938 - protein, 11 aa, Influenza virus
DIYCICRDNWK

SEQ ID NO: 405939 - protein, 11 aa, Influenza virus
IYCICRDNWKG

SEQ ID NO: 405940 - protein, 11 aa, Influenza virus
DNWKGSNRPWI

SEQ ID NO: 405941 - protein, 11 aa, Influenza virus
NWKGSNRPWIR

SEQ ID NO: 405942 - protein, 11 aa, Influenza virus
WKGSNRPWVRI

SEQ ID NO: 405943 - protein, 11 aa, Influenza virus
GSNRPWMRISN

SEQ ID NO: 405944 - protein, 11 aa, Influenza virus
SNRPWMRISNE

SEQ ID NO: 405945 - protein, 11 aa, Influenza virus
NRPWMRISNET

SEQ ID NO: 405946 - protein, 11 aa, Influenza virus
RPWMRISNETI

SEQ ID NO: 405947 - protein, 11 aa, Influenza virus
ISNETILETGY

SEQ ID NO: 405948 - protein, 11 aa, Influenza virus
SNETILETGYV

SEQ ID NO: 405949 - protein, 11 aa, Influenza virus
NETIIETGYVC

SEQ ID NO: 405950 - protein, 11 aa, Influenza virus
ETIIETGYVCS

SEQ ID NO: 405951 - protein, 11 aa, Influenza virus
TIIETGYVCSK

SEQ ID NO: 405952 - protein, 11 aa, Influenza virus
IIETGYVCSKF

SEQ ID NO: 405953 - protein, 11 aa, Influenza virus
IETGYVCSKFH

SEQ ID NO: 405954 - protein, 11 aa, Influenza virus
ETGYVCGKFHS

SEQ ID NO: 405955 - protein, 11 aa, Influenza virus
TGYVCGKFHSD

SEQ ID NO: 405956 - protein, 11 aa, Influenza virus
GYVCGKFHSDT

SEQ ID NO: 405957 - protein, 11 aa, Influenza virus
KFHSDTPRPVD

SEQ ID NO: 405958 - protein, 11 aa, Influenza virus
FHSDTPRPVDP

SEQ ID NO: 405959 - protein, 11 aa, Influenza virus
HSDTPRPVDPS

SEQ ID NO: 405960 - protein, 11 aa, Influenza virus
IQTLVSNNDWS

SEQ ID NO: 405961 - protein, 11 aa, Influenza virus
QTLVANNDWSG

SEQ ID NO: 405962 - protein, 11 aa, Influenza virus
TLVANNDWSGY

SEQ ID NO: 405963 - protein, 11 aa, Influenza virus
ANNDWSGYSGS

SEQ ID NO: 405964 - protein, 11 aa, Influenza virus
SDWSGYSGSFI

SEQ ID NO: 405965 - protein, 11 aa, Influenza virus
DWSGYSGSFVI

SEQ ID NO: 405966 - protein, 11 aa, Influenza virus
GCFQPCFYVEL

SEQ ID NO: 405967 - protein, 11 aa, Influenza virus
CFQPCFYVELT

SEQ ID NO: 405968 - protein, 11 aa, Influenza virus
FQPCFYVELTR

SEQ ID NO: 405969 - protein, 11 aa, Influenza virus
QPCFYVELTRG

SEQ ID NO: 405970 - protein, 11 aa, Influenza virus
PCFYIELIRGK

SEQ ID NO: 405971 - protein, 11 aa, Influenza virus
VSWTSNSMVTF

SEQ ID NO: 405972 - protein, 11 aa, Influenza virus
SWASNSIVTFC

SEQ ID NO: 405973 - protein, 11 aa, Influenza virus
WASNSIVTFCG

SEQ ID NO: 405974 - protein, 11 aa, Influenza virus
TSNSMVTFCGL

SEQ ID NO: 405975 - protein, 11 aa, Influenza virus
SNSMVTFCGLD

SEQ ID NO: 405976 - protein, 11 aa, Influenza virus
NSMVTFCGLDN

SEQ ID NO: 405977 - protein, 11 aa, Influenza virus
SMVTFCGLDNE

SEQ ID NO: 405978 - protein, 11 aa, Influenza virus
MVTFCGLDNEP

SEQ ID NO: 405979 - protein, 11 aa, Influenza virus
VTFCGLDNEPD

SEQ ID NO: 405980 - protein, 11 aa, Influenza virus
FCGLDNEPGSE

SEQ ID NO: 405981 - protein, 11 aa, Influenza virus
LDNEPGSGDWP

SEQ ID NO: 405982 - protein, 11 aa, Influenza virus
DNEPGSGDWPD

SEQ ID NO: 405983 - protein, 11 aa, Influenza virus
EPGSGDWPDGS

SEQ ID NO: 405984 - protein, 11 aa, Influenza virus
WPDGSDIGFMP

SEQ ID NO: 405985 - protein, 11 aa, Influenza virus
PDGSDIGFMPK

SEQ ID NO: 405986 - protein, 11 aa, Influenza virus
MNPNQMIITIG

SEQ ID NO: 405987 - protein, 11 aa, Influenza virus
NPNQMIITIGS

SEQ ID NO: 405988 - protein, 11 aa, Influenza virus
PNQKIITIGSA

SEQ ID NO: 405989 - protein, 11 aa, Influenza virus
LTTVGLLLQII

SEQ ID NO: 405990 - protein, 11 aa, Influenza virus
TTVGLLLQIIS

SEQ ID NO: 405991 - protein, 11 aa, Influenza virus
TVGLLLQIISL

SEQ ID NO: 405992 - protein, 11 aa, Influenza virus
VGLLLQIISLC

SEQ ID NO: 405993 - protein, 11 aa, Influenza virus
GPLLQITSLCS

SEQ ID NO: 405994 - protein, 11 aa, Influenza virus
LLLQVTSLCSI

SEQ ID NO: 405995 - protein, 11 aa, Influenza virus
SIWFSHYNQMK

SEQ ID NO: 405996 - protein, 11 aa, Influenza virus
IWFSHYNQMKQ

SEQ ID NO: 405997 - protein, 11 aa, Influenza virus
WFSHYNQVTQP

SEQ ID NO: 405998 - protein, 11 aa, Influenza virus
TNYYNETFVNM

SEQ ID NO: 405999 - protein, 11 aa, Influenza virus
YYNETFVNITN

SEQ ID NO: 406000 - protein, 11 aa, Influenza virus
YNETFVNMTNV

SEQ ID NO: 406001 - protein, 11 aa, Influenza virus
NETFVNMTNVQ

SEQ ID NO: 406002 - protein, 11 aa, Influenza virus
ETFVNMTNVQN

SEQ ID NO: 406003 - protein, 11 aa, Influenza virus
TFVNVTNVQND

SEQ ID NO: 406004 - protein, 11 aa, Influenza virus
FVNVTNVQNDY

SEQ ID NO: 406005 - protein, 11 aa, Influenza virus
VNVTNVQNDYT

SEQ ID NO: 406006 - protein, 11 aa, Influenza virus
NVTNVQNDYTT

SEQ ID NO: 406007 - protein, 11 aa, Influenza virus
LCPIKGWAPLS

SEQ ID NO: 406008 - protein, 11 aa, Influenza virus
CPIKGWAPLSK

SEQ ID NO: 406009 - protein, 11 aa, Influenza virus
PIKGWAPLSKD

SEQ ID NO: 406010 - protein, 11 aa, Influenza virus
IKGWAPLSKDN

SEQ ID NO: 406011 - protein, 11 aa, Influenza virus
GEVSVIREPFI

SEQ ID NO: 406012 - protein, 11 aa, Influenza virus
EVFVIREPFVS

SEQ ID NO: 406013 - protein, 11 aa, Influenza virus
VFVIREPFVSC

SEQ ID NO: 406014 - protein, 11 aa, Influenza virus
SVIREPFISCS

SEQ ID NO: 406015 - protein, 11 aa, Influenza virus
VIREPFVSCSI

SEQ ID NO: 406016 - protein, 11 aa, Influenza virus
ISCSIDECRTF

SEQ ID NO: 406017 - protein, 11 aa, Influenza virus
SCSIDECRTFF

SEQ ID NO: 406018 - protein, 11 aa, Influenza virus
CSIDECRTFFL

SEQ ID NO: 406019 - protein, 11 aa, Influenza virus
SIDECRTFFLT

SEQ ID NO: 406020 - protein, 11 aa, Influenza virus
IDECRTFFLTQ

SEQ ID NO: 406021 - protein, 11 aa, Influenza virus
DECRTFFLTQG

SEQ ID NO: 406022 - protein, 11 aa, Influenza virus
SPFRTLMSCPV

SEQ ID NO: 406023 - protein, 11 aa, Influenza virus
PFRTLMSCPVG

SEQ ID NO: 406024 - protein, 11 aa, Influenza virus
FRTLMSCPVGV

SEQ ID NO: 406025 - protein, 11 aa, Influenza virus
RTLMSCPVGVA

SEQ ID NO: 406026 - protein, 11 aa, Influenza virus
TLMSCPVGVAP

SEQ ID NO: 406027 - protein, 11 aa, Influenza virus
LMSCPVGVAPS

SEQ ID NO: 406028 - protein, 11 aa, Influenza virus
MSCPVGVAPSP

SEQ ID NO: 406029 - protein, 11 aa, Influenza virus
SCPVGVAPSPS

SEQ ID NO: 406030 - protein, 11 aa, Influenza virus
CPVGVAPSPSN

SEQ ID NO: 406031 - protein, 11 aa, Influenza virus
PVGVAPSPSNS

SEQ ID NO: 406032 - protein, 11 aa, Influenza virus
VGVAPSPSNSR

SEQ ID NO: 406033 - protein, 11 aa, Influenza virus
ACSDGSGWLTL

SEQ ID NO: 406034 - protein, 11 aa, Influenza virus
CSDGSGWLTLG

SEQ ID NO: 406035 - protein, 11 aa, Influenza virus
SDGSGWLTLGI

SEQ ID NO: 406036 - protein, 11 aa, Influenza virus
DGSGWLTLGIT

SEQ ID NO: 406037 - protein, 11 aa, Influenza virus
GSGWLTLGITG

SEQ ID NO: 406038 - protein, 11 aa, Influenza virus
SGWLTLGITGP

SEQ ID NO: 406039 - protein, 11 aa, Influenza virus
WLTLGITGPDT

SEQ ID NO: 406040 - protein, 11 aa, Influenza virus
LTLGITGPDTT

SEQ ID NO: 406041 - protein, 11 aa, Influenza virus
TLGITGPDTTA

SEQ ID NO: 406042 - protein, 11 aa, Influenza virus
LGITGPDTTAV

SEQ ID NO: 406043 - protein, 11 aa, Influenza virus
GITGPDTTAVA

SEQ ID NO: 406044 - protein, 11 aa, Influenza virus
ITGPDTTAVAV

SEQ ID NO: 406045 - protein, 11 aa, Influenza virus
TGPDTTAVAVL

SEQ ID NO: 406046 - protein, 11 aa, Influenza virus
GPDTTAVAVLK

SEQ ID NO: 406047 - protein, 11 aa, Influenza virus
PDTTAVAVLKY

SEQ ID NO: 406048 - protein, 11 aa, Influenza virus
DTTAVAVLKYN

SEQ ID NO: 406049 - protein, 11 aa, Influenza virus
TTAVAVLKYNG

SEQ ID NO: 406050 - protein, 11 aa, Influenza virus
TAVAVLKYNGV

SEQ ID NO: 406051 - protein, 11 aa, Influenza virus
AVAVLKYNGVI

SEQ ID NO: 406052 - protein, 11 aa, Influenza virus
VAVLKYNGVIT

SEQ ID NO: 406053 - protein, 11 aa, Influenza virus
AVLKYNGVITD

SEQ ID NO: 406054 - protein, 11 aa, Influenza virus
VLKYNGVITDT

SEQ ID NO: 406055 - protein, 11 aa, Influenza virus
LKYNGVITDTL

SEQ ID NO: 406056 - protein, 11 aa, Influenza virus
KYNGIITDTFK

SEQ ID NO: 406057 - protein, 11 aa, Influenza virus
YNGIITDTFKS

SEQ ID NO: 406058 - protein, 11 aa, Influenza virus
NGIITDTFKSW

SEQ ID NO: 406059 - protein, 11 aa, Influenza virus
GIITDTFKSWK

SEQ ID NO: 406060 - protein, 11 aa, Influenza virus
IITDTFKSWKG

SEQ ID NO: 406061 - protein, 11 aa, Influenza virus
VCQDEFCYTLV

SEQ ID NO: 406062 - protein, 11 aa, Influenza virus
CQDEFCYTLVT

SEQ ID NO: 406063 - protein, 11 aa, Influenza virus
QDEFCYTLVTD

SEQ ID NO: 406064 - protein, 11 aa, Influenza virus
DEFCYTLVTDG

SEQ ID NO: 406065 - protein, 11 aa, Influenza virus
EFCYTLVTDGP

SEQ ID NO: 406066 - protein, 11 aa, Influenza virus
FCYTLVTDGPS

SEQ ID NO: 406067 - protein, 11 aa, Influenza virus
CYTLITDGPSN

SEQ ID NO: 406068 - protein, 11 aa, Influenza virus
YTLITDGPSNA

SEQ ID NO: 406069 - protein, 11 aa, Influenza virus
TLITDGPSNAQ

SEQ ID NO: 406070 - protein, 11 aa, Influenza virus
LITDGPSNAQA

SEQ ID NO: 406071 - protein, 11 aa, Influenza virus
ITDGPSNAQAF

SEQ ID NO: 406072 - protein, 11 aa, Influenza virus
GPSDGQAFYKI

SEQ ID NO: 406073 - protein, 11 aa, Influenza virus
PSDAQAFYKLL

SEQ ID NO: 406074 - protein, 11 aa, Influenza virus
SDAQAFYKLLK

SEQ ID NO: 406075 - protein, 11 aa, Influenza virus
DAQAFYKLLKI

SEQ ID NO: 406076 - protein, 11 aa, Influenza virus
GQAFYKILKIK

SEQ ID NO: 406077 - protein, 11 aa, Influenza virus
YKILKIKKGKL

SEQ ID NO: 406078 - protein, 11 aa, Influenza virus
KILKIRKGKIM

SEQ ID NO: 406079 - protein, 11 aa, Influenza virus
APGFHFEECSC

SEQ ID NO: 406080 - protein, 11 aa, Influenza virus
PGFHFEECSCY

SEQ ID NO: 406081 - protein, 11 aa, Influenza virus
FEECSCYPSRE

SEQ ID NO: 406082 - protein, 11 aa, Influenza virus
EECSCYPSGES

SEQ ID NO: 406083 - protein, 11 aa, Influenza virus
NRPWIRFNSDP

SEQ ID NO: 406084 - protein, 11 aa, Influenza virus
RPWIRFNSDPD

SEQ ID NO: 406085 - protein, 11 aa, Influenza virus
PWIRFNSDPDY

SEQ ID NO: 406086 - protein, 11 aa, Influenza virus
WVRFNSDLDYQ

SEQ ID NO: 406087 - protein, 11 aa, Influenza virus
VRFNSDLDYQI

SEQ ID NO: 406088 - protein, 11 aa, Influenza virus
RFNSDPDYQIG

SEQ ID NO: 406089 - protein, 11 aa, Influenza virus
FNSDPDYQIGY

SEQ ID NO: 406090 - protein, 11 aa, Influenza virus
NSNLDYQIGYV

SEQ ID NO: 406091 - protein, 11 aa, Influenza virus
SNLDYQIGYVC

SEQ ID NO: 406092 - protein, 11 aa, Influenza virus
NLDYQIGYVCS

SEQ ID NO: 406093 - protein, 11 aa, Influenza virus
PDYQIGYVCSG

SEQ ID NO: 406094 - protein, 11 aa, Influenza virus
DYQIGYICSGV

SEQ ID NO: 406095 - protein, 11 aa, Influenza virus
YQIGYICSGVF

SEQ ID NO: 406096 - protein, 11 aa, Influenza virus
QIGYICSGVFG

SEQ ID NO: 406097 - protein, 11 aa, Influenza virus
IGYICSGVFGD

SEQ ID NO: 406098 - protein, 11 aa, Influenza virus
GYICSGVFGDN

SEQ ID NO: 406099 - protein, 11 aa, Influenza virus
YICSGVFGDNP

SEQ ID NO: 406100 - protein, 11 aa, Influenza virus
ICSGVFGDNPR

SEQ ID NO: 406101 - protein, 11 aa, Influenza virus
CSGIFGDSPRP

SEQ ID NO: 406102 - protein, 11 aa, Influenza virus
SPINNGKGRYG

SEQ ID NO: 406103 - protein, 11 aa, Influenza virus
NLESRSGFEMV

SEQ ID NO: 406104 - protein, 11 aa, Influenza virus
SRSGFEMVWDD

SEQ ID NO: 406105 - protein, 11 aa, Influenza virus
RSGFEMVWDDN

SEQ ID NO: 406106 - protein, 11 aa, Influenza virus
SGFEMVWDDNG

SEQ ID NO: 406107 - protein, 11 aa, Influenza virus
EMVWDDNGWVS

SEQ ID NO: 406108 - protein, 11 aa, Influenza virus
MVWDANGWVTA

SEQ ID NO: 406109 - protein, 11 aa, Influenza virus
VWDDNGWVSTD

SEQ ID NO: 406110 - protein, 11 aa, Influenza virus
DANGWVTADKD

SEQ ID NO: 406111 - protein, 11 aa, Influenza virus
ANGWVSTDKSS

SEQ ID NO: 406112 - protein, 11 aa, Influenza virus
NGWVTADKDSN

SEQ ID NO: 406113 - protein, 11 aa, Influenza virus
GWVTADKDSNG

SEQ ID NO: 406114 - protein, 11 aa, Influenza virus
WVTADKDSNGV

SEQ ID NO: 406115 - protein, 11 aa, Influenza virus
VTADKDSNGVQ

SEQ ID NO: 406116 - protein, 11 aa, Influenza virus
TADKDSNGVQD

SEQ ID NO: 406117 - protein, 11 aa, Influenza virus
ADKDSNGVQDI

SEQ ID NO: 406118 - protein, 11 aa, Influenza virus
RGETTGRNCTI

SEQ ID NO: 406119 - protein, 11 aa, Influenza virus
GETTGRNCTIP

SEQ ID NO: 406120 - protein, 11 aa, Influenza virus
EMIRGQPNERT

SEQ ID NO: 406121 - protein, 11 aa, Influenza virus
MIRGQPNERTI

SEQ ID NO: 406122 - protein, 11 aa, Influenza virus
IRGQPKERTIW

SEQ ID NO: 406123 - protein, 11 aa, Influenza virus
RGQPKERTIWT

SEQ ID NO: 406124 - protein, 11 aa, Influenza virus
GQPNERTIWTS

SEQ ID NO: 406125 - protein, 11 aa, Influenza virus
QPNERTIWTSG

SEQ ID NO: 406126 - protein, 11 aa, Influenza virus
PKERTIWTSGS

SEQ ID NO: 406127 - protein, 11 aa, Influenza virus
NERTIWTSGSS

SEQ ID NO: 406128 - protein, 11 aa, Influenza virus
ERTIWTSGSSI

SEQ ID NO: 406129 - protein, 11 aa, Influenza virus
RTIWTSGSSIA

SEQ ID NO: 406130 - protein, 11 aa, Influenza virus
SSIAFCGVNSN

SEQ ID NO: 406131 - protein, 11 aa, Influenza virus
SIAFCGVNFDL

SEQ ID NO: 406132 - protein, 11 aa, Influenza virus
AFCGVDSDTTS

SEQ ID NO: 406133 - protein, 11 aa, Influenza virus
FCGVDSDTTSW

SEQ ID NO: 406134 - protein, 11 aa, Influenza virus
SDTTGWPWPDG

SEQ ID NO: 406135 - protein, 11 aa, Influenza virus
DTTCWSWPDGA

SEQ ID NO: 406136 - protein, 11 aa, Influenza virus
TTCWSWPDGAL

SEQ ID NO: 406137 - protein, 11 aa, Influenza virus
TGWSWPDGALF

SEQ ID NO: 406138 - protein, 11 aa, Influenza virus
GWSWPDGALFP

SEQ ID NO: 406139 - protein, 11 aa, Influenza virus
WSWPDGALFPL

SEQ ID NO: 406140 - protein, 11 aa, Influenza virus
SWPDGALFPLT

SEQ ID NO: 406141 - protein, 11 aa, Influenza virus
PNQKIITIGSA

SEQ ID NO: 406142 - protein, 11 aa, Influenza virus
NQKIITIGSAS

SEQ ID NO: 406143 - protein, 11 aa, Influenza virus
QKIITIGSASL

SEQ ID NO: 406144 - protein, 11 aa, Influenza virus
KIITIGSASLG

SEQ ID NO: 406145 - protein, 11 aa, Influenza virus
IITIGSASLGL

SEQ ID NO: 406146 - protein, 11 aa, Influenza virus
FLNNTEPLCDV

SEQ ID NO: 406147 - protein, 11 aa, Influenza virus
LNNTEPLCDVS

SEQ ID NO: 406148 - protein, 11 aa, Influenza virus
NNTEPLCDVSG

SEQ ID NO: 406149 - protein, 11 aa, Influenza virus
NTEPLCDVSGF

SEQ ID NO: 406150 - protein, 11 aa, Influenza virus
TEPLCDVSGFA

SEQ ID NO: 406151 - protein, 11 aa, Influenza virus
EPLCDVSGFAI

SEQ ID NO: 406152 - protein, 11 aa, Influenza virus
SGFAIFSKDNG

SEQ ID NO: 406153 - protein, 11 aa, Influenza virus
GFAIISKDNGI

SEQ ID NO: 406154 - protein, 11 aa, Influenza virus
FAIFSKDNGIR

SEQ ID NO: 406155 - protein, 11 aa, Influenza virus
IFSKDNGIRIG

SEQ ID NO: 406156 - protein, 11 aa, Influenza virus
FSKDNGIRIGS

SEQ ID NO: 406157 - protein, 11 aa, Influenza virus
NGIRVGSRGHV

SEQ ID NO: 406158 - protein, 11 aa, Influenza virus
GIRVGSRGHVF

SEQ ID NO: 406159 - protein, 11 aa, Influenza virus
IRVGSRGHVFV

SEQ ID NO: 406160 - protein, 11 aa, Influenza virus
RVGSRGHVFVI

SEQ ID NO: 406161 - protein, 11 aa, Influenza virus
VGSRGHVFVIR

SEQ ID NO: 406162 - protein, 11 aa, Influenza virus
HIFVIREPFVA

SEQ ID NO: 406163 - protein, 11 aa, Influenza virus
IFVIREPFVAC

SEQ ID NO: 406164 - protein, 11 aa, Influenza virus
FVIREPFVACS

SEQ ID NO: 406165 - protein, 11 aa, Influenza virus
VIREPFVACSP

SEQ ID NO: 406166 - protein, 11 aa, Influenza virus
IREPFVSCGPS

SEQ ID NO: 406167 - protein, 11 aa, Influenza virus
REPFVSCGPSE

SEQ ID NO: 406168 - protein, 11 aa, Influenza virus
EPFVSCGPSEC

SEQ ID NO: 406169 - protein, 11 aa, Influenza virus
PFVSCGPSECR

SEQ ID NO: 406170 - protein, 11 aa, Influenza virus
FVSCGPSECRT

SEQ ID NO: 406171 - protein, 11 aa, Influenza virus
VSCGPSECRTF

SEQ ID NO: 406172 - protein, 11 aa, Influenza virus
SCGPSECRTFF

SEQ ID NO: 406173 - protein, 11 aa, Influenza virus
CGPAECRTFFL

SEQ ID NO: 406174 - protein, 11 aa, Influenza virus
GPAECRTFFLT

SEQ ID NO: 406175 - protein, 11 aa, Influenza virus
PAECRTFFLTQ

SEQ ID NO: 406176 - protein, 11 aa, Influenza virus
AECRTFFLTQG

SEQ ID NO: 406177 - protein, 11 aa, Influenza virus
ALMSVPLGSSS

SEQ ID NO: 406178 - protein, 11 aa, Influenza virus
LMSVPLGSSSN

SEQ ID NO: 406179 - protein, 11 aa, Influenza virus
MSVLLGSSPNA

SEQ ID NO: 406180 - protein, 11 aa, Influenza virus
SVPMGSSPNAY

SEQ ID NO: 406181 - protein, 11 aa, Influenza virus
VPMGSSPNAYQ

SEQ ID NO: 406182 - protein, 11 aa, Influenza virus
LLGSSPNAYQA

SEQ ID NO: 406183 - protein, 11 aa, Influenza virus
LGSSSNAYQAK

SEQ ID NO: 406184 - protein, 11 aa, Influenza virus
GSSSNAYQAKF

SEQ ID NO: 406185 - protein, 11 aa, Influenza virus
SSSNAYQAKFE

SEQ ID NO: 406186 - protein, 11 aa, Influenza virus
SPNAYQAQFES

SEQ ID NO: 406187 - protein, 11 aa, Influenza virus
SNAYQAKFESV

SEQ ID NO: 406188 - protein, 11 aa, Influenza virus
FESVEWSATAC

SEQ ID NO: 406189 - protein, 11 aa, Influenza virus
ESIAWSATACH

SEQ ID NO: 406190 - protein, 11 aa, Influenza virus
SVEWSATACHD

SEQ ID NO: 406191 - protein, 11 aa, Influenza virus
VEWSATACHDG

SEQ ID NO: 406192 - protein, 11 aa, Influenza virus
AWSATACHDGR

SEQ ID NO: 406193 - protein, 11 aa, Influenza virus
WSATACHDGKG

SEQ ID NO: 406194 - protein, 11 aa, Influenza virus
SATACHDGKGW

SEQ ID NO: 406195 - protein, 11 aa, Influenza virus
ATACHDGKEWM

SEQ ID NO: 406196 - protein, 11 aa, Influenza virus
GVSGADNDAYA

SEQ ID NO: 406197 - protein, 11 aa, Influenza virus
VSGADNDAYAV

SEQ ID NO: 406198 - protein, 11 aa, Influenza virus
SGADDEAYAVI

SEQ ID NO: 406199 - protein, 11 aa, Influenza virus
GTDDDAYAVIH

SEQ ID NO: 406200 - protein, 11 aa, Influenza virus
ADDEAYAVIHY

SEQ ID NO: 406201 - protein, 11 aa, Influenza virus
DAYAVIHYGGI

SEQ ID NO: 406202 - protein, 11 aa, Influenza virus
AYAVIHYGGIP

SEQ ID NO: 406203 - protein, 11 aa, Influenza virus
YAVIHYGGIPT

SEQ ID NO: 406204 - protein, 11 aa, Influenza virus
AVIHYGGIPTD

SEQ ID NO: 406205 - protein, 11 aa, Influenza virus
VIHYGGIPTDV

SEQ ID NO: 406206 - protein, 11 aa, Influenza virus
IHYGGIPTDVV

SEQ ID NO: 406207 - protein, 11 aa, Influenza virus
HYGGIPTDVVR

SEQ ID NO: 406208 - protein, 11 aa, Influenza virus
YGGIPTDVVRS

SEQ ID NO: 406209 - protein, 11 aa, Influenza virus
GGIPTDVVRSW

SEQ ID NO: 406210 - protein, 11 aa, Influenza virus
PTDVIRSWRKQ

SEQ ID NO: 406211 - protein, 11 aa, Influenza virus
TDVIRSWRKQI

SEQ ID NO: 406212 - protein, 11 aa, Influenza virus
DVIRSWRKQIL

SEQ ID NO: 406213 - protein, 11 aa, Influenza virus
VIRSWRKQILR

SEQ ID NO: 406214 - protein, 11 aa, Influenza virus
IRSWRKQILRT

SEQ ID NO: 406215 - protein, 11 aa, Influenza virus
RSWRKKILRTQ

SEQ ID NO: 406216 - protein, 11 aa, Influenza virus
SWRKKILRTQE

SEQ ID NO: 406217 - protein, 11 aa, Influenza virus
WRKKILRTQES

SEQ ID NO: 406218 - protein, 11 aa, Influenza virus
RKKILRTQESS

SEQ ID NO: 406219 - protein, 11 aa, Influenza virus
RQILRTQESSC

SEQ ID NO: 406220 - protein, 11 aa, Influenza virus
LRTQESSCVCI

SEQ ID NO: 406221 - protein, 11 aa, Influenza virus
RTQESSCVCVK

SEQ ID NO: 406222 - protein, 11 aa, Influenza virus
TQESSCVCVKG

SEQ ID NO: 406223 - protein, 11 aa, Influenza virus
YWVMTDGPANK

SEQ ID NO: 406224 - protein, 11 aa, Influenza virus
WVMTDGPANKQ

SEQ ID NO: 406225 - protein, 11 aa, Influenza virus
VMTDGPANKQA

SEQ ID NO: 406226 - protein, 11 aa, Influenza virus
MTDGPANKQAS

SEQ ID NO: 406227 - protein, 11 aa, Influenza virus
TDGPANKQASY

SEQ ID NO: 406228 - protein, 11 aa, Influenza virus
DGPANKQASYK

SEQ ID NO: 406229 - protein, 11 aa, Influenza virus
GPANKQASYKI

SEQ ID NO: 406230 - protein, 11 aa, Influenza virus
PANKQASYKIF

SEQ ID NO: 406231 - protein, 11 aa, Influenza virus
ANKQASYKIFK

SEQ ID NO: 406232 - protein, 11 aa, Influenza virus
SNQASYKIFKS

SEQ ID NO: 406233 - protein, 11 aa, Influenza virus
EVLFQGGHIEE

SEQ ID NO: 406234 - protein, 11 aa, Influenza virus
VLFQGGHIEEC

SEQ ID NO: 406235 - protein, 11 aa, Influenza virus
SFRGGHIEECS

SEQ ID NO: 406236 - protein, 11 aa, Influenza virus
HIEECSCYPNS

SEQ ID NO: 406237 - protein, 11 aa, Influenza virus
IEECSCYPNSG

SEQ ID NO: 406238 - protein, 11 aa, Influenza virus
EECSCYPNSGK

SEQ ID NO: 406239 - protein, 11 aa, Influenza virus
ECSCYPNSGKV

SEQ ID NO: 406240 - protein, 11 aa, Influenza virus
CSCYPNSGKVE

SEQ ID NO: 406241 - protein, 11 aa, Influenza virus
SCYPNSGKVEC

SEQ ID NO: 406242 - protein, 11 aa, Influenza virus
CYPNSGKVECV

SEQ ID NO: 406243 - protein, 11 aa, Influenza virus
YPNSGKVECVC

SEQ ID NO: 406244 - protein, 11 aa, Influenza virus
PNSGKVECVCR

SEQ ID NO: 406245 - protein, 11 aa, Influenza virus
NSGKVECVCRD

SEQ ID NO: 406246 - protein, 11 aa, Influenza virus
SGKVECVCRDN

SEQ ID NO: 406247 - protein, 11 aa, Influenza virus
CQVECVCRDNW

SEQ ID NO: 406248 - protein, 11 aa, Influenza virus
YDVGYLCAGIP

SEQ ID NO: 406249 - protein, 11 aa, Influenza virus
KVGYLCAGIPT

SEQ ID NO: 406250 - protein, 11 aa, Influenza virus
IPTDTPRIQDS

SEQ ID NO: 406251 - protein, 11 aa, Influenza virus
AVGGSGTDNYG

SEQ ID NO: 406252 - protein, 11 aa, Influenza virus
VGGSGTDNYGV

SEQ ID NO: 406253 - protein, 11 aa, Influenza virus
VKGFAFKQGNS

SEQ ID NO: 406254 - protein, 11 aa, Influenza virus
KGFGFRQGNNV

SEQ ID NO: 406255 - protein, 11 aa, Influenza virus
GFGFRQGNNVW

SEQ ID NO: 406256 - protein, 11 aa, Influenza virus
FAFKQGNSVWA

SEQ ID NO: 406257 - protein, 11 aa, Influenza virus
AFKQGNSVWAG

SEQ ID NO: 406258 - protein, 11 aa, Influenza virus
FRQGNNVWAGR

SEQ ID NO: 406259 - protein, 11 aa, Influenza virus
KQGNSVWAGRT

SEQ ID NO: 406260 - protein, 11 aa, Influenza virus
QGTSVWAGRTI

SEQ ID NO: 406261 - protein, 11 aa, Influenza virus
ASRSGFEVLLI

SEQ ID NO: 406262 - protein, 11 aa, Influenza virus
SRSGFEVLFIE

SEQ ID NO: 406263 - protein, 11 aa, Influenza virus
RSGFEILLIEE

SEQ ID NO: 406264 - protein, 11 aa, Influenza virus
SGFEILLIEEG

SEQ ID NO: 406265 - protein, 11 aa, Influenza virus
GFEILLIEEGW

SEQ ID NO: 406266 - protein, 11 aa, Influenza virus
EVLNNMNWSGY

SEQ ID NO: 406267 - protein, 11 aa, Influenza virus
ILNNKNWSGYS

SEQ ID NO: 406268 - protein, 11 aa, Influenza virus
LNNRNWSGYSG

SEQ ID NO: 406269 - protein, 11 aa, Influenza virus
NNMNWSGYSGS

SEQ ID NO: 406270 - protein, 11 aa, Influenza virus
NMNWSGYSGSF

SEQ ID NO: 406271 - protein, 11 aa, Influenza virus
KHWSGYSGSFT

SEQ ID NO: 406272 - protein, 11 aa, Influenza virus
NWSGYSGAFTV

SEQ ID NO: 406273 - protein, 11 aa, Influenza virus
WSGYSGAFTVP

SEQ ID NO: 406274 - protein, 11 aa, Influenza virus
SGYSGSFTIPT

SEQ ID NO: 406275 - protein, 11 aa, Influenza virus
FWLEMIRGKPK

SEQ ID NO: 406276 - protein, 11 aa, Influenza virus
WLEMIRGKPKE

SEQ ID NO: 406277 - protein, 11 aa, Influenza virus
LEMIRGRPEER

SEQ ID NO: 406278 - protein, 11 aa, Influenza virus
PKERTSIWTSS

SEQ ID NO: 406279 - protein, 11 aa, Influenza virus
KERTSIWTSSS

SEQ ID NO: 406280 - protein, 11 aa, Influenza virus
EKTSIWTSSSS

SEQ ID NO: 406281 - protein, 11 aa, Influenza virus
RNSIWTSSSST

SEQ ID NO: 406282 - protein, 11 aa, Influenza virus
PSIWTSSSSTV

SEQ ID NO: 406283 - protein, 11 aa, Influenza virus
SMVFCGVSGEV

SEQ ID NO: 406284 - protein, 11 aa, Influenza virus
MVFCGVSGEVP

SEQ ID NO: 406285 - protein, 11 aa, Influenza virus
VFCGVSSEAPG

SEQ ID NO: 406286 - protein, 11 aa, Influenza virus
FCGVSSEVPGC

SEQ ID NO: 406287 - protein, 11 aa, Influenza virus
CGVSSEAPGWS

SEQ ID NO: 406288 - protein, 11 aa, Influenza virus
GVSSEAPGWSW

SEQ ID NO: 406289 - protein, 11 aa, Influenza virus
VSSEAPGWSWD

SEQ ID NO: 406290 - protein, 11 aa, Influenza virus
SSEVPEWSWDD

SEQ ID NO: 406291 - protein, 11 aa, Influenza virus
SEVPEWSWDDG

SEQ ID NO: 406292 - protein, 11 aa, Influenza virus
EVPGWSWGDGA

SEQ ID NO: 406293 - protein, 11 aa, Influenza virus
VPEWSWDDGAI

SEQ ID NO: 406294 - protein, 11 aa, Influenza virus
SWDDGAILPLT

SEQ ID NO: 406295 - protein, 11 aa, Influenza virus
WDDGAILPFGI

SEQ ID NO: 406296 - protein, 11 aa, Influenza virus
DDGAILPFGID

SEQ ID NO: 406297 - protein, 11 aa, Influenza virus
MNPNQKIMCIS

SEQ ID NO: 406298 - protein, 11 aa, Influenza virus
NPNQKIMCISA

SEQ ID NO: 406299 - protein, 11 aa, Influenza virus
PNQKIMCISAT

SEQ ID NO: 406300 - protein, 11 aa, Influenza virus
CISTTGMTLSV

SEQ ID NO: 406301 - protein, 11 aa, Influenza virus
KPLCAVNSWHI

SEQ ID NO: 406302 - protein, 11 aa, Influenza virus
PLCAVNSWHIL

SEQ ID NO: 406303 - protein, 11 aa, Influenza virus
LCAVNSWHILS

SEQ ID NO: 406304 - protein, 11 aa, Influenza virus
CAVNSWHILSK

SEQ ID NO: 406305 - protein, 11 aa, Influenza virus
AVNSWHILSKD

SEQ ID NO: 406306 - protein, 11 aa, Influenza virus
VNSWHIFSKDN

SEQ ID NO: 406307 - protein, 11 aa, Influenza virus
NSWHIFSKDNA

SEQ ID NO: 406308 - protein, 11 aa, Influenza virus
SWHILSKDNAV

SEQ ID NO: 406309 - protein, 11 aa, Influenza virus
WHILSKDNAVR

SEQ ID NO: 406310 - protein, 11 aa, Influenza virus
HILSKDNAVRI

SEQ ID NO: 406311 - protein, 11 aa, Influenza virus
SKDNAIRIGEE

SEQ ID NO: 406312 - protein, 11 aa, Influenza virus
KDNAIRIGEEA

SEQ ID NO: 406313 - protein, 11 aa, Influenza virus
DNAIRIGEEAH

SEQ ID NO: 406314 - protein, 11 aa, Influenza virus
EAHILVTREPY

SEQ ID NO: 406315 - protein, 11 aa, Influenza virus
VTREPYLSCEP

SEQ ID NO: 406316 - protein, 11 aa, Influenza virus
ECRIFALSQGT

SEQ ID NO: 406317 - protein, 11 aa, Influenza virus
ALSQGTTLKGR

SEQ ID NO: 406318 - protein, 11 aa, Influenza virus
LSQGTTLKGRH

SEQ ID NO: 406319 - protein, 11 aa, Influenza virus
SQGTTLKGRHA

SEQ ID NO: 406320 - protein, 11 aa, Influenza virus
QGTTLKGRHAN

SEQ ID NO: 406321 - protein, 11 aa, Influenza virus
GTTLKGRHANG

SEQ ID NO: 406322 - protein, 11 aa, Influenza virus
TTLKGRHANGT

SEQ ID NO: 406323 - protein, 11 aa, Influenza virus
TLRGRHANGTM

SEQ ID NO: 406324 - protein, 11 aa, Influenza virus
LRGRHANGTIN

SEQ ID NO: 406325 - protein, 11 aa, Influenza virus
RGRHANGTIND

SEQ ID NO: 406326 - protein, 11 aa, Influenza virus
GRHANGTMHDR

SEQ ID NO: 406327 - protein, 11 aa, Influenza virus
RHANGTMHDRS

SEQ ID NO: 406328 - protein, 11 aa, Influenza virus
HANGTMHDRSP

SEQ ID NO: 406329 - protein, 11 aa, Influenza virus
ANGTIHDRSPY

SEQ ID NO: 406330 - protein, 11 aa, Influenza virus
NGTIHDRSPYR

SEQ ID NO: 406331 - protein, 11 aa, Influenza virus
GTIHDRSPYRA

SEQ ID NO: 406332 - protein, 11 aa, Influenza virus
TIHDRSPYRAL

SEQ ID NO: 406333 - protein, 11 aa, Influenza virus
HDRSQFRALIS

SEQ ID NO: 406334 - protein, 11 aa, Influenza virus
DRSQFRALISW

SEQ ID NO: 406335 - protein, 11 aa, Influenza virus
RSQFRALISWE

SEQ ID NO: 406336 - protein, 11 aa, Influenza virus
SQFRALISWEM

SEQ ID NO: 406337 - protein, 11 aa, Influenza virus
QFRALISWEMG

SEQ ID NO: 406338 - protein, 11 aa, Influenza virus
YRALISWEMGQ

SEQ ID NO: 406339 - protein, 11 aa, Influenza virus
RALISWGMGQA

SEQ ID NO: 406340 - protein, 11 aa, Influenza virus
ALISWGMGQAP

SEQ ID NO: 406341 - protein, 11 aa, Influenza virus
LISWGMGQAPS

SEQ ID NO: 406342 - protein, 11 aa, Influenza virus
ISWGMGQAPSP

SEQ ID NO: 406343 - protein, 11 aa, Influenza virus
SWEMGLAPSPY

SEQ ID NO: 406344 - protein, 11 aa, Influenza virus
WEMGQAPSPYT

SEQ ID NO: 406345 - protein, 11 aa, Influenza virus
IECIGWSSTSC

SEQ ID NO: 406346 - protein, 11 aa, Influenza virus
GWSSTSCHDGV

SEQ ID NO: 406347 - protein, 11 aa, Influenza virus
SSTSCHDGVSR

SEQ ID NO: 406348 - protein, 11 aa, Influenza virus
STSCHDGVSRM

SEQ ID NO: 406349 - protein, 11 aa, Influenza virus
TSCHDGVSRMS

SEQ ID NO: 406350 - protein, 11 aa, Influenza virus
SRMSVCMSGPN

SEQ ID NO: 406351 - protein, 11 aa, Influenza virus
RMSICMSGPND

SEQ ID NO: 406352 - protein, 11 aa, Influenza virus
MSICMSGPNDN

SEQ ID NO: 406353 - protein, 11 aa, Influenza virus
SICMSGPNDNA

SEQ ID NO: 406354 - protein, 11 aa, Influenza virus
ICMSGPNDNAS

SEQ ID NO: 406355 - protein, 11 aa, Influenza virus
CMSGPNDNASA

SEQ ID NO: 406356 - protein, 11 aa, Influenza virus
MSGPNDNASAV

SEQ ID NO: 406357 - protein, 11 aa, Influenza virus
SGPNNNASAVI

SEQ ID NO: 406358 - protein, 11 aa, Influenza virus
GPNNNASAVIW

SEQ ID NO: 406359 - protein, 11 aa, Influenza virus
PNNNASAVIWY

SEQ ID NO: 406360 - protein, 11 aa, Influenza virus
TEIPSWEGNIL

SEQ ID NO: 406361 - protein, 11 aa, Influenza virus
EIPSWEGNILR

SEQ ID NO: 406362 - protein, 11 aa, Influenza virus
IPSWEGNILRT

SEQ ID NO: 406363 - protein, 11 aa, Influenza virus
PSWEGNILRTQ

SEQ ID NO: 406364 - protein, 11 aa, Influenza virus
TWAGNILRTQE

SEQ ID NO: 406365 - protein, 11 aa, Influenza virus
QESECVCHKGV

SEQ ID NO: 406366 - protein, 11 aa, Influenza virus
ESECVCHKGVC

SEQ ID NO: 406367 - protein, 11 aa, Influenza virus
SECVCHKGVCP

SEQ ID NO: 406368 - protein, 11 aa, Influenza virus
ECVCHKGVCPV

SEQ ID NO: 406369 - protein, 11 aa, Influenza virus
CVCHKGVCPVV

SEQ ID NO: 406370 - protein, 11 aa, Influenza virus
VCPVIMTDGPA

SEQ ID NO: 406371 - protein, 11 aa, Influenza virus
CPVIMTDGPAN

SEQ ID NO: 406372 - protein, 11 aa, Influenza virus
GSAEHIEECSC

SEQ ID NO: 406373 - protein, 11 aa, Influenza virus
KAQHIEECSCY

SEQ ID NO: 406374 - protein, 11 aa, Influenza virus
IKCVCRDNWKG

SEQ ID NO: 406375 - protein, 11 aa, Influenza virus
KCICRDNWRGA

SEQ ID NO: 406376 - protein, 11 aa, Influenza virus
CICRDNWRGAN

SEQ ID NO: 406377 - protein, 11 aa, Influenza virus
ICRDNWRGANR

SEQ ID NO: 406378 - protein, 11 aa, Influenza virus
RDNWRGANRPV

SEQ ID NO: 406379 - protein, 11 aa, Influenza virus
DNWRGANRPVI

SEQ ID NO: 406380 - protein, 11 aa, Influenza virus
NWKGANRPIIT

SEQ ID NO: 406381 - protein, 11 aa, Influenza virus
WKGANRPVIII

SEQ ID NO: 406382 - protein, 11 aa, Influenza virus
YLCSRILTDTS

SEQ ID NO: 406383 - protein, 11 aa, Influenza virus
LCSRILTDTSR

SEQ ID NO: 406384 - protein, 11 aa, Influenza virus
CSRILTDTSRP

SEQ ID NO: 406385 - protein, 11 aa, Influenza virus
GGTPDPGVKGF

SEQ ID NO: 406386 - protein, 11 aa, Influenza virus
GNPDPGVKGFA

SEQ ID NO: 406387 - protein, 11 aa, Influenza virus
NPDPGVKGFAF

SEQ ID NO: 406388 - protein, 11 aa, Influenza virus
DPGIKGFAFLD

SEQ ID NO: 406389 - protein, 11 aa, Influenza virus
PGVKGFAFLDE

SEQ ID NO: 406390 - protein, 11 aa, Influenza virus
SWLGRTISKDL

SEQ ID NO: 406391 - protein, 11 aa, Influenza virus
WLGRTISKDLR

SEQ ID NO: 406392 - protein, 11 aa, Influenza virus
LGRTISKDLRS

SEQ ID NO: 406393 - protein, 11 aa, Influenza virus
GRTISKDLRSG

SEQ ID NO: 406394 - protein, 11 aa, Influenza virus
RTISKDLRSGY

SEQ ID NO: 406395 - protein, 11 aa, Influenza virus
TISKDLRSGYE

SEQ ID NO: 406396 - protein, 11 aa, Influenza virus
DSRSGYEILKV

SEQ ID NO: 406397 - protein, 11 aa, Influenza virus
SRSGYEILKVP

SEQ ID NO: 406398 - protein, 11 aa, Influenza virus
RSGYEILKVPN

SEQ ID NO: 406399 - protein, 11 aa, Influenza virus
SGYEILKVPNA

SEQ ID NO: 406400 - protein, 11 aa, Influenza virus
GYEILKVPNAE

SEQ ID NO: 406401 - protein, 11 aa, Influenza virus
IINNQNWSGYS

SEQ ID NO: 406402 - protein, 11 aa, Influenza virus
INNQNWSGYSG

SEQ ID NO: 406403 - protein, 11 aa, Influenza virus
NNQDWSGYSGA

SEQ ID NO: 406404 - protein, 11 aa, Influenza virus
NQDWSGYSGAF

SEQ ID NO: 406405 - protein, 11 aa, Influenza virus
WSGYSGAFMDY

SEQ ID NO: 406406 - protein, 11 aa, Influenza virus
SGYSGAFMDYW

SEQ ID NO: 406407 - protein, 11 aa, Influenza virus
KKCFNPCFYVE

SEQ ID NO: 406408 - protein, 11 aa, Influenza virus
FYVELIRGRPR

SEQ ID NO: 406409 - protein, 11 aa, Influenza virus
YVELIRGRPRE

SEQ ID NO: 406410 - protein, 11 aa, Influenza virus
VWWTSNSIVAL

SEQ ID NO: 406411 - protein, 11 aa, Influenza virus
WWTSNSIVALC

SEQ ID NO: 406412 - protein, 11 aa, Influenza virus
NSIVALCGSKK

SEQ ID NO: 406413 - protein, 11 aa, Influenza virus
SIVALCGSKEQ

SEQ ID NO: 406414 - protein, 11 aa, Influenza virus
IVALCGSKEQL

SEQ ID NO: 406415 - protein, 11 aa, Influenza virus
VALCGSKEQLG

SEQ ID NO: 406416 - protein, 11 aa, Influenza virus
ALCGSKEQLGS

SEQ ID NO: 406417 - protein, 11 aa, Influenza virus
LCGSKEQLGSW

SEQ ID NO: 406418 - protein, 11 aa, Influenza virus
CGSKEQLGSWS

SEQ ID NO: 406419 - protein, 11 aa, Influenza virus
GSKEQLGSWSW

SEQ ID NO: 406420 - protein, 11 aa, Influenza virus
SKEQLGSWSWH

SEQ ID NO: 406421 - protein, 11 aa, Influenza virus
KEQLGSWSWHD

SEQ ID NO: 406422 - protein, 11 aa, Influenza virus
KRLGSWSWHDG

SEQ ID NO: 406423 - protein, 11 aa, Influenza virus
WHDGAEIIYFE

SEQ ID NO: 406424 - protein, 11 aa, Influenza virus
MNPNQKLFTLS

SEQ ID NO: 406425 - protein, 11 aa, Influenza virus
NPNQKLFTLSG

SEQ ID NO: 406426 - protein, 11 aa, Influenza virus
PNQKLFTLSGV

SEQ ID NO: 406427 - protein, 11 aa, Influenza virus
NQKLFTLSGVA

SEQ ID NO: 406428 - protein, 11 aa, Influenza virus
QKLFTLSGVAI

SEQ ID NO: 406429 - protein, 11 aa, Influenza virus
NLLIGISNMSL

SEQ ID NO: 406430 - protein, 11 aa, Influenza virus
LLIGISNMSLN

SEQ ID NO: 406431 - protein, 11 aa, Influenza virus
SNVVLNVSLHL

SEQ ID NO: 406432 - protein, 11 aa, Influenza virus
KNTYVNNTTII

SEQ ID NO: 406433 - protein, 11 aa, Influenza virus
YLVLNKSLCKV

SEQ ID NO: 406434 - protein, 11 aa, Influenza virus
WVVIAKDNAIR

SEQ ID NO: 406435 - protein, 11 aa, Influenza virus
VVIAKDNAIRF

SEQ ID NO: 406436 - protein, 11 aa, Influenza virus
VIAKDNAIRFG

SEQ ID NO: 406437 - protein, 11 aa, Influenza virus
IAKDNAIRFGE

SEQ ID NO: 406438 - protein, 11 aa, Influenza virus
AKDNAIRFGEG

SEQ ID NO: 406439 - protein, 11 aa, Influenza virus
KDNAIRFGEGE

SEQ ID NO: 406440 - protein, 11 aa, Influenza virus
NAIRFGESEQV

SEQ ID NO: 406441 - protein, 11 aa, Influenza virus
AIRFGESEQVI

SEQ ID NO: 406442 - protein, 11 aa, Influenza virus
IRFGESEQVIV

SEQ ID NO: 406443 - protein, 11 aa, Influenza virus
RFGEGEQIIVT

SEQ ID NO: 406444 - protein, 11 aa, Influenza virus
FGEGEQIIVTR

SEQ ID NO: 406445 - protein, 11 aa, Influenza virus
GEGEQIIVTRE

SEQ ID NO: 406446 - protein, 11 aa, Influenza virus
EGEQIIVTREP

SEQ ID NO: 406447 - protein, 11 aa, Influenza virus
GEQIIVTREPY

SEQ ID NO: 406448 - protein, 11 aa, Influenza virus
TREPYVSCDPS

SEQ ID NO: 406449 - protein, 11 aa, Influenza virus
SCKMYALHQGT

SEQ ID NO: 406450 - protein, 11 aa, Influenza virus
GTTIRNRHSNG

SEQ ID NO: 406451 - protein, 11 aa, Influenza virus
TTIRNRHSNGT

SEQ ID NO: 406452 - protein, 11 aa, Influenza virus
TIRNKHSNGTT

SEQ ID NO: 406453 - protein, 11 aa, Influenza virus
IRNKHSNGTTH

SEQ ID NO: 406454 - protein, 11 aa, Influenza virus
RNKHSNGTTHD

SEQ ID NO: 406455 - protein, 11 aa, Influenza virus
NKHSNGTTHDR

SEQ ID NO: 406456 - protein, 11 aa, Influenza virus
TIHDRTTFRGL

SEQ ID NO: 406457 - protein, 11 aa, Influenza virus
DRTTFRGLLST

SEQ ID NO: 406458 - protein, 11 aa, Influenza virus
AFRGLISTHLG

SEQ ID NO: 406459 - protein, 11 aa, Influenza virus
SNSDFICVGWS

SEQ ID NO: 406460 - protein, 11 aa, Influenza virus
NSDFICVGWSS

SEQ ID NO: 406461 - protein, 11 aa, Influenza virus
SDFICVGWSST

SEQ ID NO: 406462 - protein, 11 aa, Influenza virus
FICVGWSSTSC

SEQ ID NO: 406463 - protein, 11 aa, Influenza virus
ICVGWSSTSCH

SEQ ID NO: 406464 - protein, 11 aa, Influenza virus
GWSSTSCHDGV

SEQ ID NO: 406465 - protein, 11 aa, Influenza virus
CHDGIARMTIC

SEQ ID NO: 406466 - protein, 11 aa, Influenza virus
QGDNENATATV

SEQ ID NO: 406467 - protein, 11 aa, Influenza virus
GDNENATATVY

SEQ ID NO: 406468 - protein, 11 aa, Influenza virus
DNENATATVYY

SEQ ID NO: 406469 - protein, 11 aa, Influenza virus
NNNATATVYYD

SEQ ID NO: 406470 - protein, 11 aa, Influenza virus
NATATVYYNKR

SEQ ID NO: 406471 - protein, 11 aa, Influenza virus
ATATVYYNKRL

SEQ ID NO: 406472 - protein, 11 aa, Influenza virus
TATVYYNKRLT

SEQ ID NO: 406473 - protein, 11 aa, Influenza virus
ATVYYNKRLTT

SEQ ID NO: 406474 - protein, 11 aa, Influenza virus
TVYYNKRLTTT

SEQ ID NO: 406475 - protein, 11 aa, Influenza virus
VYYNKRLTTTI

SEQ ID NO: 406476 - protein, 11 aa, Influenza virus
GRLTTTIKTWA

SEQ ID NO: 406477 - protein, 11 aa, Influenza virus
RLTTTIKTWAK

SEQ ID NO: 406478 - protein, 11 aa, Influenza virus
TTTIKTWAKNI

SEQ ID NO: 406479 - protein, 11 aa, Influenza virus
TTIKTWAKNIL

SEQ ID NO: 406480 - protein, 11 aa, Influenza virus
TIKTWAKNILR

SEQ ID NO: 406481 - protein, 11 aa, Influenza virus
IKTWAKNILRT

SEQ ID NO: 406482 - protein, 11 aa, Influenza virus
KTWAKNILRTQ

SEQ ID NO: 406483 - protein, 11 aa, Influenza virus
TWAKNILRTQE

SEQ ID NO: 406484 - protein, 11 aa, Influenza virus
WAKNILRTQES

SEQ ID NO: 406485 - protein, 11 aa, Influenza virus
AKNILRTQESE

SEQ ID NO: 406486 - protein, 11 aa, Influenza virus
KNILRTQESEC

SEQ ID NO: 406487 - protein, 11 aa, Influenza virus
TQDSECVSHNG

SEQ ID NO: 406488 - protein, 11 aa, Influenza virus
QESECVRHNGT

SEQ ID NO: 406489 - protein, 11 aa, Influenza virus
ESECVRHNGTC

SEQ ID NO: 406490 - protein, 11 aa, Influenza virus
SECVCHNSTCV

SEQ ID NO: 406491 - protein, 11 aa, Influenza virus
LRGSARHIEEC

SEQ ID NO: 406492 - protein, 11 aa, Influenza virus
GSARHIEECPC

SEQ ID NO: 406493 - protein, 11 aa, Influenza virus
SARHVEECSCY

SEQ ID NO: 406494 - protein, 11 aa, Influenza virus
ARHIEEWSCYG

SEQ ID NO: 406495 - protein, 11 aa, Influenza virus
RHIEECPCYGH

SEQ ID NO: 406496 - protein, 11 aa, Influenza virus
HIEECSCYGHD

SEQ ID NO: 406497 - protein, 11 aa, Influenza virus
ITCVCRDNWQG

SEQ ID NO: 406498 - protein, 11 aa, Influenza virus
TCVCRDNWRGA

SEQ ID NO: 406499 - protein, 11 aa, Influenza virus
NWQGANRPVIK

SEQ ID NO: 406500 - protein, 11 aa, Influenza virus
WQGANRPVIKI

SEQ ID NO: 406501 - protein, 11 aa, Influenza virus
QGANRPVIKID

SEQ ID NO: 406502 - protein, 11 aa, Influenza virus
GANRPVIKIDM

SEQ ID NO: 406503 - protein, 11 aa, Influenza virus
TGVLTDTSRPK

SEQ ID NO: 406504 - protein, 11 aa, Influenza virus
GVLTDTSRPKD

SEQ ID NO: 406505 - protein, 11 aa, Influenza virus
GECFNPITGSP

SEQ ID NO: 406506 - protein, 11 aa, Influenza virus
ECFNPITGSPG

SEQ ID NO: 406507 - protein, 11 aa, Influenza virus
NPITGSPGVPG

SEQ ID NO: 406508 - protein, 11 aa, Influenza virus
APGIKGFGFLN

SEQ ID NO: 406509 - protein, 11 aa, Influenza virus
NTWLGRTISTR

SEQ ID NO: 406510 - protein, 11 aa, Influenza virus
TWLGRTISPRL

SEQ ID NO: 406511 - protein, 11 aa, Influenza virus
WLGRTISPKLR

SEQ ID NO: 406512 - protein, 11 aa, Influenza virus
TISPKLRSGFE

SEQ ID NO: 406513 - protein, 11 aa, Influenza virus
SPKLRSGFEML

SEQ ID NO: 406514 - protein, 11 aa, Influenza virus
SRSGFEMLKVP

SEQ ID NO: 406515 - protein, 11 aa, Influenza virus
RSGFEMLKIHN

SEQ ID NO: 406516 - protein, 11 aa, Influenza virus
SGFEMLRIPNA

SEQ ID NO: 406517 - protein, 11 aa, Influenza virus
GFEMLKVPNAE

SEQ ID NO: 406518 - protein, 11 aa, Influenza virus
KWSGYSGSFID

SEQ ID NO: 406519 - protein, 11 aa, Influenza virus
YSGSFIDYWDD

SEQ ID NO: 406520 - protein, 11 aa, Influenza virus
SVCYNPCFYVE

SEQ ID NO: 406521 - protein, 11 aa, Influenza virus
KCYNPCFYVEL

SEQ ID NO: 406522 - protein, 11 aa, Influenza virus
RGRPEEVKYVW

SEQ ID NO: 406523 - protein, 11 aa, Influenza virus
GRPEEVKYVWW

SEQ ID NO: 406524 - protein, 11 aa, Influenza virus
RPEEAKYVWWA

SEQ ID NO: 406525 - protein, 11 aa, Influenza virus
PEEAKYVWWAS

SEQ ID NO: 406526 - protein, 11 aa, Influenza virus
EEAKYVWWASN

SEQ ID NO: 406527 - protein, 11 aa, Influenza virus
EAKYVWWASNS

SEQ ID NO: 406528 - protein, 11 aa, Influenza virus
AKYVWWASNSL

SEQ ID NO: 406529 - protein, 11 aa, Influenza virus
KYVEWTSNSLI

SEQ ID NO: 406530 - protein, 11 aa, Influenza virus
YVEWTSNSLIA

SEQ ID NO: 406531 - protein, 11 aa, Influenza virus
VEWTSNSLIAL

SEQ ID NO: 406532 - protein, 11 aa, Influenza virus
EWTSNSLIALC

SEQ ID NO: 406533 - protein, 11 aa, Influenza virus
WASNSLIALCG

SEQ ID NO: 406534 - protein, 11 aa, Influenza virus
ASNSLIALCGS

SEQ ID NO: 406535 - protein, 11 aa, Influenza virus
NSLIALCGSPF

SEQ ID NO: 406536 - protein, 11 aa, Influenza virus
PVGPGSFPDGA

SEQ ID NO: 406537 - protein, 11 aa, Influenza virus
IGSGFFPDGPQ

SEQ ID NO: 406538 - protein, 11 aa, Influenza virus
GSGSFPDGAKI

SEQ ID NO: 406539 - protein, 11 aa, Influenza virus
GFFPDGPQIQY

SEQ ID NO: 406540 - protein, 11 aa, Influenza virus
SFPNGAQIQYF

SEQ ID NO: 406541 - protein, 11 aa, Influenza virus
FPDGAKIQYFS

SEQ ID NO: 406542 - protein, 11 aa, Influenza virus
RGFAPFSKDNG

SEQ ID NO: 406543 - protein, 11 aa, Influenza virus
NGIRIGSKGHV

SEQ ID NO: 406544 - protein, 11 aa, Influenza virus
GIRIGSKGHVF

SEQ ID NO: 406545 - protein, 11 aa, Influenza virus
IRIGSKGHVFV

SEQ ID NO: 406546 - protein, 11 aa, Influenza virus
RIGSKGHVFVI

SEQ ID NO: 406547 - protein, 11 aa, Influenza virus
IGSKGHVFVIR

SEQ ID NO: 406548 - protein, 11 aa, Influenza virus
GSKGHVFVIRE

SEQ ID NO: 406549 - protein, 11 aa, Influenza virus
SKGHVFVIREP

SEQ ID NO: 406550 - protein, 11 aa, Influenza virus
KGHVFVIREPF

SEQ ID NO: 406551 - protein, 11 aa, Influenza virus
GHVFIIREPFV

SEQ ID NO: 406552 - protein, 11 aa, Influenza virus
HVFIIREPFVS

SEQ ID NO: 406553 - protein, 11 aa, Influenza virus
VFIIREPFVSC

SEQ ID NO: 406554 - protein, 11 aa, Influenza virus
FVIREPFISCS

SEQ ID NO: 406555 - protein, 11 aa, Influenza virus
VIREPFISCSP

SEQ ID NO: 406556 - protein, 11 aa, Influenza virus
ECRTFFLTHGS

SEQ ID NO: 406557 - protein, 11 aa, Influenza virus
RTFFITQGSLL

SEQ ID NO: 406558 - protein, 11 aa, Influenza virus
TFFITQGSLLN

SEQ ID NO: 406559 - protein, 11 aa, Influenza virus
FFLTQGSLVND

SEQ ID NO: 406560 - protein, 11 aa, Influenza virus
FLTHGSLLNDK

SEQ ID NO: 406561 - protein, 11 aa, Influenza virus
LTHGSLLNDKH

SEQ ID NO: 406562 - protein, 11 aa, Influenza virus
THGSLLNDKHS

SEQ ID NO: 406563 - protein, 11 aa, Influenza virus
HGSLLNDKHSN

SEQ ID NO: 406564 - protein, 11 aa, Influenza virus
GSLLNDKHFNG

SEQ ID NO: 406565 - protein, 11 aa, Influenza virus
SLLNDKHSSGT

SEQ ID NO: 406566 - protein, 11 aa, Influenza virus
NDRHSNGTVKD

SEQ ID NO: 406567 - protein, 11 aa, Influenza virus
DRHSNGTVKDR

SEQ ID NO: 406568 - protein, 11 aa, Influenza virus
RHSNGTVKDRS

SEQ ID NO: 406569 - protein, 11 aa, Influenza virus
HSNGTMKDRSP

SEQ ID NO: 406570 - protein, 11 aa, Influenza virus
SNGTIKDRSPY

SEQ ID NO: 406571 - protein, 11 aa, Influenza virus
NGTIKDRSPYR

SEQ ID NO: 406572 - protein, 11 aa, Influenza virus
GTIKDRSPYRT

SEQ ID NO: 406573 - protein, 11 aa, Influenza virus
TIKDRSPYRTL

SEQ ID NO: 406574 - protein, 11 aa, Influenza virus
IKDRSPYRTLM

SEQ ID NO: 406575 - protein, 11 aa, Influenza virus
RSPFRTLMSVE

SEQ ID NO: 406576 - protein, 11 aa, Influenza virus
GQSPNVYQSRF

SEQ ID NO: 406577 - protein, 11 aa, Influenza virus
QSPNVYQSRFE

SEQ ID NO: 406578 - protein, 11 aa, Influenza virus
VYQAKFESVAW

SEQ ID NO: 406579 - protein, 11 aa, Influenza virus
YQAKFESVAWS

SEQ ID NO: 406580 - protein, 11 aa, Influenza virus
QAKFESVAWSA

SEQ ID NO: 406581 - protein, 11 aa, Influenza virus
AKFESVAWSAT

SEQ ID NO: 406582 - protein, 11 aa, Influenza virus
KFESVAWSATA

SEQ ID NO: 406583 - protein, 11 aa, Influenza virus
AIAWSATACHD

SEQ ID NO: 406584 - protein, 11 aa, Influenza virus
ATACHDGKKWT

SEQ ID NO: 406585 - protein, 11 aa, Influenza virus
GDIMRTQESSC

SEQ ID NO: 406586 - protein, 11 aa, Influenza virus
DIMRTQESSCT

SEQ ID NO: 406587 - protein, 11 aa, Influenza virus
ILRTQESSCSC

SEQ ID NO: 406588 - protein, 11 aa, Influenza virus
RTQESSCTCIR

SEQ ID NO: 406589 - protein, 11 aa, Influenza virus
TQESSCTCIRG

SEQ ID NO: 406590 - protein, 11 aa, Influenza virus
GECFWVMTDGP

SEQ ID NO: 406591 - protein, 11 aa, Influenza virus
ECFWVMTDGPA

SEQ ID NO: 406592 - protein, 11 aa, Influenza virus
WVMTDGPANSQ

SEQ ID NO: 406593 - protein, 11 aa, Influenza virus
VMTDGPANSQA

SEQ ID NO: 406594 - protein, 11 aa, Influenza virus
FDGGHIEECSC

SEQ ID NO: 406595 - protein, 11 aa, Influenza virus
DGGHIEECSCY

SEQ ID NO: 406596 - protein, 11 aa, Influenza virus
IEECSCYPNNG

SEQ ID NO: 406597 - protein, 11 aa, Influenza virus
ECSCYPNNGKV

SEQ ID NO: 406598 - protein, 11 aa, Influenza virus
CSCYPNNGKVE

SEQ ID NO: 406599 - protein, 11 aa, Influenza virus
SCYPNNGKVEC

SEQ ID NO: 406600 - protein, 11 aa, Influenza virus
CYPNDGKVECV

SEQ ID NO: 406601 - protein, 11 aa, Influenza virus
YPNDGKVECVC

SEQ ID NO: 406602 - protein, 11 aa, Influenza virus
PNDGKVECVCR

SEQ ID NO: 406603 - protein, 11 aa, Influenza virus
NDGKVECVCRD

SEQ ID NO: 406604 - protein, 11 aa, Influenza virus
DGKVECVCRDN

SEQ ID NO: 406605 - protein, 11 aa, Influenza virus
NWTGTNRPVLI

SEQ ID NO: 406606 - protein, 11 aa, Influenza virus
WTGTNRPVLII

SEQ ID NO: 406607 - protein, 11 aa, Influenza virus
LSYKVGYLCAG

SEQ ID NO: 406608 - protein, 11 aa, Influenza virus
VGYLCAGIPSD

SEQ ID NO: 406609 - protein, 11 aa, Influenza virus
GYLCAGIPSDT

SEQ ID NO: 406610 - protein, 11 aa, Influenza virus
YLCAGIPSDTP

SEQ ID NO: 406611 - protein, 11 aa, Influenza virus
LCAGIPSDTPR

SEQ ID NO: 406612 - protein, 11 aa, Influenza virus
CAGIPSDTPRG

SEQ ID NO: 406613 - protein, 11 aa, Influenza virus
AGIPSDTPRGE

SEQ ID NO: 406614 - protein, 11 aa, Influenza virus
GIPSDTPRGED

SEQ ID NO: 406615 - protein, 11 aa, Influenza virus
PSDTPRGEDAQ

SEQ ID NO: 406616 - protein, 11 aa, Influenza virus
SDTPRGEDAQF

SEQ ID NO: 406617 - protein, 11 aa, Influenza virus
LGYGVKGFGFR

SEQ ID NO: 406618 - protein, 11 aa, Influenza virus
GVKGFGFRQGD

SEQ ID NO: 406619 - protein, 11 aa, Influenza virus
VKGFGFRQGDD

SEQ ID NO: 406620 - protein, 11 aa, Influenza virus
KGFGFRQGDDV

SEQ ID NO: 406621 - protein, 11 aa, Influenza virus
GFGFRQGDDVW

SEQ ID NO: 406622 - protein, 11 aa, Influenza virus
DNSNWSGYSGS

SEQ ID NO: 406623 - protein, 11 aa, Influenza virus
NSNWSGYSGSF

SEQ ID NO: 406624 - protein, 11 aa, Influenza virus
SNWSGYSGSFT

SEQ ID NO: 406625 - protein, 11 aa, Influenza virus
GYSGSFTLPVG

SEQ ID NO: 406626 - protein, 11 aa, Influenza virus
YSGSFTLPVEM

SEQ ID NO: 406627 - protein, 11 aa, Influenza virus
PCFWVEMIRGR

SEQ ID NO: 406628 - protein, 11 aa, Influenza virus
CFWVEMIRGRP

SEQ ID NO: 406629 - protein, 11 aa, Influenza virus
FWVEMIRGEPE

SEQ ID NO: 406630 - protein, 11 aa, Influenza virus
WVEMIRGEPEE

SEQ ID NO: 406631 - protein, 11 aa, Influenza virus
TVWTSSSSIVM

SEQ ID NO: 406632 - protein, 11 aa, Influenza virus
SSSSIVMCGVN

SEQ ID NO: 406633 - protein, 11 aa, Influenza virus
SSSVVMCGVDH

SEQ ID NO: 406634 - protein, 11 aa, Influenza virus
DWSWHDGAVLP

SEQ ID NO: 406635 - protein, 11 aa, Influenza virus
WSWHDGAILPL

SEQ ID NO: 406636 - protein, 11 aa, Influenza virus
MNPNQKILFAS

SEQ ID NO: 406637 - protein, 11 aa, Influenza virus
NPNQKILFASA

SEQ ID NO: 406638 - protein, 11 aa, Influenza virus
PNQKILFASAT

SEQ ID NO: 406639 - protein, 11 aa, Influenza virus
NQKILCTSAIA

SEQ ID NO: 406640 - protein, 11 aa, Influenza virus
QKILCTSAIAI

SEQ ID NO: 406641 - protein, 11 aa, Influenza virus
ANLGLNVGLHL

SEQ ID NO: 406642 - protein, 11 aa, Influenza virus
NLGLNVGLHLK

SEQ ID NO: 406643 - protein, 11 aa, Influenza virus
LGLNVGLHLKP

SEQ ID NO: 406644 - protein, 11 aa, Influenza virus
FNNLTRGLCTI

SEQ ID NO: 406645 - protein, 11 aa, Influenza virus
NNLTRGLCTIN

SEQ ID NO: 406646 - protein, 11 aa, Influenza virus
NLTRGLCTINS

SEQ ID NO: 406647 - protein, 11 aa, Influenza virus
LTRGLCTINSW

SEQ ID NO: 406648 - protein, 11 aa, Influenza virus
TRGLCTINSWH

SEQ ID NO: 406649 - protein, 11 aa, Influenza virus
RGLCTINSWHI

SEQ ID NO: 406650 - protein, 11 aa, Influenza virus
ELCTINSWHIY

SEQ ID NO: 406651 - protein, 11 aa, Influenza virus
LCIINSWHIYG

SEQ ID NO: 406652 - protein, 11 aa, Influenza virus
CKINSWHIFGK

SEQ ID NO: 406653 - protein, 11 aa, Influenza virus
TINSWHIHGKD

SEQ ID NO: 406654 - protein, 11 aa, Influenza virus
SWHIFGKDNAV

SEQ ID NO: 406655 - protein, 11 aa, Influenza virus
WHIFGKDNAVR

SEQ ID NO: 406656 - protein, 11 aa, Influenza virus
HIFGKDNAVRI

SEQ ID NO: 406657 - protein, 11 aa, Influenza virus
IFGKDNAVRIG

SEQ ID NO: 406658 - protein, 11 aa, Influenza virus
FGKDNAVRIGE

SEQ ID NO: 406659 - protein, 11 aa, Influenza virus
GKDNAIRIGEN

SEQ ID NO: 406660 - protein, 11 aa, Influenza virus
KDNAIRIGENS

SEQ ID NO: 406661 - protein, 11 aa, Influenza virus
RIGEDSDILVT

SEQ ID NO: 406662 - protein, 11 aa, Influenza virus
IGEDSDILVTR

SEQ ID NO: 406663 - protein, 11 aa, Influenza virus
GEDSDILVTRE

SEQ ID NO: 406664 - protein, 11 aa, Influenza virus
DSDILVTREPY

SEQ ID NO: 406665 - protein, 11 aa, Influenza virus
TREPYVSCDPN

SEQ ID NO: 406666 - protein, 11 aa, Influenza virus
REPYVSCDPDG

SEQ ID NO: 406667 - protein, 11 aa, Influenza virus
EPYVSCDPDGC

SEQ ID NO: 406668 - protein, 11 aa, Influenza virus
PYVSCEPDECR

SEQ ID NO: 406669 - protein, 11 aa, Influenza virus
YVSCDPDGCRF

SEQ ID NO: 406670 - protein, 11 aa, Influenza virus
VSCDPDGCRFY

SEQ ID NO: 406671 - protein, 11 aa, Influenza virus
SCEPDECRFYA

SEQ ID NO: 406672 - protein, 11 aa, Influenza virus
CEPDECRFYAL

SEQ ID NO: 406673 - protein, 11 aa, Influenza virus
EPDECRFYALS

SEQ ID NO: 406674 - protein, 11 aa, Influenza virus
PNECRFYALSQ

SEQ ID NO: 406675 - protein, 11 aa, Influenza virus
NECRFYALSQG

SEQ ID NO: 406676 - protein, 11 aa, Influenza virus
IHDRSQYRALV

SEQ ID NO: 406677 - protein, 11 aa, Influenza virus
HDRSQYRALVS

SEQ ID NO: 406678 - protein, 11 aa, Influenza virus
DRSQYRALVSW

SEQ ID NO: 406679 - protein, 11 aa, Influenza virus
RSQYRALVSWP

SEQ ID NO: 406680 - protein, 11 aa, Influenza virus
SQYRALVSWPL

SEQ ID NO: 406681 - protein, 11 aa, Influenza virus
QYRALVSWPLS

SEQ ID NO: 406682 - protein, 11 aa, Influenza virus
YRALVSWPLSS

SEQ ID NO: 406683 - protein, 11 aa, Influenza virus
RALVSWPLSSP

SEQ ID NO: 406684 - protein, 11 aa, Influenza virus
ALVSWPLSSPP

SEQ ID NO: 406685 - protein, 11 aa, Influenza virus
LISWPQSSPPT

SEQ ID NO: 406686 - protein, 11 aa, Influenza virus
ISWPQSSPPTV

SEQ ID NO: 406687 - protein, 11 aa, Influenza virus
PLSSPPTVYNN

SEQ ID NO: 406688 - protein, 11 aa, Influenza virus
KVECIGWSSTS

SEQ ID NO: 406689 - protein, 11 aa, Influenza virus
WSSTSCHDGKA

SEQ ID NO: 406690 - protein, 11 aa, Influenza virus
SSTSCHDGKAR

SEQ ID NO: 406691 - protein, 11 aa, Influenza virus
STSCHDGKARM

SEQ ID NO: 406692 - protein, 11 aa, Influenza virus
TSCHDGKARMS

SEQ ID NO: 406693 - protein, 11 aa, Influenza virus
RMSVCISGPNN

SEQ ID NO: 406694 - protein, 11 aa, Influenza virus
MSVCISGPNNN

SEQ ID NO: 406695 - protein, 11 aa, Influenza virus
SVCISGPNNNA

SEQ ID NO: 406696 - protein, 11 aa, Influenza virus
VCISGPNNNAS

SEQ ID NO: 406697 - protein, 11 aa, Influenza virus
ISGPNNNASAI

SEQ ID NO: 406698 - protein, 11 aa, Influenza virus
SGPNNNASAIV

SEQ ID NO: 406699 - protein, 11 aa, Influenza virus
GPNNNASAIVW

SEQ ID NO: 406700 - protein, 11 aa, Influenza virus
PNNNASAIVWY

SEQ ID NO: 406701 - protein, 11 aa, Influenza virus
NNNASAIVWYN

SEQ ID NO: 406702 - protein, 11 aa, Influenza virus
RPITEINTWAR

SEQ ID NO: 406703 - protein, 11 aa, Influenza virus
PITEINTWARN

SEQ ID NO: 406704 - protein, 11 aa, Influenza virus
ITEINTWARNI

SEQ ID NO: 406705 - protein, 11 aa, Influenza virus
RTEESECVCHN

SEQ ID NO: 406706 - protein, 11 aa, Influenza virus
TEESECVCHNG

SEQ ID NO: 406707 - protein, 11 aa, Influenza virus
QESECVCHSGI

SEQ ID NO: 406708 - protein, 11 aa, Influenza virus
ESECVCHSGIC

SEQ ID NO: 406709 - protein, 11 aa, Influenza virus
SECVCHSGICP

SEQ ID NO: 406710 - protein, 11 aa, Influenza virus
ECVCHSGICPV

SEQ ID NO: 406711 - protein, 11 aa, Influenza virus
CVCHSGICPVV

SEQ ID NO: 406712 - protein, 11 aa, Influenza virus
VCHSGICPVVF

SEQ ID NO: 406713 - protein, 11 aa, Influenza virus
CHSGICPVVFT

SEQ ID NO: 406714 - protein, 11 aa, Influenza virus
HSGICPVVFTD

SEQ ID NO: 406715 - protein, 11 aa, Influenza virus
SGICPVVFTDG

SEQ ID NO: 406716 - protein, 11 aa, Influenza virus
GSATGPADTRI

SEQ ID NO: 406717 - protein, 11 aa, Influenza virus
SATGPADTRIY

SEQ ID NO: 406718 - protein, 11 aa, Influenza virus
ATGPADTRIYY

SEQ ID NO: 406719 - protein, 11 aa, Influenza virus
TGPADTRIYYF

SEQ ID NO: 406720 - protein, 11 aa, Influenza virus
LNGTAKHIEEC

SEQ ID NO: 406721 - protein, 11 aa, Influenza virus
NGTAKHIEECS

SEQ ID NO: 406722 - protein, 11 aa, Influenza virus
KHIEECSCYGK

SEQ ID NO: 406723 - protein, 11 aa, Influenza virus
IICTCRDNWQG

SEQ ID NO: 406724 - protein, 11 aa, Influenza virus
QGSNRPVIRID

SEQ ID NO: 406725 - protein, 11 aa, Influenza virus
GSNRPVIRIDP

SEQ ID NO: 406726 - protein, 11 aa, Influenza virus
MMTHTSQYICS

SEQ ID NO: 406727 - protein, 11 aa, Influenza virus
THTSQYICSPI

SEQ ID NO: 406728 - protein, 11 aa, Influenza virus
LTDNPRPNDPN

SEQ ID NO: 406729 - protein, 11 aa, Influenza virus
VGKCNEPYPGN

SEQ ID NO: 406730 - protein, 11 aa, Influenza virus
KCNDPYPGSNN

SEQ ID NO: 406731 - protein, 11 aa, Influenza virus
CNDPYPGNNBN

SEQ ID NO: 406732 - protein, 11 aa, Influenza virus
NDPYPGNNBNG

SEQ ID NO: 406733 - protein, 11 aa, Influenza virus
DPYPGNNBNGV

SEQ ID NO: 406734 - protein, 11 aa, Influenza virus
PYPGNNNKGVK

SEQ ID NO: 406735 - protein, 11 aa, Influenza virus
YPGSNNNGVKG

SEQ ID NO: 406736 - protein, 11 aa, Influenza virus
PGNNNGVKGFS

SEQ ID NO: 406737 - protein, 11 aa, Influenza virus
GSNNNGVKGFS

SEQ ID NO: 406738 - protein, 11 aa, Influenza virus
NSNNGVKGFSY

SEQ ID NO: 406739 - protein, 11 aa, Influenza virus
SNNGVKGFSYL

SEQ ID NO: 406740 - protein, 11 aa, Influenza virus
NNGVKGFAYLD

SEQ ID NO: 406741 - protein, 11 aa, Influenza virus
NGVKGFAYLDG

SEQ ID NO: 406742 - protein, 11 aa, Influenza virus
NTWLGRTLNTA

SEQ ID NO: 406743 - protein, 11 aa, Influenza virus
TWLGRTTSTAS

SEQ ID NO: 406744 - protein, 11 aa, Influenza virus
WLGRTLNTASR

SEQ ID NO: 406745 - protein, 11 aa, Influenza virus
GRTISTASRAG

SEQ ID NO: 406746 - protein, 11 aa, Influenza virus
RTISTASRYGY

SEQ ID NO: 406747 - protein, 11 aa, Influenza virus
TISTASRAGYE

SEQ ID NO: 406748 - protein, 11 aa, Influenza virus
NTASRSGYEML

SEQ ID NO: 406749 - protein, 11 aa, Influenza virus
IASRSGYEILK

SEQ ID NO: 406750 - protein, 11 aa, Influenza virus
ASRSGYEILKV

SEQ ID NO: 406751 - protein, 11 aa, Influenza virus
SRAGYEMLKVP

SEQ ID NO: 406752 - protein, 11 aa, Influenza virus
RAGYEMLKVPN

SEQ ID NO: 406753 - protein, 11 aa, Influenza virus
YGYEMLKVPNA

SEQ ID NO: 406754 - protein, 11 aa, Influenza virus
EILKVPNALTD

SEQ ID NO: 406755 - protein, 11 aa, Influenza virus
MLKVPNALTND

SEQ ID NO: 406756 - protein, 11 aa, Influenza virus
LKVPNALTDDK

SEQ ID NO: 406757 - protein, 11 aa, Influenza virus
KVPNALTDDKS

SEQ ID NO: 406758 - protein, 11 aa, Influenza virus
VPNALTDNRSK

SEQ ID NO: 406759 - protein, 11 aa, Influenza virus
PNALTDDKSKP

SEQ ID NO: 406760 - protein, 11 aa, Influenza virus
QGQTIVLTTDW

SEQ ID NO: 406761 - protein, 11 aa, Influenza virus
GQTIVLTTDWS

SEQ ID NO: 406762 - protein, 11 aa, Influenza virus
QTIVLDTDWSG

SEQ ID NO: 406763 - protein, 11 aa, Influenza virus
TIVLDTDWSGY

SEQ ID NO: 406764 - protein, 11 aa, Influenza virus
IVLTTDWSGYS

SEQ ID NO: 406765 - protein, 11 aa, Influenza virus
TDWSGYSGSFV

SEQ ID NO: 406766 - protein, 11 aa, Influenza virus
DWSGYSGSFVD

SEQ ID NO: 406767 - protein, 11 aa, Influenza virus
WSGYSGSFVDY

SEQ ID NO: 406768 - protein, 11 aa, Influenza virus
SGYSGSFVDYW

SEQ ID NO: 406769 - protein, 11 aa, Influenza virus
GYSGSFVDYWA

SEQ ID NO: 406770 - protein, 11 aa, Influenza virus
YSGSFIDYWAE

SEQ ID NO: 406771 - protein, 11 aa, Influenza virus
SGSFVDYWAEG

SEQ ID NO: 406772 - protein, 11 aa, Influenza virus
DYWAKGECYRA

SEQ ID NO: 406773 - protein, 11 aa, Influenza virus
YWAKGECYRAC

SEQ ID NO: 406774 - protein, 11 aa, Influenza virus
WAKGECYRACF

SEQ ID NO: 406775 - protein, 11 aa, Influenza virus
AKGECYRACFY

SEQ ID NO: 406776 - protein, 11 aa, Influenza virus
KGECYRACFYV

SEQ ID NO: 406777 - protein, 11 aa, Influenza virus
EECYRACFYVE

SEQ ID NO: 406778 - protein, 11 aa, Influenza virus
ELIRGRPKEDR

SEQ ID NO: 406779 - protein, 11 aa, Influenza virus
LIRGRPKEDRV

SEQ ID NO: 406780 - protein, 11 aa, Influenza virus
IRGRPKEDRVW

SEQ ID NO: 406781 - protein, 11 aa, Influenza virus
RGRPKEDRVWW

SEQ ID NO: 406782 - protein, 11 aa, Influenza virus
GRPKEDRVWWT

SEQ ID NO: 406783 - protein, 11 aa, Influenza virus
RPKEDRVWWTS

SEQ ID NO: 406784 - protein, 11 aa, Influenza virus
PKEDRVWWTSN

SEQ ID NO: 406785 - protein, 11 aa, Influenza virus
KEDRVWWTSNS

SEQ ID NO: 406786 - protein, 11 aa, Influenza virus
EDRVWWTSNSI

SEQ ID NO: 406787 - protein, 11 aa, Influenza virus
DRVWWTSNSIV

SEQ ID NO: 406788 - protein, 11 aa, Influenza virus
KVWWTSNSIIS

SEQ ID NO: 406789 - protein, 11 aa, Influenza virus
LGQWNWPDGAE

SEQ ID NO: 406790 - protein, 11 aa, Influenza virus
GQWNWPDGAEI

SEQ ID NO: 406791 - protein, 11 aa, Influenza virus
QWNWPDGAEIE

SEQ ID NO: 406792 - protein, 11 aa, Influenza virus
WNWPDGAEIEY

SEQ ID NO: 406793 - protein, 11 aa, Influenza virus
NWPDGAEIEYF

SEQ ID NO: 406794 - protein, 11 aa, Influenza virus
WPDGAKIKYFL

SEQ ID NO: 406795 - protein, 11 aa, Influenza virus
GLDRICLGHHA

SEQ ID NO: 406796 - protein, 11 aa, Influenza virus
LDRICLGHHAV

SEQ ID NO: 406797 - protein, 11 aa, Influenza virus
DKICLGHHAVA

SEQ ID NO: 406798 - protein, 11 aa, Influenza virus
KICLGHHAVAN

SEQ ID NO: 406799 - protein, 11 aa, Influenza virus
ICLGHHAVANG

SEQ ID NO: 406800 - protein, 11 aa, Influenza virus
CLGHHAVANGT

SEQ ID NO: 406801 - protein, 11 aa, Influenza virus
HEEVTNATETV

SEQ ID NO: 406802 - protein, 11 aa, Influenza virus
EVTNATETVET

SEQ ID NO: 406803 - protein, 11 aa, Influenza virus
SEEALRQKIME

SEQ ID NO: 406804 - protein, 11 aa, Influenza virus
LRQKVMESGGI

SEQ ID NO: 406805 - protein, 11 aa, Influenza virus
QNFPRTTNTYR

SEQ ID NO: 406806 - protein, 11 aa, Influenza virus
SFPQTTNTYRN

SEQ ID NO: 406807 - protein, 11 aa, Influenza virus
FPRTTNTYRNT

SEQ ID NO: 406808 - protein, 11 aa, Influenza virus
PRTTNTYRNTD

SEQ ID NO: 406809 - protein, 11 aa, Influenza virus
QTANTYRNTDS

SEQ ID NO: 406810 - protein, 11 aa, Influenza virus
LYGAQSLSISV

SEQ ID NO: 406811 - protein, 11 aa, Influenza virus
YGTQSLSISVE

SEQ ID NO: 406812 - protein, 11 aa, Influenza virus
GTQSLSISIGS

SEQ ID NO: 406813 - protein, 11 aa, Influenza virus
TQSLSISVESS

SEQ ID NO: 406814 - protein, 11 aa, Influenza virus
QSLSISVESST

SEQ ID NO: 406815 - protein, 11 aa, Influenza virus
SLSISIGSSTY

SEQ ID NO: 406816 - protein, 11 aa, Influenza virus
LSISIGSSTYQ

SEQ ID NO: 406817 - protein, 11 aa, Influenza virus
SISVESSTYQN

SEQ ID NO: 406818 - protein, 11 aa, Influenza virus
VESSTYQNNFV

SEQ ID NO: 406819 - protein, 11 aa, Influenza virus
ESSTYQNNFVP

SEQ ID NO: 406820 - protein, 11 aa, Influenza virus
SSTYHNSFVPV

SEQ ID NO: 406821 - protein, 11 aa, Influenza virus
STYQNNFVPVI

SEQ ID NO: 406822 - protein, 11 aa, Influenza virus
NNFVPVIGARP

SEQ ID NO: 406823 - protein, 11 aa, Influenza virus
FVPVMGARPQV

SEQ ID NO: 406824 - protein, 11 aa, Influenza virus
VPVMGARPQVN

SEQ ID NO: 406825 - protein, 11 aa, Influenza virus
PVVRARPQVNG

SEQ ID NO: 406826 - protein, 11 aa, Influenza virus
VMGARPQVNGQ

SEQ ID NO: 406827 - protein, 11 aa, Influenza virus
GARPKVNGQSG

SEQ ID NO: 406828 - protein, 11 aa, Influenza virus
ARPLVNGQSGR

SEQ ID NO: 406829 - protein, 11 aa, Influenza virus
RPQVNGQRGRI

SEQ ID NO: 406830 - protein, 11 aa, Influenza virus
VNGQSGRIVFH

SEQ ID NO: 406831 - protein, 11 aa, Influenza virus
NGQSGRINFHW

SEQ ID NO: 406832 - protein, 11 aa, Influenza virus
PGHNITFSHNG

SEQ ID NO: 406833 - protein, 11 aa, Influenza virus
GDHITFSHNGG

SEQ ID NO: 406834 - protein, 11 aa, Influenza virus
ITFSDNGGLIA

SEQ ID NO: 406835 - protein, 11 aa, Influenza virus
TFSDNGGLIAP

SEQ ID NO: 406836 - protein, 11 aa, Influenza virus
HNGGLIAPNRV

SEQ ID NO: 406837 - protein, 11 aa, Influenza virus
CKSKCFWRGGS

SEQ ID NO: 406838 - protein, 11 aa, Influenza virus
ESKCFWKSGSI

SEQ ID NO: 406839 - protein, 11 aa, Influenza virus
SKCFWKGGSIK

SEQ ID NO: 406840 - protein, 11 aa, Influenza virus
KCFWKGGSIKT

SEQ ID NO: 406841 - protein, 11 aa, Influenza virus
GGSIKTKLPFQ

SEQ ID NO: 406842 - protein, 11 aa, Influenza virus
GSIKTKLPFQN

SEQ ID NO: 406843 - protein, 11 aa, Influenza virus
SIKTKLPFQNL

SEQ ID NO: 406844 - protein, 11 aa, Influenza virus
IKTKLPFQNLS

SEQ ID NO: 406845 - protein, 11 aa, Influenza virus
KTKLPFQNLSP

SEQ ID NO: 406846 - protein, 11 aa, Influenza virus
TELPFQNLSPR

SEQ ID NO: 406847 - protein, 11 aa, Influenza virus
ELPFQNLSPRT

SEQ ID NO: 406848 - protein, 11 aa, Influenza virus
RTVGQCPKYVK

SEQ ID NO: 406849 - protein, 11 aa, Influenza virus
KSLMLATGMRN

SEQ ID NO: 406850 - protein, 11 aa, Influenza virus
LATGMRNVPET

SEQ ID NO: 406851 - protein, 11 aa, Influenza virus
QGRGLFGAKAG

SEQ ID NO: 406852 - protein, 11 aa, Influenza virus
GRGLFGAKAGF

SEQ ID NO: 406853 - protein, 11 aa, Influenza virus
FLENGWEGMVD

SEQ ID NO: 406854 - protein, 11 aa, Influenza virus
IENGWEGMVNG

SEQ ID NO: 406855 - protein, 11 aa, Influenza virus
RHQNAQGTGQV

SEQ ID NO: 406856 - protein, 11 aa, Influenza virus
HQNDQGTGQAA

SEQ ID NO: 406857 - protein, 11 aa, Influenza virus
QNAQGTGLAAD

SEQ ID NO: 406858 - protein, 11 aa, Influenza virus
NDQGTGQAADY

SEQ ID NO: 406859 - protein, 11 aa, Influenza virus
AQGTGQAADYE

SEQ ID NO: 406860 - protein, 11 aa, Influenza virus
QGTGQAADYES

SEQ ID NO: 406861 - protein, 11 aa, Influenza virus
GTGQAADYEST

SEQ ID NO: 406862 - protein, 11 aa, Influenza virus
TGQAADYESTQ

SEQ ID NO: 406863 - protein, 11 aa, Influenza virus
GQAADYESTQA

SEQ ID NO: 406864 - protein, 11 aa, Influenza virus
QAADYKSTQKT

SEQ ID NO: 406865 - protein, 11 aa, Influenza virus
AADYKSTQTAI

SEQ ID NO: 406866 - protein, 11 aa, Influenza virus
AINQITGKLNR

SEQ ID NO: 406867 - protein, 11 aa, Influenza virus
IDQVTGKLNRL

SEQ ID NO: 406868 - protein, 11 aa, Influenza virus
NQITGKLNRLI

SEQ ID NO: 406869 - protein, 11 aa, Influenza virus
FESIESEFSET

SEQ ID NO: 406870 - protein, 11 aa, Influenza virus
ESIESEFSETE

SEQ ID NO: 406871 - protein, 11 aa, Influenza virus
SIESEFSETEH

SEQ ID NO: 406872 - protein, 11 aa, Influenza virus
IESEFSETEHQ

SEQ ID NO: 406873 - protein, 11 aa, Influenza virus
ESEFSETEHQI

SEQ ID NO: 406874 - protein, 11 aa, Influenza virus
SEFSETEHQIG

SEQ ID NO: 406875 - protein, 11 aa, Influenza virus
EFSETEHQIGN

SEQ ID NO: 406876 - protein, 11 aa, Influenza virus
FSETEHQIGNV

SEQ ID NO: 406877 - protein, 11 aa, Influenza virus
SETEHQIGNVI

SEQ ID NO: 406878 - protein, 11 aa, Influenza virus
EIEYQIGNVIN

SEQ ID NO: 406879 - protein, 11 aa, Influenza virus
IEYQIGNVINW

SEQ ID NO: 406880 - protein, 11 aa, Influenza virus
DIWTYNAELLV

SEQ ID NO: 406881 - protein, 11 aa, Influenza virus
NQHTIEMTDSE

SEQ ID NO: 406882 - protein, 11 aa, Influenza virus
QHTIDMGDSEM

SEQ ID NO: 406883 - protein, 11 aa, Influenza virus
HTIEMTDSEML

SEQ ID NO: 406884 - protein, 11 aa, Influenza virus
TIDLADSEMLN

SEQ ID NO: 406885 - protein, 11 aa, Influenza virus
IEMTDSEMLNL

SEQ ID NO: 406886 - protein, 11 aa, Influenza virus
EMTDSEMLNLY

SEQ ID NO: 406887 - protein, 11 aa, Influenza virus
MTDSEMLNLYE

SEQ ID NO: 406888 - protein, 11 aa, Influenza virus
GDSEMLNLYER

SEQ ID NO: 406889 - protein, 11 aa, Influenza virus
STMLNLYERVR

SEQ ID NO: 406890 - protein, 11 aa, Influenza virus
TMLNLYERVRK

SEQ ID NO: 406891 - protein, 11 aa, Influenza virus
DCMESIRNNTY

SEQ ID NO: 406892 - protein, 11 aa, Influenza virus
CMERIRNNTYD

SEQ ID NO: 406893 - protein, 11 aa, Influenza virus
MERIRNNTYDH

SEQ ID NO: 406894 - protein, 11 aa, Influenza virus
IRNNTYDHAQY

SEQ ID NO: 406895 - protein, 11 aa, Influenza virus
RNNTYDHAQYR

SEQ ID NO: 406896 - protein, 11 aa, Influenza virus
NNTYDHAQYRE

SEQ ID NO: 406897 - protein, 11 aa, Influenza virus
NTYDHAQYREE

SEQ ID NO: 406898 - protein, 11 aa, Influenza virus
HYREEALLNRL

SEQ ID NO: 406899 - protein, 11 aa, Influenza virus
YREESLLNRLS

SEQ ID NO: 406900 - protein, 11 aa, Influenza virus
REESLLNRLSI

SEQ ID NO: 406901 - protein, 11 aa, Influenza virus
EESLLNRLSIN

SEQ ID NO: 406902 - protein, 11 aa, Influenza virus
EALLNRLSINP

SEQ ID NO: 406903 - protein, 11 aa, Influenza virus
ALLNRLSINPV

SEQ ID NO: 406904 - protein, 11 aa, Influenza virus
INPVTLSSGYK

SEQ ID NO: 406905 - protein, 11 aa, Influenza virus
LFSGYKDIILW

SEQ ID NO: 406906 - protein, 11 aa, Influenza virus
SSGYKNVILWF

SEQ ID NO: 406907 - protein, 11 aa, Influenza virus
IILWFSFGASS

SEQ ID NO: 406908 - protein, 11 aa, Influenza virus
LWFSFGASSFV

SEQ ID NO: 406909 - protein, 11 aa, Influenza virus
WFSFGASSFVL

SEQ ID NO: 406910 - protein, 11 aa, Influenza virus
FSFGASSFVLL

SEQ ID NO: 406911 - protein, 11 aa, Influenza virus
SFGASSFVLLA

SEQ ID NO: 406912 - protein, 11 aa, Influenza virus
GLDRICLGHHA

SEQ ID NO: 406913 - protein, 11 aa, Influenza virus
LDRICLGHHAV

SEQ ID NO: 406914 - protein, 11 aa, Influenza virus
DRICLGHHAVA

SEQ ID NO: 406915 - protein, 11 aa, Influenza virus
RICLGHHAVAN

SEQ ID NO: 406916 - protein, 11 aa, Influenza virus
ICLGHHAVANG

SEQ ID NO: 406917 - protein, 11 aa, Influenza virus
CLGHHAVANGT

SEQ ID NO: 406918 - protein, 11 aa, Influenza virus
LGHHAVANGTI

SEQ ID NO: 406919 - protein, 11 aa, Influenza virus
NGTIIKTLTNE

SEQ ID NO: 406920 - protein, 11 aa, Influenza virus
GTIVKTLTSEK

SEQ ID NO: 406921 - protein, 11 aa, Influenza virus
TIVKTLTSEKE

SEQ ID NO: 406922 - protein, 11 aa, Influenza virus
EREEVTNATET

SEQ ID NO: 406923 - protein, 11 aa, Influenza virus
HEEVTNATETV

SEQ ID NO: 406924 - protein, 11 aa, Influenza virus
KVTNATETVES

SEQ ID NO: 406925 - protein, 11 aa, Influenza virus
VTNATETVESR

SEQ ID NO: 406926 - protein, 11 aa, Influenza virus
KDLDNCHPIGM

SEQ ID NO: 406927 - protein, 11 aa, Influenza virus
GTPACDLYLTG

SEQ ID NO: 406928 - protein, 11 aa, Influenza virus
CDPHLTGTWDT

SEQ ID NO: 406929 - protein, 11 aa, Influenza virus
DPHLTGTWDTL

SEQ ID NO: 406930 - protein, 11 aa, Influenza virus
PHLTGTWDTLI

SEQ ID NO: 406931 - protein, 11 aa, Influenza virus
HLTGMWDTLIE

SEQ ID NO: 406932 - protein, 11 aa, Influenza virus
LTGIWDTLIER

SEQ ID NO: 406933 - protein, 11 aa, Influenza virus
TGTWDTLIERG

SEQ ID NO: 406934 - protein, 11 aa, Influenza virus
GTWDTLIERGS

SEQ ID NO: 406935 - protein, 11 aa, Influenza virus
AYCYPGTTVNE

SEQ ID NO: 406936 - protein, 11 aa, Influenza virus
CYPGTTVNEEA

SEQ ID NO: 406937 - protein, 11 aa, Influenza virus
YPGTTVNEEAL

SEQ ID NO: 406938 - protein, 11 aa, Influenza virus
PGTTVNEEALR

SEQ ID NO: 406939 - protein, 11 aa, Influenza virus
GTTVNEEALRQ

SEQ ID NO: 406940 - protein, 11 aa, Influenza virus
TTVNEEALRQK

SEQ ID NO: 406941 - protein, 11 aa, Influenza virus
TVNEGALRQKI

SEQ ID NO: 406942 - protein, 11 aa, Influenza virus
VNEGALRQKIM

SEQ ID NO: 406943 - protein, 11 aa, Influenza virus
KIMESGGISKM

SEQ ID NO: 406944 - protein, 11 aa, Influenza virus
IMESGGISKIS

SEQ ID NO: 406945 - protein, 11 aa, Influenza virus
MESGGISKIST

SEQ ID NO: 406946 - protein, 11 aa, Influenza virus
GKNSFYAELKW

SEQ ID NO: 406947 - protein, 11 aa, Influenza virus
KNSFYAELKWL

SEQ ID NO: 406948 - protein, 11 aa, Influenza virus
NSFYAELKWLI

SEQ ID NO: 406949 - protein, 11 aa, Influenza virus
YAELKWLVSKN

SEQ ID NO: 406950 - protein, 11 aa, Influenza virus
AELKWLVSKNK

SEQ ID NO: 406951 - protein, 11 aa, Influenza virus
ELKWLVSKNKG

SEQ ID NO: 406952 - protein, 11 aa, Influenza virus
LKWLVSKNKGQ

SEQ ID NO: 406953 - protein, 11 aa, Influenza virus
QNFPRTTNTYR

SEQ ID NO: 406954 - protein, 11 aa, Influenza virus
NFPRTTNTYRN

SEQ ID NO: 406955 - protein, 11 aa, Influenza virus
FPRTTNTYRNT

SEQ ID NO: 406956 - protein, 11 aa, Influenza virus
PRTTNTYRNTD

SEQ ID NO: 406957 - protein, 11 aa, Influenza virus
QTANTYRNTDS

SEQ ID NO: 406958 - protein, 11 aa, Influenza virus
EHLITWGIHHP

SEQ ID NO: 406959 - protein, 11 aa, Influenza virus
HLIMWGIHHPS

SEQ ID NO: 406960 - protein, 11 aa, Influenza virus
LITWGIHHPSS

SEQ ID NO: 406961 - protein, 11 aa, Influenza virus
WGIHHPSSAQE

SEQ ID NO: 406962 - protein, 11 aa, Influenza virus
GIHHPSSAQEK

SEQ ID NO: 406963 - protein, 11 aa, Influenza virus
IHHPSSAQEKN

SEQ ID NO: 406964 - protein, 11 aa, Influenza virus
HHPSSAQEKND

SEQ ID NO: 406965 - protein, 11 aa, Influenza virus
HPSSTKEKNDL

SEQ ID NO: 406966 - protein, 11 aa, Influenza virus
PSSTKEKNDLY

SEQ ID NO: 406967 - protein, 11 aa, Influenza virus
SSAQEKNDLYG

SEQ ID NO: 406968 - protein, 11 aa, Influenza virus
EKNDLYGTQPL

SEQ ID NO: 406969 - protein, 11 aa, Influenza virus
KNDLYGTQPLS

SEQ ID NO: 406970 - protein, 11 aa, Influenza virus
NDLYGTQPLSI

SEQ ID NO: 406971 - protein, 11 aa, Influenza virus
ELYGTQSLSIS

SEQ ID NO: 406972 - protein, 11 aa, Influenza virus
LYGTQSLSISI

SEQ ID NO: 406973 - protein, 11 aa, Influenza virus
YGTQPLSISVG

SEQ ID NO: 406974 - protein, 11 aa, Influenza virus
GTQPLSISVGS

SEQ ID NO: 406975 - protein, 11 aa, Influenza virus
TQSLSISIGSS

SEQ ID NO: 406976 - protein, 11 aa, Influenza virus
QSLSISIGSST

SEQ ID NO: 406977 - protein, 11 aa, Influenza virus
SLSISIGSSTY

SEQ ID NO: 406978 - protein, 11 aa, Influenza virus
LSISIGSSTYQ

SEQ ID NO: 406979 - protein, 11 aa, Influenza virus
SISIGSSTYQN

SEQ ID NO: 406980 - protein, 11 aa, Influenza virus
ISVESSTYQNN

SEQ ID NO: 406981 - protein, 11 aa, Influenza virus
SVESSTYQNNF

SEQ ID NO: 406982 - protein, 11 aa, Influenza virus
VGSSTYQNSFV

SEQ ID NO: 406983 - protein, 11 aa, Influenza virus
GSSTYQNSFVP

SEQ ID NO: 406984 - protein, 11 aa, Influenza virus
SSTYHNSFVPV

SEQ ID NO: 406985 - protein, 11 aa, Influenza virus
SIYQNSFVPVV

SEQ ID NO: 406986 - protein, 11 aa, Influenza virus
TYQNNFVPVIG

SEQ ID NO: 406987 - protein, 11 aa, Influenza virus
YHNSFVPVVGA

SEQ ID NO: 406988 - protein, 11 aa, Influenza virus
QNNFVPVIGAR

SEQ ID NO: 406989 - protein, 11 aa, Influenza virus
GQSGRIDFHWA

SEQ ID NO: 406990 - protein, 11 aa, Influenza virus
IQPGDNITFSH

SEQ ID NO: 406991 - protein, 11 aa, Influenza virus
QPGDNITFLHN

SEQ ID NO: 406992 - protein, 11 aa, Influenza virus
PGDNIIFSHNG

SEQ ID NO: 406993 - protein, 11 aa, Influenza virus
GDNITFLHNGG

SEQ ID NO: 406994 - protein, 11 aa, Influenza virus
DNITFLHNGGL

SEQ ID NO: 406995 - protein, 11 aa, Influenza virus
NITFLHNGGLI

SEQ ID NO: 406996 - protein, 11 aa, Influenza virus
ITFSDNGGLIA

SEQ ID NO: 406997 - protein, 11 aa, Influenza virus
TFSHNGGLVAP

SEQ ID NO: 406998 - protein, 11 aa, Influenza virus
FSHNGGLIAPD

SEQ ID NO: 406999 - protein, 11 aa, Influenza virus
SHNGGLVAPSR

SEQ ID NO: 407000 - protein, 11 aa, Influenza virus
HNGGLIAPDRV

SEQ ID NO: 407001 - protein, 11 aa, Influenza virus
NGGLIAPDRVS

SEQ ID NO: 407002 - protein, 11 aa, Influenza virus
GGLVAPSRVSK

SEQ ID NO: 407003 - protein, 11 aa, Influenza virus
GLIAPDRVSKL

SEQ ID NO: 407004 - protein, 11 aa, Influenza virus
SKCFWRGGSIN

SEQ ID NO: 407005 - protein, 11 aa, Influenza virus
KCFWRGGSINT

SEQ ID NO: 407006 - protein, 11 aa, Influenza virus
CFWRGGSINTK

SEQ ID NO: 407007 - protein, 11 aa, Influenza virus
FWRGGSINTKL

SEQ ID NO: 407008 - protein, 11 aa, Influenza virus
WRGGSINTKLP

SEQ ID NO: 407009 - protein, 11 aa, Influenza virus
RGGSINTKLPF

SEQ ID NO: 407010 - protein, 11 aa, Influenza virus
GGSINTRLPFQ

SEQ ID NO: 407011 - protein, 11 aa, Influenza virus
GSINTRLPFQN

SEQ ID NO: 407012 - protein, 11 aa, Influenza virus
SINTRLPFQNL

SEQ ID NO: 407013 - protein, 11 aa, Influenza virus
INTRLPFQNLS

SEQ ID NO: 407014 - protein, 11 aa, Influenza virus
NTRLPFQNLSP

SEQ ID NO: 407015 - protein, 11 aa, Influenza virus
TVGQCPKYVNQ

SEQ ID NO: 407016 - protein, 11 aa, Influenza virus
KSLMLATGMRN

SEQ ID NO: 407017 - protein, 11 aa, Influenza virus
LATGMRNVPET

SEQ ID NO: 407018 - protein, 11 aa, Influenza virus
GQAADYESTQA

SEQ ID NO: 407019 - protein, 11 aa, Influenza virus
QAADYKSTQKT

SEQ ID NO: 407020 - protein, 11 aa, Influenza virus
AADYESTQAAI

SEQ ID NO: 407021 - protein, 11 aa, Influenza virus
ADYESTQAAID

SEQ ID NO: 407022 - protein, 11 aa, Influenza virus
DYKSTQKTIDQ

SEQ ID NO: 407023 - protein, 11 aa, Influenza virus
YKSTQKTIDQV

SEQ ID NO: 407024 - protein, 11 aa, Influenza virus
ESTQAAIDQIT

SEQ ID NO: 407025 - protein, 11 aa, Influenza virus
STQKTIDQVTG

SEQ ID NO: 407026 - protein, 11 aa, Influenza virus
TQKTIDQVTGK

SEQ ID NO: 407027 - protein, 11 aa, Influenza virus
QKTIDQVTGKL

SEQ ID NO: 407028 - protein, 11 aa, Influenza virus
KTIDQVTGKLN

SEQ ID NO: 407029 - protein, 11 aa, Influenza virus
TIDQVTGKLNR

SEQ ID NO: 407030 - protein, 11 aa, Influenza virus
IDQVTGKLNRL

SEQ ID NO: 407031 - protein, 11 aa, Influenza virus
FESIESEFSET

SEQ ID NO: 407032 - protein, 11 aa, Influenza virus
ESIESEFSETE

SEQ ID NO: 407033 - protein, 11 aa, Influenza virus
SIESEFSETEH

SEQ ID NO: 407034 - protein, 11 aa, Influenza virus
IESEFSETEHQ

SEQ ID NO: 407035 - protein, 11 aa, Influenza virus
ESEFSETEHQI

SEQ ID NO: 407036 - protein, 11 aa, Influenza virus
SEFSETEHQIG

SEQ ID NO: 407037 - protein, 11 aa, Influenza virus
EFSETEHQIGN

SEQ ID NO: 407038 - protein, 11 aa, Influenza virus
FSETEHQIGNV

SEQ ID NO: 407039 - protein, 11 aa, Influenza virus
SETEHQIGNVI

SEQ ID NO: 407040 - protein, 11 aa, Influenza virus
EIEYQIGNVIN

SEQ ID NO: 407041 - protein, 11 aa, Influenza virus
IEYQIGNVINW

SEQ ID NO: 407042 - protein, 11 aa, Influenza virus
MADSTMLNLYE

SEQ ID NO: 407043 - protein, 11 aa, Influenza virus
ADSEMLNLYEG

SEQ ID NO: 407044 - protein, 11 aa, Influenza virus
DSEMLNLYEGV

SEQ ID NO: 407045 - protein, 11 aa, Influenza virus
STMLNLYERVR

SEQ ID NO: 407046 - protein, 11 aa, Influenza virus
TMLNLYERVRK

SEQ ID NO: 407047 - protein, 11 aa, Influenza virus
DGKGCFEIYHT

SEQ ID NO: 407048 - protein, 11 aa, Influenza virus
GKGCFEIYHTC

SEQ ID NO: 407049 - protein, 11 aa, Influenza virus
NNCMESIRNNT

SEQ ID NO: 407050 - protein, 11 aa, Influenza virus
NCMERIRNNTY

SEQ ID NO: 407051 - protein, 11 aa, Influenza virus
ESIRNNTYDHS

SEQ ID NO: 407052 - protein, 11 aa, Influenza virus
SIRNNTYDHSQ

SEQ ID NO: 407053 - protein, 11 aa, Influenza virus
IRNNTYDHSQY

SEQ ID NO: 407054 - protein, 11 aa, Influenza virus
RNNTYDHSQYR

SEQ ID NO: 407055 - protein, 11 aa, Influenza virus
NNTYDHSQYRE

SEQ ID NO: 407056 - protein, 11 aa, Influenza virus
NTYDHSQYREE

SEQ ID NO: 407057 - protein, 11 aa, Influenza virus
TYDHSQYREEA

SEQ ID NO: 407058 - protein, 11 aa, Influenza virus
YDHSQYREEAL

SEQ ID NO: 407059 - protein, 11 aa, Influenza virus
DHSQYREEALL

SEQ ID NO: 407060 - protein, 11 aa, Influenza virus
HSQYREEALLN

SEQ ID NO: 407061 - protein, 11 aa, Influenza virus
SQYREEALLNR

SEQ ID NO: 407062 - protein, 11 aa, Influenza virus
EALLNRLSINP

SEQ ID NO: 407063 - protein, 11 aa, Influenza virus
ALLNRLSINPV

SEQ ID NO: 407064 - protein, 11 aa, Influenza virus
LLNRLSINPVK

SEQ ID NO: 407065 - protein, 11 aa, Influenza virus
LNRLSINPVKL

SEQ ID NO: 407066 - protein, 11 aa, Influenza virus
NRLSINPVKLS

SEQ ID NO: 407067 - protein, 11 aa, Influenza virus
RLSINPVKLSS

SEQ ID NO: 407068 - protein, 11 aa, Influenza virus
LSINPVKLSSG

SEQ ID NO: 407069 - protein, 11 aa, Influenza virus
SINPVKLSSGY

SEQ ID NO: 407070 - protein, 11 aa, Influenza virus
INPVTLSSGYK

SEQ ID NO: 407071 - protein, 11 aa, Influenza virus
NPVTLSSGYKD

SEQ ID NO: 407072 - protein, 11 aa, Influenza virus
VTLSSGYKDII

SEQ ID NO: 407073 - protein, 11 aa, Influenza virus
TLSSGYKDIIL

SEQ ID NO: 407074 - protein, 11 aa, Influenza virus
KNVILWFSFGA

SEQ ID NO: 407075 - protein, 11 aa, Influenza virus
DIILWFSFGES

SEQ ID NO: 407076 - protein, 11 aa, Influenza virus
FGASCFVLLAA

SEQ ID NO: 407077 - protein, 11 aa, Influenza virus
IMGLVFFCLRN

SEQ ID NO: 407078 - protein, 11 aa, Influenza virus
MGLFFFCLKNG

SEQ ID NO: 407079 - protein, 11 aa, Influenza virus
GLFFFCLKNGN

SEQ ID NO: 407080 - protein, 11 aa, Influenza virus
LFFFCLKNGNM

SEQ ID NO: 407081 - protein, 11 aa, Influenza virus
FFFCLKNGNMR

SEQ ID NO: 407082 - protein, 11 aa, Influenza virus
LKDGNMRCTIC

SEQ ID NO: 407083 - protein, 11 aa, Influenza virus
MNPNQNLFTLS

SEQ ID NO: 407084 - protein, 11 aa, Influenza virus
NPKSKLFTLSG

SEQ ID NO: 407085 - protein, 11 aa, Influenza virus
PKSKLFTLSGV

SEQ ID NO: 407086 - protein, 11 aa, Influenza virus
KSKLFTLSGVA

SEQ ID NO: 407087 - protein, 11 aa, Influenza virus
QKLFALSGVAV

SEQ ID NO: 407088 - protein, 11 aa, Influenza virus
KLFALSGVAVA

SEQ ID NO: 407089 - protein, 11 aa, Influenza virus
LFALSGVAVAL

SEQ ID NO: 407090 - protein, 11 aa, Influenza virus
MNLLIGISNVG

SEQ ID NO: 407091 - protein, 11 aa, Influenza virus
LIGISNVGLKV

SEQ ID NO: 407092 - protein, 11 aa, Influenza virus
NVGLNVSLHLR

SEQ ID NO: 407093 - protein, 11 aa, Influenza virus
ERGTKQEENLT

SEQ ID NO: 407094 - protein, 11 aa, Influenza virus
NQNNTTVVENT

SEQ ID NO: 407095 - protein, 11 aa, Influenza virus
QTNTTLIENTY

SEQ ID NO: 407096 - protein, 11 aa, Influenza virus
TNTTLIENTYV

SEQ ID NO: 407097 - protein, 11 aa, Influenza virus
TTLIENTYVNK

SEQ ID NO: 407098 - protein, 11 aa, Influenza virus
TVVENKYVNNT

SEQ ID NO: 407099 - protein, 11 aa, Influenza virus
VVENKYVNNTT

SEQ ID NO: 407100 - protein, 11 aa, Influenza virus
IENTYVNKTTV

SEQ ID NO: 407101 - protein, 11 aa, Influenza virus
ENTYVNKTTVI

SEQ ID NO: 407102 - protein, 11 aa, Influenza virus
YLLLNKSLCNV

SEQ ID NO: 407103 - protein, 11 aa, Influenza virus
LLLNKSLCNVE

SEQ ID NO: 407104 - protein, 11 aa, Influenza virus
LNKSLCSVEGW

SEQ ID NO: 407105 - protein, 11 aa, Influenza virus
NKSLCSVEGWV

SEQ ID NO: 407106 - protein, 11 aa, Influenza virus
KSLCSVEGWVV

SEQ ID NO: 407107 - protein, 11 aa, Influenza virus
SLCSVEGWVVI

SEQ ID NO: 407108 - protein, 11 aa, Influenza virus
LCSVEGWVVIA

SEQ ID NO: 407109 - protein, 11 aa, Influenza virus
CSVEGWVVIAK

SEQ ID NO: 407110 - protein, 11 aa, Influenza virus
SVEGWVVIAKD

SEQ ID NO: 407111 - protein, 11 aa, Influenza virus
GWVVIAKDNAI

SEQ ID NO: 407112 - protein, 11 aa, Influenza virus
WVVIAKDNAIR

SEQ ID NO: 407113 - protein, 11 aa, Influenza virus
VVIAKDNAIRF

SEQ ID NO: 407114 - protein, 11 aa, Influenza virus
VIAKDNAIRFG

SEQ ID NO: 407115 - protein, 11 aa, Influenza virus
IAKDNAIRFGE

SEQ ID NO: 407116 - protein, 11 aa, Influenza virus
AKDNAIRFGEG

SEQ ID NO: 407117 - protein, 11 aa, Influenza virus
KDNAIRFGEGE

SEQ ID NO: 407118 - protein, 11 aa, Influenza virus
DNAIRFGEGEQ

SEQ ID NO: 407119 - protein, 11 aa, Influenza virus
NAIRFGESEQV

SEQ ID NO: 407120 - protein, 11 aa, Influenza virus
AVRFGESEQII

SEQ ID NO: 407121 - protein, 11 aa, Influenza virus
IRFGESEQVIV

SEQ ID NO: 407122 - protein, 11 aa, Influenza virus
RFGEGEQIIVT

SEQ ID NO: 407123 - protein, 11 aa, Influenza virus
FGEGEQIIVTR

SEQ ID NO: 407124 - protein, 11 aa, Influenza virus
GEGEQIIVTRE

SEQ ID NO: 407125 - protein, 11 aa, Influenza virus
EGEQIIVTREP

SEQ ID NO: 407126 - protein, 11 aa, Influenza virus
GEQIIVTREPY

SEQ ID NO: 407127 - protein, 11 aa, Influenza virus
TREPYVSCDPT

SEQ ID NO: 407128 - protein, 11 aa, Influenza virus
REPYVSCDPSG

SEQ ID NO: 407129 - protein, 11 aa, Influenza virus
EPYVSCDPSGC

SEQ ID NO: 407130 - protein, 11 aa, Influenza virus
PYVSCDPSGCK

SEQ ID NO: 407131 - protein, 11 aa, Influenza virus
YVSCDPSGCKM

SEQ ID NO: 407132 - protein, 11 aa, Influenza virus
VSCDPSGCKMY

SEQ ID NO: 407133 - protein, 11 aa, Influenza virus
SCDPSGCKMYA

SEQ ID NO: 407134 - protein, 11 aa, Influenza virus
CDPTGCKMYAL

SEQ ID NO: 407135 - protein, 11 aa, Influenza virus
DPTGCKMYALH

SEQ ID NO: 407136 - protein, 11 aa, Influenza virus
PSGCKMYALHQ

SEQ ID NO: 407137 - protein, 11 aa, Influenza virus
SGCKMYALHQG

SEQ ID NO: 407138 - protein, 11 aa, Influenza virus
FRGLMSTPLGT

SEQ ID NO: 407139 - protein, 11 aa, Influenza virus
RGLMSTPLGSP

SEQ ID NO: 407140 - protein, 11 aa, Influenza virus
GLMSTPLGSPP

SEQ ID NO: 407141 - protein, 11 aa, Influenza virus
LISTPLGTPPT

SEQ ID NO: 407142 - protein, 11 aa, Influenza virus
ISTPLGTPPTV

SEQ ID NO: 407143 - protein, 11 aa, Influenza virus
STPLGTPPTVS

SEQ ID NO: 407144 - protein, 11 aa, Influenza virus
TPLGTPPTVSN

SEQ ID NO: 407145 - protein, 11 aa, Influenza virus
PLGTPPTVSNS

SEQ ID NO: 407146 - protein, 11 aa, Influenza virus
LGTPPTVSNSD

SEQ ID NO: 407147 - protein, 11 aa, Influenza virus
GTPPTVSNSDF

SEQ ID NO: 407148 - protein, 11 aa, Influenza virus
VSNSDFICVGW

SEQ ID NO: 407149 - protein, 11 aa, Influenza virus
SNSDFICVGWS

SEQ ID NO: 407150 - protein, 11 aa, Influenza virus
NSDFICVGWSS

SEQ ID NO: 407151 - protein, 11 aa, Influenza virus
SDFICVGWSST

SEQ ID NO: 407152 - protein, 11 aa, Influenza virus
DFICVGWSSTS

SEQ ID NO: 407153 - protein, 11 aa, Influenza virus
FMCVGWSSTTC

SEQ ID NO: 407154 - protein, 11 aa, Influenza virus
MCVGWSSTTCH

SEQ ID NO: 407155 - protein, 11 aa, Influenza virus
GWSSTTCHDGI

SEQ ID NO: 407156 - protein, 11 aa, Influenza virus
WSSTTCHDGIG

SEQ ID NO: 407157 - protein, 11 aa, Influenza virus
SSTTCHDGIGR

SEQ ID NO: 407158 - protein, 11 aa, Influenza virus
STTCHDGIGRM

SEQ ID NO: 407159 - protein, 11 aa, Influenza virus
TTCHDGIGRMT

SEQ ID NO: 407160 - protein, 11 aa, Influenza virus
TCHDGIGRMTI

SEQ ID NO: 407161 - protein, 11 aa, Influenza virus
HDGVGRMTICI

SEQ ID NO: 407162 - protein, 11 aa, Influenza virus
DGVGRMTICIQ

SEQ ID NO: 407163 - protein, 11 aa, Influenza virus
GVGRMTICIQG

SEQ ID NO: 407164 - protein, 11 aa, Influenza virus
VGRMTICIQGN

SEQ ID NO: 407165 - protein, 11 aa, Influenza virus
GRMTICVQGKN

SEQ ID NO: 407166 - protein, 11 aa, Influenza virus
RMTICIQGNND

SEQ ID NO: 407167 - protein, 11 aa, Influenza virus
MTICIQGNNDN

SEQ ID NO: 407168 - protein, 11 aa, Influenza virus
TICIQGNNDNA

SEQ ID NO: 407169 - protein, 11 aa, Influenza virus
ICIQGNNDNAT

SEQ ID NO: 407170 - protein, 11 aa, Influenza virus
CIQGNNDNATA

SEQ ID NO: 407171 - protein, 11 aa, Influenza virus
IQGNNDNATAT

SEQ ID NO: 407172 - protein, 11 aa, Influenza virus
QGNNKNATATV

SEQ ID NO: 407173 - protein, 11 aa, Influenza virus
GNNKNATATVY

SEQ ID NO: 407174 - protein, 11 aa, Influenza virus
NNKNATATVYY

SEQ ID NO: 407175 - protein, 11 aa, Influenza virus
NDNATATVYYN

SEQ ID NO: 407176 - protein, 11 aa, Influenza virus
DNATATVYYNR

SEQ ID NO: 407177 - protein, 11 aa, Influenza virus
NATATVYYERR

SEQ ID NO: 407178 - protein, 11 aa, Influenza virus
ATATVYYNGRL

SEQ ID NO: 407179 - protein, 11 aa, Influenza virus
TATVYYNRRPT

SEQ ID NO: 407180 - protein, 11 aa, Influenza virus
ATVYYNGRLTT

SEQ ID NO: 407181 - protein, 11 aa, Influenza virus
TVYYNGRLTTT

SEQ ID NO: 407182 - protein, 11 aa, Influenza virus
VYYNGRLTTTI

SEQ ID NO: 407183 - protein, 11 aa, Influenza virus
YYNRRPTTTIK

SEQ ID NO: 407184 - protein, 11 aa, Influenza virus
YNRRLTTTIKT

SEQ ID NO: 407185 - protein, 11 aa, Influenza virus
NRRLTTTIKPW

SEQ ID NO: 407186 - protein, 11 aa, Influenza virus
GRLTTTIKTWA

SEQ ID NO: 407187 - protein, 11 aa, Influenza virus
RLTTTIKPWAR

SEQ ID NO: 407188 - protein, 11 aa, Influenza virus
LTTTIKPWARN

SEQ ID NO: 407189 - protein, 11 aa, Influenza virus
TTTIKPWARNI

SEQ ID NO: 407190 - protein, 11 aa, Influenza virus
TTIKPWARNIL

SEQ ID NO: 407191 - protein, 11 aa, Influenza virus
TIKPWARNILR

SEQ ID NO: 407192 - protein, 11 aa, Influenza virus
IKPWARNILRT

SEQ ID NO: 407193 - protein, 11 aa, Influenza virus
KPWARNILRTQ

SEQ ID NO: 407194 - protein, 11 aa, Influenza virus
PWARNILRTQE

SEQ ID NO: 407195 - protein, 11 aa, Influenza virus
WAGKILRTQES

SEQ ID NO: 407196 - protein, 11 aa, Influenza virus
AGKILRTQESE

SEQ ID NO: 407197 - protein, 11 aa, Influenza virus
GKILRTQESEC

SEQ ID NO: 407198 - protein, 11 aa, Influenza virus
CVCHNGTCAVV

SEQ ID NO: 407199 - protein, 11 aa, Influenza virus
VCHNGTCAVVM

SEQ ID NO: 407200 - protein, 11 aa, Influenza virus
CHNGTCAVVMT

SEQ ID NO: 407201 - protein, 11 aa, Influenza virus
HNGTCAVVMTD

SEQ ID NO: 407202 - protein, 11 aa, Influenza virus
NGTCAVVMTDG

SEQ ID NO: 407203 - protein, 11 aa, Influenza virus
GTCAVVMTDGS

SEQ ID NO: 407204 - protein, 11 aa, Influenza virus
TCAVVMTDGSA

SEQ ID NO: 407205 - protein, 11 aa, Influenza virus
CAVVMTDGSAS

SEQ ID NO: 407206 - protein, 11 aa, Influenza virus
VIMTDGSANSQ

SEQ ID NO: 407207 - protein, 11 aa, Influenza virus
IMTDGPANSQA

SEQ ID NO: 407208 - protein, 11 aa, Influenza virus
MTDGSASGQAY

SEQ ID NO: 407209 - protein, 11 aa, Influenza virus
TDGSASGQAYT

SEQ ID NO: 407210 - protein, 11 aa, Influenza virus
DGSANSQAYTK

SEQ ID NO: 407211 - protein, 11 aa, Influenza virus
QAYTKVMYFHK

SEQ ID NO: 407212 - protein, 11 aa, Influenza virus
AYTKVMYFHKG

SEQ ID NO: 407213 - protein, 11 aa, Influenza virus
YFHKGIVIKEE

SEQ ID NO: 407214 - protein, 11 aa, Influenza virus
KEEVLKGSARH

SEQ ID NO: 407215 - protein, 11 aa, Influenza virus
LQGSARHIEEC

SEQ ID NO: 407216 - protein, 11 aa, Influenza virus
QGSARHIEECS

SEQ ID NO: 407217 - protein, 11 aa, Influenza virus
GSARHVEECSC

SEQ ID NO: 407218 - protein, 11 aa, Influenza virus
SARHVEECSCY

SEQ ID NO: 407219 - protein, 11 aa, Influenza virus
ARHVEECSCYG

SEQ ID NO: 407220 - protein, 11 aa, Influenza virus
RHIEECPCYGH

SEQ ID NO: 407221 - protein, 11 aa, Influenza virus
HIEECSCYGHS

SEQ ID NO: 407222 - protein, 11 aa, Influenza virus
IEECSCYGHNQ

SEQ ID NO: 407223 - protein, 11 aa, Influenza virus
EECSCYGHNQK

SEQ ID NO: 407224 - protein, 11 aa, Influenza virus
QKITCVCRDNW

SEQ ID NO: 407225 - protein, 11 aa, Influenza virus
KVTCICRDNWQ

SEQ ID NO: 407226 - protein, 11 aa, Influenza virus
VTCICRDNWQG

SEQ ID NO: 407227 - protein, 11 aa, Influenza virus
NWQGANRPVIK

SEQ ID NO: 407228 - protein, 11 aa, Influenza virus
WQGANRPVIKI

SEQ ID NO: 407229 - protein, 11 aa, Influenza virus
QGANRPIIEID

SEQ ID NO: 407230 - protein, 11 aa, Influenza virus
GANRPIIEIDM

SEQ ID NO: 407231 - protein, 11 aa, Influenza virus
VMEHTSQYLCT

SEQ ID NO: 407232 - protein, 11 aa, Influenza virus
MDHTSQYLCTG

SEQ ID NO: 407233 - protein, 11 aa, Influenza virus
EHTSQYLCTGI

SEQ ID NO: 407234 - protein, 11 aa, Influenza virus
HTSQYLCTGIL

SEQ ID NO: 407235 - protein, 11 aa, Influenza virus
TSQYLCTGILT

SEQ ID NO: 407236 - protein, 11 aa, Influenza virus
SQYLCTGILTD

SEQ ID NO: 407237 - protein, 11 aa, Influenza virus
QYLCTGILTDT

SEQ ID NO: 407238 - protein, 11 aa, Influenza virus
YLCTGILTDTS

SEQ ID NO: 407239 - protein, 11 aa, Influenza virus
LCTGILTDTSR

SEQ ID NO: 407240 - protein, 11 aa, Influenza virus
TGILTDTSRPS

SEQ ID NO: 407241 - protein, 11 aa, Influenza virus
GILTDTSRPSD

SEQ ID NO: 407242 - protein, 11 aa, Influenza virus
ILTDTSRPSDK

SEQ ID NO: 407243 - protein, 11 aa, Influenza virus
DCSNPITGSPS

SEQ ID NO: 407244 - protein, 11 aa, Influenza virus
CSNPITGSPSA

SEQ ID NO: 407245 - protein, 11 aa, Influenza virus
SNPITGSPSAP

SEQ ID NO: 407246 - protein, 11 aa, Influenza virus
PGVKGFGFLDG

SEQ ID NO: 407247 - protein, 11 aa, Influenza virus
DNTWLGRTISP

SEQ ID NO: 407248 - protein, 11 aa, Influenza virus
NTWLGRTISPH

SEQ ID NO: 407249 - protein, 11 aa, Influenza virus
TWLGRTFSPRS

SEQ ID NO: 407250 - protein, 11 aa, Influenza virus
WLGRTISPHSR

SEQ ID NO: 407251 - protein, 11 aa, Influenza virus
LGGTISPRSRS

SEQ ID NO: 407252 - protein, 11 aa, Influenza virus
GRTFSPRSRSG

SEQ ID NO: 407253 - protein, 11 aa, Influenza virus
GTISPRSRSGF

SEQ ID NO: 407254 - protein, 11 aa, Influenza virus
GFEMLKVPNAG

SEQ ID NO: 407255 - protein, 11 aa, Influenza virus
FEMLKVPNAGT

SEQ ID NO: 407256 - protein, 11 aa, Influenza virus
EMLKVPNAGTD

SEQ ID NO: 407257 - protein, 11 aa, Influenza virus
MLKVPNAGTDP

SEQ ID NO: 407258 - protein, 11 aa, Influenza virus
LKIPNAETDPS

SEQ ID NO: 407259 - protein, 11 aa, Influenza virus
KIPNAETDPSS

SEQ ID NO: 407260 - protein, 11 aa, Influenza virus
NSDWSGYSGSF

SEQ ID NO: 407261 - protein, 11 aa, Influenza virus
NKWSGYSGSFI

SEQ ID NO: 407262 - protein, 11 aa, Influenza virus
KWSGYSGSFID

SEQ ID NO: 407263 - protein, 11 aa, Influenza virus
YSGSFIDYWND

SEQ ID NO: 407264 - protein, 11 aa, Influenza virus
SVCYNPCFYVE

SEQ ID NO: 407265 - protein, 11 aa, Influenza virus
KCYNPCFYVEL

SEQ ID NO: 407266 - protein, 11 aa, Influenza virus
NSLIALCGSPF

SEQ ID NO: 407267 - protein, 11 aa, Influenza virus
SLVALCGSPVP

SEQ ID NO: 407268 - protein, 11 aa, Influenza virus
LVALCGSPVPV

SEQ ID NO: 407269 - protein, 11 aa, Influenza virus
VALCGSPVPVG

SEQ ID NO: 407270 - protein, 11 aa, Influenza virus
ALCGSPVPVGS

SEQ ID NO: 407271 - protein, 11 aa, Influenza virus
LCGSPVPVGSG

SEQ ID NO: 407272 - protein, 11 aa, Influenza virus
CGSPVPVGSGS

SEQ ID NO: 407273 - protein, 11 aa, Influenza virus
GSPVPVGSGSF

SEQ ID NO: 407274 - protein, 11 aa, Influenza virus
SPVPVGSGSFP

SEQ ID NO: 407275 - protein, 11 aa, Influenza virus
PVPVGSGSFPD

SEQ ID NO: 407276 - protein, 11 aa, Influenza virus
VPVGSGSFPDG

SEQ ID NO: 407277 - protein, 11 aa, Influenza virus
VGSGSFPDGAK

SEQ ID NO: 407278 - protein, 11 aa, Influenza virus
GSGSFPNGAQI

SEQ ID NO: 407279 - protein, 11 aa, Influenza virus
SGSFPNGAQIQ

SEQ ID NO: 407280 - protein, 11 aa, Influenza virus
GSFPDGAKIQY

SEQ ID NO: 407281 - protein, 11 aa, Influenza virus
SFPDGARIQYF

SEQ ID NO: 407282 - protein, 11 aa, Influenza virus
FPDGAKIQYFS

SEQ ID NO: 407283 - protein, 11 aa, Influenza virus
RADEICIGYLS

SEQ ID NO: 407284 - protein, 11 aa, Influenza virus
ADEICIGHLSN

SEQ ID NO: 407285 - protein, 11 aa, Influenza virus
DKICIGYLSNN

SEQ ID NO: 407286 - protein, 11 aa, Influenza virus
EICIGHLSNNS

SEQ ID NO: 407287 - protein, 11 aa, Influenza virus
CIGYMSNNSTE

SEQ ID NO: 407288 - protein, 11 aa, Influenza virus
IGYLSNNSTER

SEQ ID NO: 407289 - protein, 11 aa, Influenza virus
GYLSNNSTERV

SEQ ID NO: 407290 - protein, 11 aa, Influenza virus
LSNNSTDKVNT

SEQ ID NO: 407291 - protein, 11 aa, Influenza virus
SNNSTDKVNTI

SEQ ID NO: 407292 - protein, 11 aa, Influenza virus
NNSTDKVNTII

SEQ ID NO: 407293 - protein, 11 aa, Influenza virus
NSTDKVNTIIE

SEQ ID NO: 407294 - protein, 11 aa, Influenza virus
STDKVNTIIEN

SEQ ID NO: 407295 - protein, 11 aa, Influenza virus
TDKVNTIIENN

SEQ ID NO: 407296 - protein, 11 aa, Influenza virus
KVNTIIENNVT

SEQ ID NO: 407297 - protein, 11 aa, Influenza virus
VNTIIENNVTV

SEQ ID NO: 407298 - protein, 11 aa, Influenza virus
NTIIENNVTVT

SEQ ID NO: 407299 - protein, 11 aa, Influenza virus
TIIESNITVTS

SEQ ID NO: 407300 - protein, 11 aa, Influenza virus
IIESNITVTSS

SEQ ID NO: 407301 - protein, 11 aa, Influenza virus
IESNVTVTSSI

SEQ ID NO: 407302 - protein, 11 aa, Influenza virus
ESNVTVTSSIE

SEQ ID NO: 407303 - protein, 11 aa, Influenza virus
SNVTVTSSIEL

SEQ ID NO: 407304 - protein, 11 aa, Influenza virus
NITVTSSVELV

SEQ ID NO: 407305 - protein, 11 aa, Influenza virus
VTVTNSVELVE

SEQ ID NO: 407306 - protein, 11 aa, Influenza virus
TVTSSIELVEN

SEQ ID NO: 407307 - protein, 11 aa, Influenza virus
HTGSFCSLDGK

SEQ ID NO: 407308 - protein, 11 aa, Influenza virus
FCSINGKAPIS

SEQ ID NO: 407309 - protein, 11 aa, Influenza virus
CSINGKAPISL

SEQ ID NO: 407310 - protein, 11 aa, Influenza virus
SINGKAPISLG

SEQ ID NO: 407311 - protein, 11 aa, Influenza virus
NGKAPISLGDC

SEQ ID NO: 407312 - protein, 11 aa, Influenza virus
GKEPISLGDCS

SEQ ID NO: 407313 - protein, 11 aa, Influenza virus
KEPISLGDCSF

SEQ ID NO: 407314 - protein, 11 aa, Influenza virus
APISLGGCSFA

SEQ ID NO: 407315 - protein, 11 aa, Influenza virus
SLGDCSFTGWI

SEQ ID NO: 407316 - protein, 11 aa, Influenza virus
LGGCSFAGWIL

SEQ ID NO: 407317 - protein, 11 aa, Influenza virus
GDCSFAGWLLG

SEQ ID NO: 407318 - protein, 11 aa, Influenza virus
DCSFTGWILGN

SEQ ID NO: 407319 - protein, 11 aa, Influenza virus
SFTGWILGNPM

SEQ ID NO: 407320 - protein, 11 aa, Influenza virus
FTGWILGNPMC

SEQ ID NO: 407321 - protein, 11 aa, Influenza virus
AGWLLGNPMCD

SEQ ID NO: 407322 - protein, 11 aa, Influenza virus
GWILGNPRCDD

SEQ ID NO: 407323 - protein, 11 aa, Influenza virus
WILGNPRCDDL

SEQ ID NO: 407324 - protein, 11 aa, Influenza virus
ILGNPRCDDLI

SEQ ID NO: 407325 - protein, 11 aa, Influenza virus
LGNPRCDDLIG

SEQ ID NO: 407326 - protein, 11 aa, Influenza virus
GNPRCDDLIGK

SEQ ID NO: 407327 - protein, 11 aa, Influenza virus
CDYLIGKTSWS

SEQ ID NO: 407328 - protein, 11 aa, Influenza virus
DNLIGKTSWSY

SEQ ID NO: 407329 - protein, 11 aa, Influenza virus
NLIGKTSWSYI

SEQ ID NO: 407330 - protein, 11 aa, Influenza virus
EKTSWSYIVEK

SEQ ID NO: 407331 - protein, 11 aa, Influenza virus
KTSWSYIVEKS

SEQ ID NO: 407332 - protein, 11 aa, Influenza virus
TSWSYIVEKTN

SEQ ID NO: 407333 - protein, 11 aa, Influenza virus
SWSYIVEKTNP

SEQ ID NO: 407334 - protein, 11 aa, Influenza virus
GQAGRMTFYWA

SEQ ID NO: 407335 - protein, 11 aa, Influenza virus
QAGRMTFYWTM

SEQ ID NO: 407336 - protein, 11 aa, Influenza virus
TFESDGAFLAP

SEQ ID NO: 407337 - protein, 11 aa, Influenza virus
FESDGAFLAPR

SEQ ID NO: 407338 - protein, 11 aa, Influenza virus
ESDGAFLAPRY

SEQ ID NO: 407339 - protein, 11 aa, Influenza virus
NVHRNAIGDCP

SEQ ID NO: 407340 - protein, 11 aa, Influenza virus
VHRNAIGDCPK

SEQ ID NO: 407341 - protein, 11 aa, Influenza virus
HRNTFGDCPKY

SEQ ID NO: 407342 - protein, 11 aa, Influenza virus
RNTFGDCPKYV

SEQ ID NO: 407343 - protein, 11 aa, Influenza virus
NTFGDCPKYVN

SEQ ID NO: 407344 - protein, 11 aa, Influenza virus
TIGDCPKYVNI

SEQ ID NO: 407345 - protein, 11 aa, Influenza virus
IGDCPKYMNVK

SEQ ID NO: 407346 - protein, 11 aa, Influenza virus
GDCPKYMNVKS

SEQ ID NO: 407347 - protein, 11 aa, Influenza virus
DCPKYVNVRSL

SEQ ID NO: 407348 - protein, 11 aa, Influenza virus
CPKYVNVRSLK

SEQ ID NO: 407349 - protein, 11 aa, Influenza virus
PKYMNVKSLKL

SEQ ID NO: 407350 - protein, 11 aa, Influenza virus
KYMNVKSLKLA

SEQ ID NO: 407351 - protein, 11 aa, Influenza virus
RSLKLATGLRN

SEQ ID NO: 407352 - protein, 11 aa, Influenza virus
SLKLATGPRNV

SEQ ID NO: 407353 - protein, 11 aa, Influenza virus
LKLATGPRNVP

SEQ ID NO: 407354 - protein, 11 aa, Influenza virus
KLATGPRNVPA

SEQ ID NO: 407355 - protein, 11 aa, Influenza virus
ARGLFGAIAGF

SEQ ID NO: 407356 - protein, 11 aa, Influenza virus
FQHRNEEGTGV

SEQ ID NO: 407357 - protein, 11 aa, Influenza virus
QHRNEEGTGVA

SEQ ID NO: 407358 - protein, 11 aa, Influenza virus
HRNEEGTGVAA

SEQ ID NO: 407359 - protein, 11 aa, Influenza virus
RNEEGTGVAAD

SEQ ID NO: 407360 - protein, 11 aa, Influenza virus
NEEGTGVAADK

SEQ ID NO: 407361 - protein, 11 aa, Influenza virus
EEGTGVAADKE

SEQ ID NO: 407362 - protein, 11 aa, Influenza virus
GIAADKESTQT

SEQ ID NO: 407363 - protein, 11 aa, Influenza virus
DIWSYNARLLV

SEQ ID NO: 407364 - protein, 11 aa, Influenza virus
IWSYNAKLLVL

SEQ ID NO: 407365 - protein, 11 aa, Influenza virus
WSYNARLLVLL

SEQ ID NO: 407366 - protein, 11 aa, Influenza virus
SYNAKLLVLLE

SEQ ID NO: 407367 - protein, 11 aa, Influenza virus
YNAKLLVLLEN

SEQ ID NO: 407368 - protein, 11 aa, Influenza virus
NARLLVLLENE

SEQ ID NO: 407369 - protein, 11 aa, Influenza virus
ARLLVLLENEK

SEQ ID NO: 407370 - protein, 11 aa, Influenza virus
RLLVLLENEKT

SEQ ID NO: 407371 - protein, 11 aa, Influenza virus
TLDLHDSNVKN

SEQ ID NO: 407372 - protein, 11 aa, Influenza virus
LDLHDSNVTNL

SEQ ID NO: 407373 - protein, 11 aa, Influenza virus
DLHDSNVKNLH

SEQ ID NO: 407374 - protein, 11 aa, Influenza virus
LHDSNVTNLHE

SEQ ID NO: 407375 - protein, 11 aa, Influenza virus
HDSNVRSLHEK

SEQ ID NO: 407376 - protein, 11 aa, Influenza virus
LKGNAKDEGNG

SEQ ID NO: 407377 - protein, 11 aa, Influenza virus
KGNAKDEGNGC

SEQ ID NO: 407378 - protein, 11 aa, Influenza virus
NNAKDEGNGCF

SEQ ID NO: 407379 - protein, 11 aa, Influenza virus
NGCFTFYHRCD

SEQ ID NO: 407380 - protein, 11 aa, Influenza virus
GCFTFYHKCNN

SEQ ID NO: 407381 - protein, 11 aa, Influenza virus
FYHKCDDECIE

SEQ ID NO: 407382 - protein, 11 aa, Influenza virus
NKCIERVRNGT

SEQ ID NO: 407383 - protein, 11 aa, Influenza virus
KCIERVRNGTY

SEQ ID NO: 407384 - protein, 11 aa, Influenza virus
CIEKIRNGTYD

SEQ ID NO: 407385 - protein, 11 aa, Influenza virus
IEKIRNGTYDH

SEQ ID NO: 407386 - protein, 11 aa, Influenza virus
EKIRNGTYDHK

SEQ ID NO: 407387 - protein, 11 aa, Influenza virus
KIRNGTYDHKE

SEQ ID NO: 407388 - protein, 11 aa, Influenza virus
NGTYDHKDFEE

SEQ ID NO: 407389 - protein, 11 aa, Influenza virus
GTYDHKEFKEE

SEQ ID NO: 407390 - protein, 11 aa, Influenza virus
TYDHKEFKEES

SEQ ID NO: 407391 - protein, 11 aa, Influenza virus
YDHKEFKEESK

SEQ ID NO: 407392 - protein, 11 aa, Influenza virus
ESRLNRQEIEG

SEQ ID NO: 407393 - protein, 11 aa, Influenza virus
INRQEIEGVRL

SEQ ID NO: 407394 - protein, 11 aa, Influenza virus
NRQEIEGVKLN

SEQ ID NO: 407395 - protein, 11 aa, Influenza virus
GDVYKILSIYS

SEQ ID NO: 407396 - protein, 11 aa, Influenza virus
DVYKILSIYSC

SEQ ID NO: 407397 - protein, 11 aa, Influenza virus
VYKILSIYSCV

SEQ ID NO: 407398 - protein, 11 aa, Influenza virus
SICSCIASSLV

SEQ ID NO: 407399 - protein, 11 aa, Influenza virus
ICSCIASSLVL

SEQ ID NO: 407400 - protein, 11 aa, Influenza virus
YSCVASSLVLA

SEQ ID NO: 407401 - protein, 11 aa, Influenza virus
CIASSLILAAI

SEQ ID NO: 407402 - protein, 11 aa, Influenza virus
ASSLILAAIIM

SEQ ID NO: 407403 - protein, 11 aa, Influenza virus
SSLILAAIIMG

SEQ ID NO: 407404 - protein, 11 aa, Influenza virus
WACNNGSCRCT

SEQ ID NO: 407405 - protein, 11 aa, Influenza virus
ACNNGSCRCTI

SEQ ID NO: 407406 - protein, 11 aa, Influenza virus
CGNGSCRCTIC

SEQ ID NO: 407407 - protein, 11 aa, Influenza virus
GNGSCRCTICI

SEQ ID NO: 407408 - protein, 11 aa, Influenza virus
VAYDKICIGYQ

SEQ ID NO: 407409 - protein, 11 aa, Influenza virus
NNSTETVNTLS

SEQ ID NO: 407410 - protein, 11 aa, Influenza virus
NSTETVNTLSE

SEQ ID NO: 407411 - protein, 11 aa, Influenza virus
STETVNTLSEQ

SEQ ID NO: 407412 - protein, 11 aa, Influenza virus
TETVNTLSEQN

SEQ ID NO: 407413 - protein, 11 aa, Influenza virus
TVNTLTEQNVP

SEQ ID NO: 407414 - protein, 11 aa, Influenza virus
VNTLTEQNVPV

SEQ ID NO: 407415 - protein, 11 aa, Influenza virus
NTLTEQNVPVT

SEQ ID NO: 407416 - protein, 11 aa, Influenza virus
TLTEQNVPVTQ

SEQ ID NO: 407417 - protein, 11 aa, Influenza virus
LTEQNVPVTQV

SEQ ID NO: 407418 - protein, 11 aa, Influenza virus
TEQNVPVTQVE

SEQ ID NO: 407419 - protein, 11 aa, Influenza virus
VTQVEELVHRG

SEQ ID NO: 407420 - protein, 11 aa, Influenza virus
TQVEELVHGGV

SEQ ID NO: 407421 - protein, 11 aa, Influenza virus
QVEELVHGGVD

SEQ ID NO: 407422 - protein, 11 aa, Influenza virus
VEELVHGGVDP

SEQ ID NO: 407423 - protein, 11 aa, Influenza virus
TKLGSPLVLDD

SEQ ID NO: 407424 - protein, 11 aa, Influenza virus
KLGSPLVLDDC

SEQ ID NO: 407425 - protein, 11 aa, Influenza virus
SPLVLDDCSLK

SEQ ID NO: 407426 - protein, 11 aa, Influenza virus
LVLDDCSLKGL

SEQ ID NO: 407427 - protein, 11 aa, Influenza virus
VLDDCSLEGLV

SEQ ID NO: 407428 - protein, 11 aa, Influenza virus
LDDCSLEGLVL

SEQ ID NO: 407429 - protein, 11 aa, Influenza virus
DDCSLKGLILG

SEQ ID NO: 407430 - protein, 11 aa, Influenza virus
DCSLKGLILGN

SEQ ID NO: 407431 - protein, 11 aa, Influenza virus
CSLEGLVLGNP

SEQ ID NO: 407432 - protein, 11 aa, Influenza virus
SLKGLILGNPK

SEQ ID NO: 407433 - protein, 11 aa, Influenza virus
LEGLVLGNPKC

SEQ ID NO: 407434 - protein, 11 aa, Influenza virus
KGLILGNPKCD

SEQ ID NO: 407435 - protein, 11 aa, Influenza virus
GIILGNPKCDL

SEQ ID NO: 407436 - protein, 11 aa, Influenza virus
IILGNPKCDLY

SEQ ID NO: 407437 - protein, 11 aa, Influenza virus
VLGNPKCDLYL

SEQ ID NO: 407438 - protein, 11 aa, Influenza virus
LSNPKCDLYLN

SEQ ID NO: 407439 - protein, 11 aa, Influenza virus
SNPKCDLYLNG

SEQ ID NO: 407440 - protein, 11 aa, Influenza virus
NPKCDLYLSGR

SEQ ID NO: 407441 - protein, 11 aa, Influenza virus
PKCDLYLSGRE

SEQ ID NO: 407442 - protein, 11 aa, Influenza virus
KCDLYLSGREW

SEQ ID NO: 407443 - protein, 11 aa, Influenza virus
CDLYLSGREWS

SEQ ID NO: 407444 - protein, 11 aa, Influenza virus
DLYLSGREWSY

SEQ ID NO: 407445 - protein, 11 aa, Influenza virus
LYLSGREWSYI

SEQ ID NO: 407446 - protein, 11 aa, Influenza virus
WSYIVERPKEI

SEQ ID NO: 407447 - protein, 11 aa, Influenza virus
SYIVERPKEIE

SEQ ID NO: 407448 - protein, 11 aa, Influenza virus
YIVERPKEIEG

SEQ ID NO: 407449 - protein, 11 aa, Influenza virus
IVERTKEMEGI

SEQ ID NO: 407450 - protein, 11 aa, Influenza virus
VERTKEMEGIC

SEQ ID NO: 407451 - protein, 11 aa, Influenza virus
ERTKEMEGICY

SEQ ID NO: 407452 - protein, 11 aa, Influenza virus
RTKEMEGICYP

SEQ ID NO: 407453 - protein, 11 aa, Influenza virus
TKEMEGICYPG

SEQ ID NO: 407454 - protein, 11 aa, Influenza virus
KEIEGICYPGS

SEQ ID NO: 407455 - protein, 11 aa, Influenza virus
EIEGICYPGSI

SEQ ID NO: 407456 - protein, 11 aa, Influenza virus
MEGVCYPGSIK

SEQ ID NO: 407457 - protein, 11 aa, Influenza virus
EGICYPGSVEN

SEQ ID NO: 407458 - protein, 11 aa, Influenza virus
GICYPGSVENQ

SEQ ID NO: 407459 - protein, 11 aa, Influenza virus
ICYPGSVENQE

SEQ ID NO: 407460 - protein, 11 aa, Influenza virus
CYPGSVENQEE

SEQ ID NO: 407461 - protein, 11 aa, Influenza virus
YPGSVENQEEL

SEQ ID NO: 407462 - protein, 11 aa, Influenza virus
PGSIENQEELK

SEQ ID NO: 407463 - protein, 11 aa, Influenza virus
GSVENQEELRS

SEQ ID NO: 407464 - protein, 11 aa, Influenza virus
SIKNQEELRSL

SEQ ID NO: 407465 - protein, 11 aa, Influenza virus
IENQEELKSLF

SEQ ID NO: 407466 - protein, 11 aa, Influenza virus
KNQEELRSLFS

SEQ ID NO: 407467 - protein, 11 aa, Influenza virus
NQEELKSLFSS

SEQ ID NO: 407468 - protein, 11 aa, Influenza virus
QEELKSLFSSI

SEQ ID NO: 407469 - protein, 11 aa, Influenza virus
EELKSLFSSIK

SEQ ID NO: 407470 - protein, 11 aa, Influenza virus
ELKSLFSSIKK

SEQ ID NO: 407471 - protein, 11 aa, Influenza virus
LKSLFSSIKKY

SEQ ID NO: 407472 - protein, 11 aa, Influenza virus
KSLFSSIKKYE

SEQ ID NO: 407473 - protein, 11 aa, Influenza virus
SLFSSIKRYER

SEQ ID NO: 407474 - protein, 11 aa, Influenza virus
KYERVKMFDFI

SEQ ID NO: 407475 - protein, 11 aa, Influenza virus
YERVKMFDFIK

SEQ ID NO: 407476 - protein, 11 aa, Influenza virus
ERVKMFDFIKW

SEQ ID NO: 407477 - protein, 11 aa, Influenza virus
RVKMFDFIKWN

SEQ ID NO: 407478 - protein, 11 aa, Influenza virus
VKMFDFIKWNV

SEQ ID NO: 407479 - protein, 11 aa, Influenza virus
KMFDFIKWNVT

SEQ ID NO: 407480 - protein, 11 aa, Influenza virus
MFDFTKWNVTH

SEQ ID NO: 407481 - protein, 11 aa, Influenza virus
FDFTKWNVTHT

SEQ ID NO: 407482 - protein, 11 aa, Influenza virus
DFTKWNVTHTG

SEQ ID NO: 407483 - protein, 11 aa, Influenza virus
FSKWNVTYTGT

SEQ ID NO: 407484 - protein, 11 aa, Influenza virus
SKWNVTYTGTS

SEQ ID NO: 407485 - protein, 11 aa, Influenza virus
KWNVTYTGISK

SEQ ID NO: 407486 - protein, 11 aa, Influenza virus
WNVTYTGISKA

SEQ ID NO: 407487 - protein, 11 aa, Influenza virus
NVTYTGISKAC

SEQ ID NO: 407488 - protein, 11 aa, Influenza virus
VTYTGISKACN

SEQ ID NO: 407489 - protein, 11 aa, Influenza virus
SNQGSFYRSIR

SEQ ID NO: 407490 - protein, 11 aa, Influenza virus
NQGSFYRSIRW

SEQ ID NO: 407491 - protein, 11 aa, Influenza virus
RGSFYRSMRWL

SEQ ID NO: 407492 - protein, 11 aa, Influenza virus
GSFYRNMRWLT

SEQ ID NO: 407493 - protein, 11 aa, Influenza virus
SFYRSIRWLTL

SEQ ID NO: 407494 - protein, 11 aa, Influenza virus
FYRSIRWLTLK

SEQ ID NO: 407495 - protein, 11 aa, Influenza virus
YRNMRWLTLKS

SEQ ID NO: 407496 - protein, 11 aa, Influenza virus
IRWLTLKSGQF

SEQ ID NO: 407497 - protein, 11 aa, Influenza virus
RWLTLKLGQFP

SEQ ID NO: 407498 - protein, 11 aa, Influenza virus
WLTLKLGQFPV

SEQ ID NO: 407499 - protein, 11 aa, Influenza virus
LTLKLGQFPVQ

SEQ ID NO: 407500 - protein, 11 aa, Influenza virus
TLKLGQFPVQT

SEQ ID NO: 407501 - protein, 11 aa, Influenza virus
LKLGQFPVQTD

SEQ ID NO: 407502 - protein, 11 aa, Influenza virus
KLGQFPVQTDE

SEQ ID NO: 407503 - protein, 11 aa, Influenza virus
LGQFPVQTDEY

SEQ ID NO: 407504 - protein, 11 aa, Influenza virus
TDEYKNTRDSN

SEQ ID NO: 407505 - protein, 11 aa, Influenza virus
DEYKNTRDSNI

SEQ ID NO: 407506 - protein, 11 aa, Influenza virus
FMWAIHHPPTS

SEQ ID NO: 407507 - protein, 11 aa, Influenza virus
WAIHHPPTTDE

SEQ ID NO: 407508 - protein, 11 aa, Influenza virus
AIHHPPTTDEQ

SEQ ID NO: 407509 - protein, 11 aa, Influenza virus
IHHPPTSDEQI

SEQ ID NO: 407510 - protein, 11 aa, Influenza virus
EINRIFRPNIG

SEQ ID NO: 407511 - protein, 11 aa, Influenza virus
INRIFRPNIGP

SEQ ID NO: 407512 - protein, 11 aa, Influenza virus
NRIFRPNIGPR

SEQ ID NO: 407513 - protein, 11 aa, Influenza virus
RIFRPNIGPRP

SEQ ID NO: 407514 - protein, 11 aa, Influenza virus
SFRPNIGPRPL

SEQ ID NO: 407515 - protein, 11 aa, Influenza virus
FRPNIGPRPLV

SEQ ID NO: 407516 - protein, 11 aa, Influenza virus
RPNIGPRPLVR

SEQ ID NO: 407517 - protein, 11 aa, Influenza virus
PNIGPRPLVRE

SEQ ID NO: 407518 - protein, 11 aa, Influenza virus
NIGPRPLVREQ

SEQ ID NO: 407519 - protein, 11 aa, Influenza virus
IGPRPLVREQQ

SEQ ID NO: 407520 - protein, 11 aa, Influenza virus
GPRPLVREQQG

SEQ ID NO: 407521 - protein, 11 aa, Influenza virus
PRPLVREQQGR

SEQ ID NO: 407522 - protein, 11 aa, Influenza virus
RPLVREQQGRM

SEQ ID NO: 407523 - protein, 11 aa, Influenza virus
PLVREQQGRMD

SEQ ID NO: 407524 - protein, 11 aa, Influenza virus
LVREQQGRMDY

SEQ ID NO: 407525 - protein, 11 aa, Influenza virus
IRGQQGRMDYY

SEQ ID NO: 407526 - protein, 11 aa, Influenza virus
MGQQGRMDYYW

SEQ ID NO: 407527 - protein, 11 aa, Influenza virus
VLKPGQTVKIK

SEQ ID NO: 407528 - protein, 11 aa, Influenza virus
KPGQTVKIKTN

SEQ ID NO: 407529 - protein, 11 aa, Influenza virus
PGQTVKIQTSG

SEQ ID NO: 407530 - protein, 11 aa, Influenza virus
GQTVKIQTSGN

SEQ ID NO: 407531 - protein, 11 aa, Influenza virus
QTVKIKTNGNL

SEQ ID NO: 407532 - protein, 11 aa, Influenza virus
TVKIQTSGNLI

SEQ ID NO: 407533 - protein, 11 aa, Influenza virus
VKIQTSGNLIA

SEQ ID NO: 407534 - protein, 11 aa, Influenza virus
KIQTSGNLIAP

SEQ ID NO: 407535 - protein, 11 aa, Influenza virus
IKTNGNLIAPE

SEQ ID NO: 407536 - protein, 11 aa, Influenza virus
KTNGNLIAPEY

SEQ ID NO: 407537 - protein, 11 aa, Influenza virus
NGNLIAPEYGY

SEQ ID NO: 407538 - protein, 11 aa, Influenza virus
NLIAPEYGYLI

SEQ ID NO: 407539 - protein, 11 aa, Influenza virus
LIAPEYGHLTT

SEQ ID NO: 407540 - protein, 11 aa, Influenza virus
IAPEYGHLTTG

SEQ ID NO: 407541 - protein, 11 aa, Influenza virus
APEYGHLTTGK

SEQ ID NO: 407542 - protein, 11 aa, Influenza virus
PEYGHLTTGKS

SEQ ID NO: 407543 - protein, 11 aa, Influenza virus
EYGYLITGKSH

SEQ ID NO: 407544 - protein, 11 aa, Influenza virus
YGHLTTGKSHG

SEQ ID NO: 407545 - protein, 11 aa, Influenza virus
GHLTTGKSHGR

SEQ ID NO: 407546 - protein, 11 aa, Influenza virus
HLVTGKSHGRI

SEQ ID NO: 407547 - protein, 11 aa, Influenza virus
LITGKSHGRVL

SEQ ID NO: 407548 - protein, 11 aa, Influenza virus
ITGKSHGRVLK

SEQ ID NO: 407549 - protein, 11 aa, Influenza virus
GKSHGRVLKNN

SEQ ID NO: 407550 - protein, 11 aa, Influenza virus
KSHGRVLKNNL

SEQ ID NO: 407551 - protein, 11 aa, Influenza virus
SHGRVLKNNLP

SEQ ID NO: 407552 - protein, 11 aa, Influenza virus
TGCQLNEGVMN

SEQ ID NO: 407553 - protein, 11 aa, Influenza virus
KCQLNEGVMNT

SEQ ID NO: 407554 - protein, 11 aa, Influenza virus
CQLNEGVINTS

SEQ ID NO: 407555 - protein, 11 aa, Influenza virus
QLNEGIMNTSK

SEQ ID NO: 407556 - protein, 11 aa, Influenza virus
LNEGIMNTSKP

SEQ ID NO: 407557 - protein, 11 aa, Influenza virus
NEGVMNTSKPL

SEQ ID NO: 407558 - protein, 11 aa, Influenza virus
EGIMNTSKPFQ

SEQ ID NO: 407559 - protein, 11 aa, Influenza virus
GVMNTSKPLQN

SEQ ID NO: 407560 - protein, 11 aa, Influenza virus
IMNTSKPFQNT

SEQ ID NO: 407561 - protein, 11 aa, Influenza virus
INTSKPFQNTS

SEQ ID NO: 407562 - protein, 11 aa, Influenza virus
NTSKPLQNTSK

SEQ ID NO: 407563 - protein, 11 aa, Influenza virus
TSKPFQNTSRH

SEQ ID NO: 407564 - protein, 11 aa, Influenza virus
SKPLQNTSKHY

SEQ ID NO: 407565 - protein, 11 aa, Influenza virus
KPFQNTSRHYI

SEQ ID NO: 407566 - protein, 11 aa, Influenza virus
PFQNTSRHYIG

SEQ ID NO: 407567 - protein, 11 aa, Influenza virus
LQNTSKHYIGK

SEQ ID NO: 407568 - protein, 11 aa, Influenza virus
QNICKPYIGKC

SEQ ID NO: 407569 - protein, 11 aa, Influenza virus
NTSRHYIGKCP

SEQ ID NO: 407570 - protein, 11 aa, Influenza virus
ICKPYIGKCPK

SEQ ID NO: 407571 - protein, 11 aa, Influenza virus
CKPYIGKCPKY

SEQ ID NO: 407572 - protein, 11 aa, Influenza virus
KPYIGKCPKYI

SEQ ID NO: 407573 - protein, 11 aa, Influenza virus
HYIGKCPKYIS

SEQ ID NO: 407574 - protein, 11 aa, Influenza virus
YIGKCPKYISS

SEQ ID NO: 407575 - protein, 11 aa, Influenza virus
IGKCPRYIPSG

SEQ ID NO: 407576 - protein, 11 aa, Influenza virus
GKCPRYIPSGS

SEQ ID NO: 407577 - protein, 11 aa, Influenza virus
KCPRYIPSGSL

SEQ ID NO: 407578 - protein, 11 aa, Influenza virus
CPRYIPSGSLK

SEQ ID NO: 407579 - protein, 11 aa, Influenza virus
PRYIPSGSLKL

SEQ ID NO: 407580 - protein, 11 aa, Influenza virus
RYIPSGSLKLA

SEQ ID NO: 407581 - protein, 11 aa, Influenza virus
YIPSRSLKLAI

SEQ ID NO: 407582 - protein, 11 aa, Influenza virus
ISSGSLKLAIG

SEQ ID NO: 407583 - protein, 11 aa, Influenza virus
PSGSLKLAIGP

SEQ ID NO: 407584 - protein, 11 aa, Influenza virus
SGSLKLAIGPR

SEQ ID NO: 407585 - protein, 11 aa, Influenza virus
GSLKLAIGPRN

SEQ ID NO: 407586 - protein, 11 aa, Influenza virus
LAIGPRNVPQV

SEQ ID NO: 407587 - protein, 11 aa, Influenza virus
AIGPRNVPQVQ

SEQ ID NO: 407588 - protein, 11 aa, Influenza virus
RNVPQAQNRGL

SEQ ID NO: 407589 - protein, 11 aa, Influenza virus
NVPQAQNRGLF

SEQ ID NO: 407590 - protein, 11 aa, Influenza virus
VPQAQNRGLFG

SEQ ID NO: 407591 - protein, 11 aa, Influenza virus
PQAQNRGLFGA

SEQ ID NO: 407592 - protein, 11 aa, Influenza virus
QNRGLFGAKAG

SEQ ID NO: 407593 - protein, 11 aa, Influenza virus
NRGLFGAKAGF

SEQ ID NO: 407594 - protein, 11 aa, Influenza virus
FGAIAGFIEGR

SEQ ID NO: 407595 - protein, 11 aa, Influenza virus
GAIAGFIEGRW

SEQ ID NO: 407596 - protein, 11 aa, Influenza virus
AIAGFIEGRWP

SEQ ID NO: 407597 - protein, 11 aa, Influenza virus
IAGFIEGRWPG

SEQ ID NO: 407598 - protein, 11 aa, Influenza virus
YGFQHQNAEGI

SEQ ID NO: 407599 - protein, 11 aa, Influenza virus
GFQHQNAEGIG

SEQ ID NO: 407600 - protein, 11 aa, Influenza virus
FQHQNSEGTGI

SEQ ID NO: 407601 - protein, 11 aa, Influenza virus
QHQNSEGTGIA

SEQ ID NO: 407602 - protein, 11 aa, Influenza virus
HQNSEGTGIAA

SEQ ID NO: 407603 - protein, 11 aa, Influenza virus
QNSEGTGIAAD

SEQ ID NO: 407604 - protein, 11 aa, Influenza virus
NSEGTGIAADR

SEQ ID NO: 407605 - protein, 11 aa, Influenza virus
EGTGIVADRDS

SEQ ID NO: 407606 - protein, 11 aa, Influenza virus
GTGIAADRGST

SEQ ID NO: 407607 - protein, 11 aa, Influenza virus
TGIVADRDSTQ

SEQ ID NO: 407608 - protein, 11 aa, Influenza virus
AADRDSTQMAI

SEQ ID NO: 407609 - protein, 11 aa, Influenza virus
ADRDSTQMAID

SEQ ID NO: 407610 - protein, 11 aa, Influenza virus
DRDSTQMAIDN

SEQ ID NO: 407611 - protein, 11 aa, Influenza virus
RDSTQMAIDNM

SEQ ID NO: 407612 - protein, 11 aa, Influenza virus
DSTQMAIDNMQ

SEQ ID NO: 407613 - protein, 11 aa, Influenza virus
STQMAIDNMQN

SEQ ID NO: 407614 - protein, 11 aa, Influenza virus
TQMAIDNMQNK

SEQ ID NO: 407615 - protein, 11 aa, Influenza virus
QMAIDNMQNKL

SEQ ID NO: 407616 - protein, 11 aa, Influenza virus
MAIDNMQNKLN

SEQ ID NO: 407617 - protein, 11 aa, Influenza virus
AIDNMQNRLNN

SEQ ID NO: 407618 - protein, 11 aa, Influenza virus
IDNMQNRLNNV

SEQ ID NO: 407619 - protein, 11 aa, Influenza virus
DIMQNKLNNVI

SEQ ID NO: 407620 - protein, 11 aa, Influenza virus
NMQNRLNNVID

SEQ ID NO: 407621 - protein, 11 aa, Influenza virus
NRLNNVIDKMN

SEQ ID NO: 407622 - protein, 11 aa, Influenza virus
RLNNVIDKMNK

SEQ ID NO: 407623 - protein, 11 aa, Influenza virus
LNNVIDKMNNQ

SEQ ID NO: 407624 - protein, 11 aa, Influenza virus
NNVIDKMNNQF

SEQ ID NO: 407625 - protein, 11 aa, Influenza virus
RINMINSQIDD

SEQ ID NO: 407626 - protein, 11 aa, Influenza virus
INMINSQIDDQ

SEQ ID NO: 407627 - protein, 11 aa, Influenza virus
IDDQIIDIWAY

SEQ ID NO: 407628 - protein, 11 aa, Influenza virus
DDQIIDIWAYN

SEQ ID NO: 407629 - protein, 11 aa, Influenza virus
DQIIDIWAYNA

SEQ ID NO: 407630 - protein, 11 aa, Influenza virus
QIIDIWAYNAE

SEQ ID NO: 407631 - protein, 11 aa, Influenza virus
IIDIWAYNAEL

SEQ ID NO: 407632 - protein, 11 aa, Influenza virus
IDIWAYNAELL

SEQ ID NO: 407633 - protein, 11 aa, Influenza virus
DANVRNLHDRT

SEQ ID NO: 407634 - protein, 11 aa, Influenza virus
ANVRNLHDRVK

SEQ ID NO: 407635 - protein, 11 aa, Influenza virus
NVRNLHDRVKR

SEQ ID NO: 407636 - protein, 11 aa, Influenza virus
ENALDTGDGCF

SEQ ID NO: 407637 - protein, 11 aa, Influenza virus
NAIDAGDGCFE

SEQ ID NO: 407638 - protein, 11 aa, Influenza virus
ALDTGDGCFEI

SEQ ID NO: 407639 - protein, 11 aa, Influenza virus
VDTGDGCFEIL

SEQ ID NO: 407640 - protein, 11 aa, Influenza virus
DNGDGCFEILH

SEQ ID NO: 407641 - protein, 11 aa, Influenza virus
AGDGCFEILHK

SEQ ID NO: 407642 - protein, 11 aa, Influenza virus
DGCFEILHRCN

SEQ ID NO: 407643 - protein, 11 aa, Influenza virus
GCFEILHRCDD

SEQ ID NO: 407644 - protein, 11 aa, Influenza virus
YEEESKLERQR

SEQ ID NO: 407645 - protein, 11 aa, Influenza virus
ERQKVNGVKLE

SEQ ID NO: 407646 - protein, 11 aa, Influenza virus
RQRINGVKLEE

SEQ ID NO: 407647 - protein, 11 aa, Influenza virus
QRINGVKLEEN

SEQ ID NO: 407648 - protein, 11 aa, Influenza virus
KVNGVKLEENS

SEQ ID NO: 407649 - protein, 11 aa, Influenza virus
ISGVKLEENST

SEQ ID NO: 407650 - protein, 11 aa, Influenza virus
ADKICVGYLST

SEQ ID NO: 407651 - protein, 11 aa, Influenza virus
DKICVGYLSTN

SEQ ID NO: 407652 - protein, 11 aa, Influenza virus
RICIGYLSTNS

SEQ ID NO: 407653 - protein, 11 aa, Influenza virus
ICIGYLSTNSS

SEQ ID NO: 407654 - protein, 11 aa, Influenza virus
CVGYLSTNSSD

SEQ ID NO: 407655 - protein, 11 aa, Influenza virus
VGYLSTNSTEK

SEQ ID NO: 407656 - protein, 11 aa, Influenza virus
GYLSTNSTEKV

SEQ ID NO: 407657 - protein, 11 aa, Influenza virus
YLSTNSTEKVD

SEQ ID NO: 407658 - protein, 11 aa, Influenza virus
LSTNSTEKVDT

SEQ ID NO: 407659 - protein, 11 aa, Influenza virus
STNSTEKVDTL

SEQ ID NO: 407660 - protein, 11 aa, Influenza virus
TNSTEKVDTLL

SEQ ID NO: 407661 - protein, 11 aa, Influenza virus
NSTEKVDTLLE

SEQ ID NO: 407662 - protein, 11 aa, Influenza virus
VDTLLENNVPV

SEQ ID NO: 407663 - protein, 11 aa, Influenza virus
DTLLENNVPVT

SEQ ID NO: 407664 - protein, 11 aa, Influenza virus
TLLENNVPVTS

SEQ ID NO: 407665 - protein, 11 aa, Influenza virus
LLENNVPVTSS

SEQ ID NO: 407666 - protein, 11 aa, Influenza virus
VPVTSSIDLIE

SEQ ID NO: 407667 - protein, 11 aa, Influenza virus
PVTSSIDLIET

SEQ ID NO: 407668 - protein, 11 aa, Influenza virus
DLVETSHTGTY

SEQ ID NO: 407669 - protein, 11 aa, Influenza virus
LVETSHTGTYC

SEQ ID NO: 407670 - protein, 11 aa, Influenza virus
VETSHTGTYCS

SEQ ID NO: 407671 - protein, 11 aa, Influenza virus
ETTHTGTYCSL

SEQ ID NO: 407672 - protein, 11 aa, Influenza virus
GVSPVHLGDCR

SEQ ID NO: 407673 - protein, 11 aa, Influenza virus
VSPVHLGDCRF

SEQ ID NO: 407674 - protein, 11 aa, Influenza virus
SPVHLGDCNFE

SEQ ID NO: 407675 - protein, 11 aa, Influenza virus
PVHLGDCNFEG

SEQ ID NO: 407676 - protein, 11 aa, Influenza virus
VHLGDCNFEGW

SEQ ID NO: 407677 - protein, 11 aa, Influenza virus
HLGDCNFEGWI

SEQ ID NO: 407678 - protein, 11 aa, Influenza virus
LGDCNFEGWIV

SEQ ID NO: 407679 - protein, 11 aa, Influenza virus
GDCNFEGWIVG

SEQ ID NO: 407680 - protein, 11 aa, Influenza virus
DCNFEGWIVGN

SEQ ID NO: 407681 - protein, 11 aa, Influenza virus
CSFEGWIGGNP

SEQ ID NO: 407682 - protein, 11 aa, Influenza virus
RFEGWIVGNPA

SEQ ID NO: 407683 - protein, 11 aa, Influenza virus
FEGWIGGNPAC

SEQ ID NO: 407684 - protein, 11 aa, Influenza virus
GTREWSYLIED

SEQ ID NO: 407685 - protein, 11 aa, Influenza virus
VREWSYLIEDP

SEQ ID NO: 407686 - protein, 11 aa, Influenza virus
REWSYLIEDPA

SEQ ID NO: 407687 - protein, 11 aa, Influenza virus
EWSYLIEDPTA

SEQ ID NO: 407688 - protein, 11 aa, Influenza virus
WSYLIEDPTAP

SEQ ID NO: 407689 - protein, 11 aa, Influenza virus
SYLIEDPTAPH

SEQ ID NO: 407690 - protein, 11 aa, Influenza virus
YLIEDPTAPHG

SEQ ID NO: 407691 - protein, 11 aa, Influenza virus
LIEDPAAPHGL

SEQ ID NO: 407692 - protein, 11 aa, Influenza virus
IEDPTAPHGLC

SEQ ID NO: 407693 - protein, 11 aa, Influenza virus
EDPTAPHGLCY

SEQ ID NO: 407694 - protein, 11 aa, Influenza virus
DPAAPHGLCYP

SEQ ID NO: 407695 - protein, 11 aa, Influenza virus
PTAPHGLCYPG

SEQ ID NO: 407696 - protein, 11 aa, Influenza virus
AAPHGLCYPGE

SEQ ID NO: 407697 - protein, 11 aa, Influenza virus
PHRLCYPGELD

SEQ ID NO: 407698 - protein, 11 aa, Influenza virus
HRLCYPGELDN

SEQ ID NO: 407699 - protein, 11 aa, Influenza virus
RLCYPGELDNN

SEQ ID NO: 407700 - protein, 11 aa, Influenza virus
FSGIKSFSRTQ

SEQ ID NO: 407701 - protein, 11 aa, Influenza virus
SGIKSFSRTQL

SEQ ID NO: 407702 - protein, 11 aa, Influenza virus
GIKSFSRTQLI

SEQ ID NO: 407703 - protein, 11 aa, Influenza virus
IKSFSRTELIA

SEQ ID NO: 407704 - protein, 11 aa, Influenza virus
KSFSRTELIAP

SEQ ID NO: 407705 - protein, 11 aa, Influenza virus
RTYNNTTGRDV

SEQ ID NO: 407706 - protein, 11 aa, Influenza virus
VYNNTTGRDVL

SEQ ID NO: 407707 - protein, 11 aa, Influenza virus
NNTTGRDVLVI

SEQ ID NO: 407708 - protein, 11 aa, Influenza virus
NTTGRDVLVIW

SEQ ID NO: 407709 - protein, 11 aa, Influenza virus
TTGRDVLVIWG

SEQ ID NO: 407710 - protein, 11 aa, Influenza virus
TGRDVLVIWGI

SEQ ID NO: 407711 - protein, 11 aa, Influenza virus
GRDVLVIWGIH

SEQ ID NO: 407712 - protein, 11 aa, Influenza virus
RDVLVIWGIHH

SEQ ID NO: 407713 - protein, 11 aa, Influenza virus
DVLVIWGIHHP

SEQ ID NO: 407714 - protein, 11 aa, Influenza virus
PYTLVSTGSWS

SEQ ID NO: 407715 - protein, 11 aa, Influenza virus
GVRPGYNGQKS

SEQ ID NO: 407716 - protein, 11 aa, Influenza virus
VRPGYNGQKSW

SEQ ID NO: 407717 - protein, 11 aa, Influenza virus
RPGYNGQKSWT

SEQ ID NO: 407718 - protein, 11 aa, Influenza virus
PRYNGQRSWMK

SEQ ID NO: 407719 - protein, 11 aa, Influenza virus
RYNGQRSWMKI

SEQ ID NO: 407720 - protein, 11 aa, Influenza virus
YNGQKSWTKIY

SEQ ID NO: 407721 - protein, 11 aa, Influenza virus
NGQKSWTKIYW

SEQ ID NO: 407722 - protein, 11 aa, Influenza virus
ITFESNGGFLA

SEQ ID NO: 407723 - protein, 11 aa, Influenza virus
TFESNGGFLAP

SEQ ID NO: 407724 - protein, 11 aa, Influenza virus
FESNGGFLAPR

SEQ ID NO: 407725 - protein, 11 aa, Influenza virus
ESNGGFLAPRY

SEQ ID NO: 407726 - protein, 11 aa, Influenza virus
SNGGFLAPRYG

SEQ ID NO: 407727 - protein, 11 aa, Influenza virus
NGGFLAPRYGY

SEQ ID NO: 407728 - protein, 11 aa, Influenza virus
GGFLAPRYGYI

SEQ ID NO: 407729 - protein, 11 aa, Influenza virus
GFLAPRYGYII

SEQ ID NO: 407730 - protein, 11 aa, Influenza virus
FLAPRYGYIIE

SEQ ID NO: 407731 - protein, 11 aa, Influenza virus
RYGYIIEEYGR

SEQ ID NO: 407732 - protein, 11 aa, Influenza virus
EYGKGRIFQSH

SEQ ID NO: 407733 - protein, 11 aa, Influenza virus
YGKGRIFQSHI

SEQ ID NO: 407734 - protein, 11 aa, Influenza virus
GKGRIFQSHIR

SEQ ID NO: 407735 - protein, 11 aa, Influenza virus
RCNTRCQTSVG

SEQ ID NO: 407736 - protein, 11 aa, Influenza virus
TKCQTSVGGID

SEQ ID NO: 407737 - protein, 11 aa, Influenza virus
KCQTSVGGIDT

SEQ ID NO: 407738 - protein, 11 aa, Influenza virus
QTSVGGIDTNK

SEQ ID NO: 407739 - protein, 11 aa, Influenza virus
TSVGGIDTNKT

SEQ ID NO: 407740 - protein, 11 aa, Influenza virus
SVGGIDTNKTF

SEQ ID NO: 407741 - protein, 11 aa, Influenza virus
VGGIDTNKTFQ

SEQ ID NO: 407742 - protein, 11 aa, Influenza virus
GGIDTNKTFQN

SEQ ID NO: 407743 - protein, 11 aa, Influenza virus
GIDTNKTFQNI

SEQ ID NO: 407744 - protein, 11 aa, Influenza virus
IDTNKTFQNID

SEQ ID NO: 407745 - protein, 11 aa, Influenza virus
NTNRTFQNIDR

SEQ ID NO: 407746 - protein, 11 aa, Influenza virus
TNRTFQNIDRN

SEQ ID NO: 407747 - protein, 11 aa, Influenza virus
NRTFQNIDRNA

SEQ ID NO: 407748 - protein, 11 aa, Influenza virus
RTFQNIDRNAL

SEQ ID NO: 407749 - protein, 11 aa, Influenza virus
TFQNIDRNALG

SEQ ID NO: 407750 - protein, 11 aa, Influenza virus
FQNIERNALGN

SEQ ID NO: 407751 - protein, 11 aa, Influenza virus
QNIERNALGNC

SEQ ID NO: 407752 - protein, 11 aa, Influenza virus
NIERNALGNCP

SEQ ID NO: 407753 - protein, 11 aa, Influenza virus
IERNALGNCPK

SEQ ID NO: 407754 - protein, 11 aa, Influenza virus
ERNALGNCPKY

SEQ ID NO: 407755 - protein, 11 aa, Influenza virus
RNALGNCPKYI

SEQ ID NO: 407756 - protein, 11 aa, Influenza virus
NALGECPKYIK

SEQ ID NO: 407757 - protein, 11 aa, Influenza virus
ALGECPKYIKS

SEQ ID NO: 407758 - protein, 11 aa, Influenza virus
LGECPKYIKSD

SEQ ID NO: 407759 - protein, 11 aa, Influenza virus
GECPKYIKSDQ

SEQ ID NO: 407760 - protein, 11 aa, Influenza virus
ECPKYIKSDQL

SEQ ID NO: 407761 - protein, 11 aa, Influenza virus
SGQLKLATGLK

SEQ ID NO: 407762 - protein, 11 aa, Influenza virus
GQLKLATGLKN

SEQ ID NO: 407763 - protein, 11 aa, Influenza virus
QLKLATGLKNV

SEQ ID NO: 407764 - protein, 11 aa, Influenza virus
LKLATGLKNVP

SEQ ID NO: 407765 - protein, 11 aa, Influenza virus
KLATGLRNIPA

SEQ ID NO: 407766 - protein, 11 aa, Influenza virus
RGLLGAIAGFI

SEQ ID NO: 407767 - protein, 11 aa, Influenza virus
GFFGAIAGFIE

SEQ ID NO: 407768 - protein, 11 aa, Influenza virus
LLGAIAGFIEG

SEQ ID NO: 407769 - protein, 11 aa, Influenza virus
LGAIAGFIEGG

SEQ ID NO: 407770 - protein, 11 aa, Influenza virus
YGFQHQNEQGM

SEQ ID NO: 407771 - protein, 11 aa, Influenza virus
GFQHQNEQGMG

SEQ ID NO: 407772 - protein, 11 aa, Influenza virus
FQHQNEQGVGI

SEQ ID NO: 407773 - protein, 11 aa, Influenza virus
QHQNEQGVGIA

SEQ ID NO: 407774 - protein, 11 aa, Influenza virus
HQNEQGVGIAA

SEQ ID NO: 407775 - protein, 11 aa, Influenza virus
QNEQGVGIAAD

SEQ ID NO: 407776 - protein, 11 aa, Influenza virus
NEQGVGIAADK

SEQ ID NO: 407777 - protein, 11 aa, Influenza virus
EQGVGIAADKE

SEQ ID NO: 407778 - protein, 11 aa, Influenza virus
QGVGIAADKES

SEQ ID NO: 407779 - protein, 11 aa, Influenza virus
GVGIAADKEST

SEQ ID NO: 407780 - protein, 11 aa, Influenza virus
VGIAADKESTQ

SEQ ID NO: 407781 - protein, 11 aa, Influenza virus
GIAAEKESTQK

SEQ ID NO: 407782 - protein, 11 aa, Influenza virus
IAAEKESTQKA

SEQ ID NO: 407783 - protein, 11 aa, Influenza virus
DKESTQKAIDR

SEQ ID NO: 407784 - protein, 11 aa, Influenza virus
RITTKINNIIE

SEQ ID NO: 407785 - protein, 11 aa, Influenza virus
SIRGEFNQVEN

SEQ ID NO: 407786 - protein, 11 aa, Influenza virus
IRGEFNQVENR

SEQ ID NO: 407787 - protein, 11 aa, Influenza virus
RGEFNQVENRI

SEQ ID NO: 407788 - protein, 11 aa, Influenza virus
GEFNQVENRIN

SEQ ID NO: 407789 - protein, 11 aa, Influenza virus
EFNQVENRINM

SEQ ID NO: 407790 - protein, 11 aa, Influenza virus
FNQVENRINML

SEQ ID NO: 407791 - protein, 11 aa, Influenza virus
NQVENRINMLA

SEQ ID NO: 407792 - protein, 11 aa, Influenza virus
QVENRINMLAD

SEQ ID NO: 407793 - protein, 11 aa, Influenza virus
VENRINMLADR

SEQ ID NO: 407794 - protein, 11 aa, Influenza virus
ENRINMLADRI

SEQ ID NO: 407795 - protein, 11 aa, Influenza virus
NRINMLADRID

SEQ ID NO: 407796 - protein, 11 aa, Influenza virus
AVTDIWSYNAR

SEQ ID NO: 407797 - protein, 11 aa, Influenza virus
VTDIWSYNARL

SEQ ID NO: 407798 - protein, 11 aa, Influenza virus
TDIWSYNARLL

SEQ ID NO: 407799 - protein, 11 aa, Influenza virus
DIWSYNARLLV

SEQ ID NO: 407800 - protein, 11 aa, Influenza virus
IWSYNARLLVL

SEQ ID NO: 407801 - protein, 11 aa, Influenza virus
VLLENDKTLNM

SEQ ID NO: 407802 - protein, 11 aa, Influenza virus
LLENDKTLDLH

SEQ ID NO: 407803 - protein, 11 aa, Influenza virus
LENDKTLNMHD

SEQ ID NO: 407804 - protein, 11 aa, Influenza virus
ENDKTLDLHDA

SEQ ID NO: 407805 - protein, 11 aa, Influenza virus
NDKTLNMHDAN

SEQ ID NO: 407806 - protein, 11 aa, Influenza virus
DKTLDLHDANV

SEQ ID NO: 407807 - protein, 11 aa, Influenza virus
KTLDLHDANVR

SEQ ID NO: 407808 - protein, 11 aa, Influenza virus
TLNMHDANVRN

SEQ ID NO: 407809 - protein, 11 aa, Influenza virus
LDLHDANVRNL

SEQ ID NO: 407810 - protein, 11 aa, Influenza virus
DLHDANVRNLH

SEQ ID NO: 407811 - protein, 11 aa, Influenza virus
MHDANVKNLHE

SEQ ID NO: 407812 - protein, 11 aa, Influenza virus
HDANVKNLHEQ

SEQ ID NO: 407813 - protein, 11 aa, Influenza virus
DANVKNLHEQV

SEQ ID NO: 407814 - protein, 11 aa, Influenza virus
ANVKNLHEQVR

SEQ ID NO: 407815 - protein, 11 aa, Influenza virus
NAINEGNGCFE

SEQ ID NO: 407816 - protein, 11 aa, Influenza virus
AINEGNGCFEL

SEQ ID NO: 407817 - protein, 11 aa, Influenza virus
INEGNGCFELL

SEQ ID NO: 407818 - protein, 11 aa, Influenza virus
CFELLHKCNNT

SEQ ID NO: 407819 - protein, 11 aa, Influenza virus
FELLHKCNNTC

SEQ ID NO: 407820 - protein, 11 aa, Influenza virus
ELLHKCNNTCM

SEQ ID NO: 407821 - protein, 11 aa, Influenza virus
LLHKCNDSCMD

SEQ ID NO: 407822 - protein, 11 aa, Influenza virus
LHKCNDSCMDT

SEQ ID NO: 407823 - protein, 11 aa, Influenza virus
HKCNNTCMETI

SEQ ID NO: 407824 - protein, 11 aa, Influenza virus
KCNNTCMETIR

SEQ ID NO: 407825 - protein, 11 aa, Influenza virus
CNNTCMETIRN

SEQ ID NO: 407826 - protein, 11 aa, Influenza virus
NDSCMDTIRNG

SEQ ID NO: 407827 - protein, 11 aa, Influenza virus
NTCMETIRNGT

SEQ ID NO: 407828 - protein, 11 aa, Influenza virus
SCMDTIRNGTY

SEQ ID NO: 407829 - protein, 11 aa, Influenza virus
CMDTIRNGTYN

SEQ ID NO: 407830 - protein, 11 aa, Influenza virus
MDTIRNGTYNH

SEQ ID NO: 407831 - protein, 11 aa, Influenza virus
KYEEESKLKRQ

SEQ ID NO: 407832 - protein, 11 aa, Influenza virus
EESKLKRQEID

SEQ ID NO: 407833 - protein, 11 aa, Influenza virus
ESKLKRQEIDG

SEQ ID NO: 407834 - protein, 11 aa, Influenza virus
SKLKRQEIDGI

SEQ ID NO: 407835 - protein, 11 aa, Influenza virus
KLKRQEIDGIK

SEQ ID NO: 407836 - protein, 11 aa, Influenza virus
LKRQEIDGIKL

SEQ ID NO: 407837 - protein, 11 aa, Influenza virus
KRQEIDGIKLK

SEQ ID NO: 407838 - protein, 11 aa, Influenza virus
RQEIDGIKLKS

SEQ ID NO: 407839 - protein, 11 aa, Influenza virus
SDDNVYKALSI

SEQ ID NO: 407840 - protein, 11 aa, Influenza virus
DDNVYKALSIY

SEQ ID NO: 407841 - protein, 11 aa, Influenza virus
DGVYKALSIYS

SEQ ID NO: 407842 - protein, 11 aa, Influenza virus
GVYKALSIYSC

SEQ ID NO: 407843 - protein, 11 aa, Influenza virus
IYSCIASSIVM

SEQ ID NO: 407844 - protein, 11 aa, Influenza virus
YSCIASSIVMV

SEQ ID NO: 407845 - protein, 11 aa, Influenza virus
SCIASSIVMVG

SEQ ID NO: 407846 - protein, 11 aa, Influenza virus
CIASSIVMVGL

SEQ ID NO: 407847 - protein, 11 aa, Influenza virus
IASSIVMVGLI

SEQ ID NO: 407848 - protein, 11 aa, Influenza virus
ASSIVMVGLIL

SEQ ID NO: 407849 - protein, 11 aa, Influenza virus
VMVGLILAFIM

SEQ ID NO: 407850 - protein, 11 aa, Influenza virus
MVGLILAFIMW

SEQ ID NO: 407851 - protein, 11 aa, Influenza virus
VGLILAFIMWT

SEQ ID NO: 407852 - protein, 11 aa, Influenza virus
GLILAFIMWTC

SEQ ID NO: 407853 - protein, 11 aa, Influenza virus
FIMWTCNSGNC

SEQ ID NO: 407854 - protein, 11 aa, Influenza virus
IMWTCNSGNCR

SEQ ID NO: 407855 - protein, 11 aa, Influenza virus
MWTCNSGNCRF

SEQ ID NO: 407856 - protein, 11 aa, Influenza virus
YSEMKWLSSSG

SEQ ID NO: 407857 - protein, 11 aa, Influenza virus
SEMKWLSSSGN

SEQ ID NO: 407858 - protein, 11 aa, Influenza virus
EMKWLLSSKDN

SEQ ID NO: 407859 - protein, 11 aa, Influenza virus
MKWLSSSGNNQ

SEQ ID NO: 407860 - protein, 11 aa, Influenza virus
KWLLSSKDNQV

SEQ ID NO: 407861 - protein, 11 aa, Influenza virus
WLSSSGNNQVF

SEQ ID NO: 407862 - protein, 11 aa, Influenza virus
LSSSGNNQVFP

SEQ ID NO: 407863 - protein, 11 aa, Influenza virus
LSSKDNQVFPQ

SEQ ID NO: 407864 - protein, 11 aa, Influenza virus
SSGNNQVFPQL

SEQ ID NO: 407865 - protein, 11 aa, Influenza virus
SKDNQVFPQLN

SEQ ID NO: 407866 - protein, 11 aa, Influenza virus
GNNQVFPQLNQ

SEQ ID NO: 407867 - protein, 11 aa, Influenza virus
DNQVFPQLNQT

SEQ ID NO: 407868 - protein, 11 aa, Influenza virus
YRQSFSPSPGA

SEQ ID NO: 407869 - protein, 11 aa, Influenza virus
RQSFSPSPGAR

SEQ ID NO: 407870 - protein, 11 aa, Influenza virus
GMKNVPEKIRV

SEQ ID NO: 407871 - protein, 11 aa, Influenza virus
MKNVPEKIRVK

SEQ ID NO: 407872 - protein, 11 aa, Influenza virus
KNVPEKIRVKR

SEQ ID NO: 407873 - protein, 11 aa, Influenza virus
NVPEKIRVKRR

SEQ ID NO: 407874 - protein, 11 aa, Influenza virus
VPEKIRVKRRP

SEQ ID NO: 407875 - protein, 11 aa, Influenza virus
PEKIRVKRRPV

SEQ ID NO: 407876 - protein, 11 aa, Influenza virus
EKIRVKRRPVA

SEQ ID NO: 407877 - protein, 11 aa, Influenza virus
KIRVKRRPVAK

SEQ ID NO: 407878 - protein, 11 aa, Influenza virus
IRVKRRPVAKA

SEQ ID NO: 407879 - protein, 11 aa, Influenza virus
RVKRRPVAKAG

SEQ ID NO: 407880 - protein, 11 aa, Influenza virus
GRYSIADKICI

SEQ ID NO: 407881 - protein, 11 aa, Influenza virus
RYSIADKICIG

SEQ ID NO: 407882 - protein, 11 aa, Influenza virus
YSIADKICIGY

SEQ ID NO: 407883 - protein, 11 aa, Influenza virus
SIADKICIGYL

SEQ ID NO: 407884 - protein, 11 aa, Influenza virus
IADKICIGYLS

SEQ ID NO: 407885 - protein, 11 aa, Influenza virus
ICIGYLSNNAT

SEQ ID NO: 407886 - protein, 11 aa, Influenza virus
CIGYLSNNATD

SEQ ID NO: 407887 - protein, 11 aa, Influenza virus
IGYLSNNSTDT

SEQ ID NO: 407888 - protein, 11 aa, Influenza virus
GYLSNNSTDTV

SEQ ID NO: 407889 - protein, 11 aa, Influenza virus
YLSNNSTDTVD

SEQ ID NO: 407890 - protein, 11 aa, Influenza virus
LSNNSTDTVDT

SEQ ID NO: 407891 - protein, 11 aa, Influenza virus
SNNSTDTVDTL

SEQ ID NO: 407892 - protein, 11 aa, Influenza virus
NNSTDTVDTLT

SEQ ID NO: 407893 - protein, 11 aa, Influenza virus
NSTDTVDTLTE

SEQ ID NO: 407894 - protein, 11 aa, Influenza virus
TDKVDTLTENG

SEQ ID NO: 407895 - protein, 11 aa, Influenza virus
DKIDTLTETGV

SEQ ID NO: 407896 - protein, 11 aa, Influenza virus
KIDTLTETGVP

SEQ ID NO: 407897 - protein, 11 aa, Influenza virus
VDTLTETGVPV

SEQ ID NO: 407898 - protein, 11 aa, Influenza virus
TETGVPVTSSV

SEQ ID NO: 407899 - protein, 11 aa, Influenza virus
ETGVPVTSSVD

SEQ ID NO: 407900 - protein, 11 aa, Influenza virus
TGVPVTSSVDL

SEQ ID NO: 407901 - protein, 11 aa, Influenza virus
TYCSLNGVSPV

SEQ ID NO: 407902 - protein, 11 aa, Influenza virus
YCSLNGVSPVH

SEQ ID NO: 407903 - protein, 11 aa, Influenza virus
CSLNGVSPVHL

SEQ ID NO: 407904 - protein, 11 aa, Influenza virus
SLNGVSPVHLG

SEQ ID NO: 407905 - protein, 11 aa, Influenza virus
LNGVSPVHLGD

SEQ ID NO: 407906 - protein, 11 aa, Influenza virus
NGVSPVHLGDC

SEQ ID NO: 407907 - protein, 11 aa, Influenza virus
GVSPVHLGDCS

SEQ ID NO: 407908 - protein, 11 aa, Influenza virus
VSPVHLGDCSF

SEQ ID NO: 407909 - protein, 11 aa, Influenza virus
LIEDPNAPNKF

SEQ ID NO: 407910 - protein, 11 aa, Influenza virus
IEDPNAPNKFC

SEQ ID NO: 407911 - protein, 11 aa, Influenza virus
EDPNAPNKLCY

SEQ ID NO: 407912 - protein, 11 aa, Influenza virus
DPNAPNKLCYP

SEQ ID NO: 407913 - protein, 11 aa, Influenza virus
PNAPNKLCYPG

SEQ ID NO: 407914 - protein, 11 aa, Influenza virus
NAPNKLCYPGE

SEQ ID NO: 407915 - protein, 11 aa, Influenza virus
KLCFPGEVDNN

SEQ ID NO: 407916 - protein, 11 aa, Influenza virus
LCFPGEVDNNG

SEQ ID NO: 407917 - protein, 11 aa, Influenza virus
CFPGEVDNNGE

SEQ ID NO: 407918 - protein, 11 aa, Influenza virus
FPGEVDNNGEL

SEQ ID NO: 407919 - protein, 11 aa, Influenza virus
VNSFSRTELIP

SEQ ID NO: 407920 - protein, 11 aa, Influenza virus
NSFSRTELIPP

SEQ ID NO: 407921 - protein, 11 aa, Influenza virus
SFSRTELIPPS

SEQ ID NO: 407922 - protein, 11 aa, Influenza virus
FSRTELINPSK

SEQ ID NO: 407923 - protein, 11 aa, Influenza virus
SRTELIPPSKW

SEQ ID NO: 407924 - protein, 11 aa, Influenza virus
RTELIPPSKWG

SEQ ID NO: 407925 - protein, 11 aa, Influenza virus
PSKWGDVLDGV

SEQ ID NO: 407926 - protein, 11 aa, Influenza virus
SKWGDVLDGVT

SEQ ID NO: 407927 - protein, 11 aa, Influenza virus
KWGDVLDGVTA

SEQ ID NO: 407928 - protein, 11 aa, Influenza virus
WGDVLDGVTAS

SEQ ID NO: 407929 - protein, 11 aa, Influenza virus
GDVLDGVTASC

SEQ ID NO: 407930 - protein, 11 aa, Influenza virus
DVLDGVTASCL

SEQ ID NO: 407931 - protein, 11 aa, Influenza virus
ILDGVTASCRD

SEQ ID NO: 407932 - protein, 11 aa, Influenza virus
LDGVTASCLDK

SEQ ID NO: 407933 - protein, 11 aa, Influenza virus
DGVTASCLDKG

SEQ ID NO: 407934 - protein, 11 aa, Influenza virus
GVTASCLDKGA

SEQ ID NO: 407935 - protein, 11 aa, Influenza virus
SFYRNLVWIVK

SEQ ID NO: 407936 - protein, 11 aa, Influenza virus
IKGDYNNTTGR

SEQ ID NO: 407937 - protein, 11 aa, Influenza virus
RGDYNNTTGRD

SEQ ID NO: 407938 - protein, 11 aa, Influenza virus
LWGIHHPDSET

SEQ ID NO: 407939 - protein, 11 aa, Influenza virus
WGIHHPDSETT

SEQ ID NO: 407940 - protein, 11 aa, Influenza virus
GIHHPDSETTA

SEQ ID NO: 407941 - protein, 11 aa, Influenza virus
ANKLYVNKNPY

SEQ ID NO: 407942 - protein, 11 aa, Influenza virus
NKLYVNKNPYT

SEQ ID NO: 407943 - protein, 11 aa, Influenza virus
NLYASKNPYTL

SEQ ID NO: 407944 - protein, 11 aa, Influenza virus
WSKRYELEIGA

SEQ ID NO: 407945 - protein, 11 aa, Influenza virus
SKRYELEIGAR

SEQ ID NO: 407946 - protein, 11 aa, Influenza virus
KRYELEIGARI

SEQ ID NO: 407947 - protein, 11 aa, Influenza virus
YELEIGARIGE

SEQ ID NO: 407948 - protein, 11 aa, Influenza virus
IGEGQRSWMKI

SEQ ID NO: 407949 - protein, 11 aa, Influenza virus
GEGQRSWMKIY

SEQ ID NO: 407950 - protein, 11 aa, Influenza virus
EGQRSWMKIYW

SEQ ID NO: 407951 - protein, 11 aa, Influenza virus
SWMKLYWHLMH

SEQ ID NO: 407952 - protein, 11 aa, Influenza virus
WMKLYWHLMHP

SEQ ID NO: 407953 - protein, 11 aa, Influenza virus
MKLYWHLMHPG

SEQ ID NO: 407954 - protein, 11 aa, Influenza virus
KLYWHLMHPGE

SEQ ID NO: 407955 - protein, 11 aa, Influenza virus
LYWHLMHPGER

SEQ ID NO: 407956 - protein, 11 aa, Influenza virus
YWHLMSPGERI

SEQ ID NO: 407957 - protein, 11 aa, Influenza virus
PGERITFESSG

SEQ ID NO: 407958 - protein, 11 aa, Influenza virus
GERITFESSGG

SEQ ID NO: 407959 - protein, 11 aa, Influenza virus
ERITFESSGGL

SEQ ID NO: 407960 - protein, 11 aa, Influenza virus
MFESNGGLLAP

SEQ ID NO: 407961 - protein, 11 aa, Influenza virus
FESSGGLLAPR

SEQ ID NO: 407962 - protein, 11 aa, Influenza virus
ESSGGLLAPRY

SEQ ID NO: 407963 - protein, 11 aa, Influenza virus
SSGGLLAPRYG

SEQ ID NO: 407964 - protein, 11 aa, Influenza virus
SGGLLAPRYGY

SEQ ID NO: 407965 - protein, 11 aa, Influenza virus
KYGTGRIFQSR

SEQ ID NO: 407966 - protein, 11 aa, Influenza virus
YGTGRIFQSGI

SEQ ID NO: 407967 - protein, 11 aa, Influenza virus
GTGRIFQSGIR

SEQ ID NO: 407968 - protein, 11 aa, Influenza virus
GRIFQSGIRMA

SEQ ID NO: 407969 - protein, 11 aa, Influenza virus
RMARCNTKCQT

SEQ ID NO: 407970 - protein, 11 aa, Influenza virus
MARCNTKCQTS

SEQ ID NO: 407971 - protein, 11 aa, Influenza virus
KCNTKCQTSLG

SEQ ID NO: 407972 - protein, 11 aa, Influenza virus
CNTKCQTSLGG

SEQ ID NO: 407973 - protein, 11 aa, Influenza virus
NTKCQTSMGGI

SEQ ID NO: 407974 - protein, 11 aa, Influenza virus
GGIDTNKTFQN

SEQ ID NO: 407975 - protein, 11 aa, Influenza virus
GIDTNKTFQNI

SEQ ID NO: 407976 - protein, 11 aa, Influenza virus
INTNKTFQNID

SEQ ID NO: 407977 - protein, 11 aa, Influenza virus
NTNKTFQNIEK

SEQ ID NO: 407978 - protein, 11 aa, Influenza virus
TNKTFQNIEKN

SEQ ID NO: 407979 - protein, 11 aa, Influenza virus
NKTFQNIEKNA

SEQ ID NO: 407980 - protein, 11 aa, Influenza virus
KTFQNIEKNAL

SEQ ID NO: 407981 - protein, 11 aa, Influenza virus
TFQNIEKNALG

SEQ ID NO: 407982 - protein, 11 aa, Influenza virus
FQNIEKNALGD

SEQ ID NO: 407983 - protein, 11 aa, Influenza virus
QNIEKNALGDC

SEQ ID NO: 407984 - protein, 11 aa, Influenza virus
NIEKNALGDCP

SEQ ID NO: 407985 - protein, 11 aa, Influenza virus
IEKNALGDCPK

SEQ ID NO: 407986 - protein, 11 aa, Influenza virus
EKNALGDCPKY

SEQ ID NO: 407987 - protein, 11 aa, Influenza virus
KNALGDCPKYI

SEQ ID NO: 407988 - protein, 11 aa, Influenza virus
LATGLRNVPSV

SEQ ID NO: 407989 - protein, 11 aa, Influenza virus
NERGLFGAIAG

SEQ ID NO: 407990 - protein, 11 aa, Influenza virus
EQGTGIAADKV

SEQ ID NO: 407991 - protein, 11 aa, Influenza virus
QGTGIAADKVS

SEQ ID NO: 407992 - protein, 11 aa, Influenza virus
GTGIAADKVST

SEQ ID NO: 407993 - protein, 11 aa, Influenza virus
TGIAADKVSTQ

SEQ ID NO: 407994 - protein, 11 aa, Influenza virus
GIAADKVSTQK

SEQ ID NO: 407995 - protein, 11 aa, Influenza virus
IAADKVSTQKA

SEQ ID NO: 407996 - protein, 11 aa, Influenza virus
AADKVSTQKAI

SEQ ID NO: 407997 - protein, 11 aa, Influenza virus
ADKTSTQKAIN

SEQ ID NO: 407998 - protein, 11 aa, Influenza virus
DKTSTQKAINE

SEQ ID NO: 407999 - protein, 11 aa, Influenza virus
KTSTQKAINEI

SEQ ID NO: 408000 - protein, 11 aa, Influenza virus
TSTQKAINEIT

SEQ ID NO: 408001 - protein, 11 aa, Influenza virus
STQKALNEITT

SEQ ID NO: 408002 - protein, 11 aa, Influenza virus
TQKALNEITTK

SEQ ID NO: 408003 - protein, 11 aa, Influenza virus
QKALNEITTKI

SEQ ID NO: 408004 - protein, 11 aa, Influenza virus
KALNEITTKIN

SEQ ID NO: 408005 - protein, 11 aa, Influenza virus
ALNEITTKINN

SEQ ID NO: 408006 - protein, 11 aa, Influenza virus
LNEITTKINNI

SEQ ID NO: 408007 - protein, 11 aa, Influenza virus
VEKRINMLADW

SEQ ID NO: 408008 - protein, 11 aa, Influenza virus
EKRINMLADWV

SEQ ID NO: 408009 - protein, 11 aa, Influenza virus
KRINMLADWVD

SEQ ID NO: 408010 - protein, 11 aa, Influenza virus
RINMLADWVDD

SEQ ID NO: 408011 - protein, 11 aa, Influenza virus
INMLADWVDDA

SEQ ID NO: 408012 - protein, 11 aa, Influenza virus
NMLADWVDDAV

SEQ ID NO: 408013 - protein, 11 aa, Influenza virus
MLADWVDDAVT

SEQ ID NO: 408014 - protein, 11 aa, Influenza virus
LADWVDDAVTD

SEQ ID NO: 408015 - protein, 11 aa, Influenza virus
ADWVDDAVTDI

SEQ ID NO: 408016 - protein, 11 aa, Influenza virus
DWVDDAVTDIW

SEQ ID NO: 408017 - protein, 11 aa, Influenza virus
WVDDAVTDIWS

SEQ ID NO: 408018 - protein, 11 aa, Influenza virus
NAKLLVLLEND

SEQ ID NO: 408019 - protein, 11 aa, Influenza virus
AKLLVLLENDR

SEQ ID NO: 408020 - protein, 11 aa, Influenza virus
KLLVLLENDRT

SEQ ID NO: 408021 - protein, 11 aa, Influenza virus
LLVLLENDRTL

SEQ ID NO: 408022 - protein, 11 aa, Influenza virus
LVLLENDRTLD

SEQ ID NO: 408023 - protein, 11 aa, Influenza virus
VLLENDRTLDL

SEQ ID NO: 408024 - protein, 11 aa, Influenza virus
LLENDRTLDLH

SEQ ID NO: 408025 - protein, 11 aa, Influenza virus
LENDRTLDLHD

SEQ ID NO: 408026 - protein, 11 aa, Influenza virus
ENGRTLGLHDA

SEQ ID NO: 408027 - protein, 11 aa, Influenza virus
NGRTLGLHDAN

SEQ ID NO: 408028 - protein, 11 aa, Influenza virus
GRTLGLHDANV

SEQ ID NO: 408029 - protein, 11 aa, Influenza virus
RTLGLHDANVR

SEQ ID NO: 408030 - protein, 11 aa, Influenza virus
TLGLHDANVRN

SEQ ID NO: 408031 - protein, 11 aa, Influenza virus
LGLHDANVRNL

SEQ ID NO: 408032 - protein, 11 aa, Influenza virus
GLHDANVRNLH

SEQ ID NO: 408033 - protein, 11 aa, Influenza virus
LHDANVKNLHE

SEQ ID NO: 408034 - protein, 11 aa, Influenza virus
HDANVKNLHEQ

SEQ ID NO: 408035 - protein, 11 aa, Influenza virus
DANVRNLHDQI

SEQ ID NO: 408036 - protein, 11 aa, Influenza virus
ANVRNLHDQIK

SEQ ID NO: 408037 - protein, 11 aa, Influenza virus
NVKNLHEQVKR

SEQ ID NO: 408038 - protein, 11 aa, Influenza virus
LKSNAIDEGDG

SEQ ID NO: 408039 - protein, 11 aa, Influenza virus
KDNAIDEGDGC

SEQ ID NO: 408040 - protein, 11 aa, Influenza virus
DNAIDEGDGCF

SEQ ID NO: 408041 - protein, 11 aa, Influenza virus
AIDEGDGCFSL

SEQ ID NO: 408042 - protein, 11 aa, Influenza virus
IDEGDGCFSLL

SEQ ID NO: 408043 - protein, 11 aa, Influenza virus
DEGDGCFSLLH

SEQ ID NO: 408044 - protein, 11 aa, Influenza virus
EGDGCFSLLHK

SEQ ID NO: 408045 - protein, 11 aa, Influenza virus
GDGCFSLLHKC

SEQ ID NO: 408046 - protein, 11 aa, Influenza virus
DGCFSLLHKCN

SEQ ID NO: 408047 - protein, 11 aa, Influenza virus
GCFSLLHKCND

SEQ ID NO: 408048 - protein, 11 aa, Influenza virus
CFSLLHKCNDS

SEQ ID NO: 408049 - protein, 11 aa, Influenza virus
FSLLHKCNDSC

SEQ ID NO: 408050 - protein, 11 aa, Influenza virus
SLLHKCNDSCM

SEQ ID NO: 408051 - protein, 11 aa, Influenza virus
FFHKCNDSCME

SEQ ID NO: 408052 - protein, 11 aa, Influenza virus
FHKCNDSCMET

SEQ ID NO: 408053 - protein, 11 aa, Influenza virus
EDYREESQLKK

SEQ ID NO: 408054 - protein, 11 aa, Influenza virus
DYREESQLKKQ

SEQ ID NO: 408055 - protein, 11 aa, Influenza virus
YREESQLKKQE

SEQ ID NO: 408056 - protein, 11 aa, Influenza virus
REESQLKKQEI

SEQ ID NO: 408057 - protein, 11 aa, Influenza virus
RQEIEGIKLKS

SEQ ID NO: 408058 - protein, 11 aa, Influenza virus
EGIKLKSEDNV

SEQ ID NO: 408059 - protein, 11 aa, Influenza virus
GIKLKSEDNVY

SEQ ID NO: 408060 - protein, 11 aa, Influenza virus
IKLKSEDNVYK

SEQ ID NO: 408061 - protein, 11 aa, Influenza virus
KLKTEDNIYKI

SEQ ID NO: 408062 - protein, 11 aa, Influenza virus
LKTEDNIYKIL

SEQ ID NO: 408063 - protein, 11 aa, Influenza virus
KTEDNIYKILS

SEQ ID NO: 408064 - protein, 11 aa, Influenza virus
TEDNIYKILSI

SEQ ID NO: 408065 - protein, 11 aa, Influenza virus
EDNVYKVLAIY

SEQ ID NO: 408066 - protein, 11 aa, Influenza virus
DNVYKVLAIYS

SEQ ID NO: 408067 - protein, 11 aa, Influenza virus
NIYKILSIYSC

SEQ ID NO: 408068 - protein, 11 aa, Influenza virus
IYKILSIYSCI

SEQ ID NO: 408069 - protein, 11 aa, Influenza virus
YKVLAIYSCIA

SEQ ID NO: 408070 - protein, 11 aa, Influenza virus
KVLAIYSCIAS

SEQ ID NO: 408071 - protein, 11 aa, Influenza virus
VLAIYSCIASS

SEQ ID NO: 408072 - protein, 11 aa, Influenza virus
LSIYSCIASSV

SEQ ID NO: 408073 - protein, 11 aa, Influenza virus
SIYSCIASSVV

SEQ ID NO: 408074 - protein, 11 aa, Influenza virus
IYSCIASSIVL

SEQ ID NO: 408075 - protein, 11 aa, Influenza virus
YSCIASSVVLV

SEQ ID NO: 408076 - protein, 11 aa, Influenza virus
SCIASSIVMVG

SEQ ID NO: 408077 - protein, 11 aa, Influenza virus
CIASSIVLVGL

SEQ ID NO: 408078 - protein, 11 aa, Influenza virus
IASSIVMVGLI

SEQ ID NO: 408079 - protein, 11 aa, Influenza virus
ASSVVLVGLIL

SEQ ID NO: 408080 - protein, 11 aa, Influenza virus
SSIVMVGLILA

SEQ ID NO: 408081 - protein, 11 aa, Influenza virus
SIVMVGLILAF

SEQ ID NO: 408082 - protein, 11 aa, Influenza virus
IVMVGLILAFI

SEQ ID NO: 408083 - protein, 11 aa, Influenza virus
VLVGLILAFIL

SEQ ID NO: 408084 - protein, 11 aa, Influenza virus
LVGLILAFILW

SEQ ID NO: 408085 - protein, 11 aa, Influenza virus
ILAFILWACSS

SEQ ID NO: 408086 - protein, 11 aa, Influenza virus
LAFILWACSSG

SEQ ID NO: 408087 - protein, 11 aa, Influenza virus
AFILWACSSGN

SEQ ID NO: 408088 - protein, 11 aa, Influenza virus
FILWACSSGNC

SEQ ID NO: 408089 - protein, 11 aa, Influenza virus
ILWACSSGNCR

SEQ ID NO: 408090 - protein, 11 aa, Influenza virus
LWACSSGNCRF

SEQ ID NO: 408091 - protein, 11 aa, Influenza virus
WACSNGNCRFN

SEQ ID NO: 408092 - protein, 11 aa, Influenza virus
ACSSGNCRFSV

SEQ ID NO: 408093 - protein, 11 aa, Influenza virus
CSSGNCRFSVC

SEQ ID NO: 408094 - protein, 11 aa, Influenza virus
SSGNCRFSVCI

SEQ ID NO: 408095 - protein, 11 aa, Influenza virus
KTKATKMKAII

SEQ ID NO: 408096 - protein, 11 aa, Influenza virus
TKATKMKAIIV

SEQ ID NO: 408097 - protein, 11 aa, Influenza virus
KATKMKAIIVV

SEQ ID NO: 408098 - protein, 11 aa, Influenza virus
QPNDGQVLYFL

SEQ ID NO: 408099 - protein, 11 aa, Influenza virus
TKMEAILVVLL

SEQ ID NO: 408100 - protein, 11 aa, Influenza virus
AIAGFIENGWE

SEQ ID NO: 408101 - protein, 11 aa, Influenza virus
IAGFIENGWEG

SEQ ID NO: 408102 - protein, 11 aa, Influenza virus
AGFIENGWEGM

SEQ ID NO: 408103 - protein, 11 aa, Influenza virus
GFIEGGWPGLI

SEQ ID NO: 408104 - protein, 11 aa, Influenza virus
FIEGGWPGLIN

SEQ ID NO: 408105 - protein, 11 aa, Influenza virus
IEGGWPGLING

SEQ ID NO: 408106 - protein, 11 aa, Influenza virus
EGGWPGLINGW

SEQ ID NO: 408107 - protein, 11 aa, Influenza virus
GGWPGLINGWY

SEQ ID NO: 408108 - protein, 11 aa, Influenza virus
GWPGLINGWYG

SEQ ID NO: 408109 - protein, 11 aa, Influenza virus
WPGLINGWYGF

SEQ ID NO: 408110 - protein, 11 aa, Influenza virus
PGLINGWYGFQ

SEQ ID NO: 408111 - protein, 11 aa, Influenza virus
GLINGWYGFQH

SEQ ID NO: 408112 - protein, 11 aa, Influenza virus
YNAELLILLEN

SEQ ID NO: 408113 - protein, 11 aa, Influenza virus
NMRCTISLVKT

SEQ ID NO: 408114 - protein, 11 aa, Influenza virus
MRCTISLVKTT

SEQ ID NO: 408115 - protein, 11 aa, Influenza virus
RCTISLVKTTL

SEQ ID NO: 408116 - protein, 11 aa, Influenza virus
CTISLVKTTLF

SEQ ID NO: 408117 - protein, 11 aa, Influenza virus
RICIDFRDMRK

SEQ ID NO: 408118 - protein, 11 aa, Influenza virus
KTKATKMKAII

SEQ ID NO: 408119 - protein, 11 aa, Influenza virus
TKATKMKAIIV

SEQ ID NO: 408120 - protein, 11 aa, Influenza virus
KATKMKAIIVV

SEQ ID NO: 408121 - protein, 11 aa, Influenza virus
ATKMEAILVVL

SEQ ID NO: 408122 - protein, 11 aa, Influenza virus
TKMEAILVVLL

SEQ ID NO: 408123 - protein, 11 aa, Influenza virus
EREAKLFVLFC

SEQ ID NO: 408124 - protein, 11 aa, Influenza virus
ADTICVGYHAN

SEQ ID NO: 408125 - protein, 11 aa, Influenza virus
DTICVGYHANN

SEQ ID NO: 408126 - protein, 11 aa, Influenza virus
TICVGYHANNS

SEQ ID NO: 408127 - protein, 11 aa, Influenza virus
ICVGYHANNST

SEQ ID NO: 408128 - protein, 11 aa, Influenza virus
NNSTDTVDTLL

SEQ ID NO: 408129 - protein, 11 aa, Influenza virus
NSTDTVDTLLE

SEQ ID NO: 408130 - protein, 11 aa, Influenza virus
STDTVDTVLER

SEQ ID NO: 408131 - protein, 11 aa, Influenza virus
TDTVDTVLERN

SEQ ID NO: 408132 - protein, 11 aa, Influenza virus
TVDTVLERNVT

SEQ ID NO: 408133 - protein, 11 aa, Influenza virus
VDTVLERNVTV

SEQ ID NO: 408134 - protein, 11 aa, Influenza virus
DTVLERNVTVT

SEQ ID NO: 408135 - protein, 11 aa, Influenza virus
TVLERNVTVTH

SEQ ID NO: 408136 - protein, 11 aa, Influenza virus
VLERNVTVTHS

SEQ ID NO: 408137 - protein, 11 aa, Influenza virus
REKNVTVTHSV

SEQ ID NO: 408138 - protein, 11 aa, Influenza virus
EKNVTVTHSVD

SEQ ID NO: 408139 - protein, 11 aa, Influenza virus
RNVTVTHSVNL

SEQ ID NO: 408140 - protein, 11 aa, Influenza virus
NVTVTHSVDLL

SEQ ID NO: 408141 - protein, 11 aa, Influenza virus
VTVTHSVDLLE

SEQ ID NO: 408142 - protein, 11 aa, Influenza virus
IAGWLLGNPEC

SEQ ID NO: 408143 - protein, 11 aa, Influenza virus
DYEELKEQLST

SEQ ID NO: 408144 - protein, 11 aa, Influenza virus
YEELREQLSTV

SEQ ID NO: 408145 - protein, 11 aa, Influenza virus
EELREQLSTVS

SEQ ID NO: 408146 - protein, 11 aa, Influenza virus
ELREQLSTVSS

SEQ ID NO: 408147 - protein, 11 aa, Influenza virus
LREQLSTVSSF

SEQ ID NO: 408148 - protein, 11 aa, Influenza virus
EQLSTVSSFER

SEQ ID NO: 408149 - protein, 11 aa, Influenza virus
QLSTVSSFERF

SEQ ID NO: 408150 - protein, 11 aa, Influenza virus
LSTVSSFERFE

SEQ ID NO: 408151 - protein, 11 aa, Influenza virus
STVSSFERFEI

SEQ ID NO: 408152 - protein, 11 aa, Influenza virus
TVSSFERFEIF

SEQ ID NO: 408153 - protein, 11 aa, Influenza virus
VSSFERFEMFP

SEQ ID NO: 408154 - protein, 11 aa, Influenza virus
SSFERFEMFPK

SEQ ID NO: 408155 - protein, 11 aa, Influenza virus
DTITFEATGNL

SEQ ID NO: 408156 - protein, 11 aa, Influenza virus
TIGECPKYVKS

SEQ ID NO: 408157 - protein, 11 aa, Influenza virus
IGECPKYVKST

SEQ ID NO: 408158 - protein, 11 aa, Influenza virus
LRMATGLRNIP

SEQ ID NO: 408159 - protein, 11 aa, Influenza virus
RMATGLRNIPS

SEQ ID NO: 408160 - protein, 11 aa, Influenza virus
ATGLRNIPSIQ

SEQ ID NO: 408161 - protein, 11 aa, Influenza virus
TGLRNIPSVQS

SEQ ID NO: 408162 - protein, 11 aa, Influenza virus
GLRNIPSVQSR

SEQ ID NO: 408163 - protein, 11 aa, Influenza virus
LRNIPSVQSRG

SEQ ID NO: 408164 - protein, 11 aa, Influenza virus
RNIPSVQSRGL

SEQ ID NO: 408165 - protein, 11 aa, Influenza virus
NIPSVQSRGLF

SEQ ID NO: 408166 - protein, 11 aa, Influenza virus
IPSVQSRGLFG

SEQ ID NO: 408167 - protein, 11 aa, Influenza virus
WYGYHHQNAQG

SEQ ID NO: 408168 - protein, 11 aa, Influenza virus
YGYHHQNAQGS

SEQ ID NO: 408169 - protein, 11 aa, Influenza virus
GYHHQNAQGSG

SEQ ID NO: 408170 - protein, 11 aa, Influenza virus
YHHQNAQGSGY

SEQ ID NO: 408171 - protein, 11 aa, Influenza virus
HHQNAQGSGYA

SEQ ID NO: 408172 - protein, 11 aa, Influenza virus
HQNAQGSGYAA

SEQ ID NO: 408173 - protein, 11 aa, Influenza virus
QNAQGSGYAAD

SEQ ID NO: 408174 - protein, 11 aa, Influenza virus
NGQGSGYAADQ

SEQ ID NO: 408175 - protein, 11 aa, Influenza virus
GQGSGYAADQK

SEQ ID NO: 408176 - protein, 11 aa, Influenza virus
QGSGYAADRKS

SEQ ID NO: 408177 - protein, 11 aa, Influenza virus
GSGYAADRKST

SEQ ID NO: 408178 - protein, 11 aa, Influenza virus
SGYAADRKSTQ

SEQ ID NO: 408179 - protein, 11 aa, Influenza virus
NKVNSVVEKMN

SEQ ID NO: 408180 - protein, 11 aa, Influenza virus
NSIIEKMNTQF

SEQ ID NO: 408181 - protein, 11 aa, Influenza virus
SIIEKMNTQFT

SEQ ID NO: 408182 - protein, 11 aa, Influenza virus
MNIQFTAVGKE

SEQ ID NO: 408183 - protein, 11 aa, Influenza virus
NIQFTAVGKEF

SEQ ID NO: 408184 - protein, 11 aa, Influenza virus
RIENLNKKIDD

SEQ ID NO: 408185 - protein, 11 aa, Influenza virus
IENLNKKIDDG

SEQ ID NO: 408186 - protein, 11 aa, Influenza virus
ENLNKKVDDGL

SEQ ID NO: 408187 - protein, 11 aa, Influenza virus
NLNKKIDDGFL

SEQ ID NO: 408188 - protein, 11 aa, Influenza virus
LNKKIDDGFLD

SEQ ID NO: 408189 - protein, 11 aa, Influenza virus
DDGFLDVWTYN

SEQ ID NO: 408190 - protein, 11 aa, Influenza virus
DGFLDVWTYNA

SEQ ID NO: 408191 - protein, 11 aa, Influenza virus
GFLDVWTYNAE

SEQ ID NO: 408192 - protein, 11 aa, Influenza virus
FLDVWTYNAEL

SEQ ID NO: 408193 - protein, 11 aa, Influenza virus
LDVWTYNAELL

SEQ ID NO: 408194 - protein, 11 aa, Influenza virus
DVWTYNAELLI

SEQ ID NO: 408195 - protein, 11 aa, Influenza virus
VWTYNAELLIL

SEQ ID NO: 408196 - protein, 11 aa, Influenza virus
ILLENERTLDF

SEQ ID NO: 408197 - protein, 11 aa, Influenza virus
ENERTLDFHDL

SEQ ID NO: 408198 - protein, 11 aa, Influenza virus
NNAKEVGNGCF

SEQ ID NO: 408199 - protein, 11 aa, Influenza virus
NAKEVGNGCFE

SEQ ID NO: 408200 - protein, 11 aa, Influenza virus
AKEVGNGCFEF

SEQ ID NO: 408201 - protein, 11 aa, Influenza virus
KEVGNGCFEFY

SEQ ID NO: 408202 - protein, 11 aa, Influenza virus
EVGNGCFEFYH

SEQ ID NO: 408203 - protein, 11 aa, Influenza virus
VGNGCFEFYHK

SEQ ID NO: 408204 - protein, 11 aa, Influenza virus
GCFEFYHKCDD

SEQ ID NO: 408205 - protein, 11 aa, Influenza virus
CMESVRNGTYD

SEQ ID NO: 408206 - protein, 11 aa, Influenza virus
MESVRNGTYDY

SEQ ID NO: 408207 - protein, 11 aa, Influenza virus
ESVRNGTYDYP

SEQ ID NO: 408208 - protein, 11 aa, Influenza virus
SVRNGTYDYPK

SEQ ID NO: 408209 - protein, 11 aa, Influenza virus
VRNGTYDYPKY

SEQ ID NO: 408210 - protein, 11 aa, Influenza virus
RNGTYDYPKYS

SEQ ID NO: 408211 - protein, 11 aa, Influenza virus
NGTYDYPKYSK

SEQ ID NO: 408212 - protein, 11 aa, Influenza virus
GTYDYPKYSKE

SEQ ID NO: 408213 - protein, 11 aa, Influenza virus
TYNYPKYSEES

SEQ ID NO: 408214 - protein, 11 aa, Influenza virus
HQILAIYSTVA

SEQ ID NO: 408215 - protein, 11 aa, Influenza virus
LAIYSTVASSS

SEQ ID NO: 408216 - protein, 11 aa, Influenza virus
AIYSTVASSSV

SEQ ID NO: 408217 - protein, 11 aa, Influenza virus
IYSTVASSSVL

SEQ ID NO: 408218 - protein, 11 aa, Influenza virus
ASSSVLLVSLG

SEQ ID NO: 408219 - protein, 11 aa, Influenza virus
SSSVLLVSLGA

SEQ ID NO: 408220 - protein, 11 aa, Influenza virus
LIVSLGAISFW

SEQ ID NO: 408221 - protein, 11 aa, Influenza virus
IVSLGAISFWM

SEQ ID NO: 408222 - protein, 11 aa, Influenza virus
LGAVSFWMCSN

SEQ ID NO: 408223 - protein, 11 aa, Influenza virus
GAVSFWMCSNG

SEQ ID NO: 408224 - protein, 11 aa, Influenza virus
AVSFWMCSNGS

SEQ ID NO: 408225 - protein, 11 aa, Influenza virus
ISFWMCSGHSC

SEQ ID NO: 408226 - protein, 11 aa, Influenza virus
SFWMCSGHSCR

SEQ ID NO: 408227 - protein, 11 aa, Influenza virus
FWMCSGHSCRI

SEQ ID NO: 408228 - protein, 11 aa, Influenza virus
WMCSGHSCRIC

SEQ ID NO: 408229 - protein, 11 aa, Influenza virus
MCSNGSLRCRI

SEQ ID NO: 408230 - protein, 11 aa, Influenza virus
CSNGSLRCRIC

SEQ ID NO: 408231 - protein, 11 aa, Influenza virus
SNGSLRCRICI

SEQ ID NO: 408232 - protein, 11 aa, Influenza virus
SLQCRICILDQ

SEQ ID NO: 408233 - protein, 11 aa, Influenza virus
LQCRICILDQN

SEQ ID NO: 408234 - protein, 11 aa, Influenza virus
SKDNSVRIGSK

SEQ ID NO: 408235 - protein, 11 aa, Influenza virus
KDNGIRIGSKG

SEQ ID NO: 408236 - protein, 11 aa, Influenza virus
DNGIRIGSKGD

SEQ ID NO: 408237 - protein, 11 aa, Influenza virus
NSIRIGSKGDI

SEQ ID NO: 408238 - protein, 11 aa, Influenza virus
SIRIGSKGDIF

SEQ ID NO: 408239 - protein, 11 aa, Influenza virus
IRIGSKGDIFV

SEQ ID NO: 408240 - protein, 11 aa, Influenza virus
RIGSKGDIFVM

SEQ ID NO: 408241 - protein, 11 aa, Influenza virus
IGSKGDIFVMR

SEQ ID NO: 408242 - protein, 11 aa, Influenza virus
GSKGDIFVMRE

SEQ ID NO: 408243 - protein, 11 aa, Influenza virus
SKGDIFVMREP

SEQ ID NO: 408244 - protein, 11 aa, Influenza virus
KGDIFVMREPF

SEQ ID NO: 408245 - protein, 11 aa, Influenza virus
GDIFVMREPFI

SEQ ID NO: 408246 - protein, 11 aa, Influenza virus
DIFVMREPFIS

SEQ ID NO: 408247 - protein, 11 aa, Influenza virus
IFVMREPFISC

SEQ ID NO: 408248 - protein, 11 aa, Influenza virus
VMREPFISCSH

SEQ ID NO: 408249 - protein, 11 aa, Influenza virus
MREPFISCSHL

SEQ ID NO: 408250 - protein, 11 aa, Influenza virus
REPFISCSQLE

SEQ ID NO: 408251 - protein, 11 aa, Influenza virus
EPFISCSQLEC

SEQ ID NO: 408252 - protein, 11 aa, Influenza virus
FECRTFFLTQG

SEQ ID NO: 408253 - protein, 11 aa, Influenza virus
LLNDRHSNGTV

SEQ ID NO: 408254 - protein, 11 aa, Influenza virus
LNDRHSNGTVK

SEQ ID NO: 408255 - protein, 11 aa, Influenza virus
KDRSPHRTLMS

SEQ ID NO: 408256 - protein, 11 aa, Influenza virus
DRSPHRTLMSC

SEQ ID NO: 408257 - protein, 11 aa, Influenza virus
RSPHRTLMSCP

SEQ ID NO: 408258 - protein, 11 aa, Influenza virus
LMSCPIGEAPS

SEQ ID NO: 408259 - protein, 11 aa, Influenza virus
MSCPIGEAPSP

SEQ ID NO: 408260 - protein, 11 aa, Influenza virus
SCPIGEAPSPY

SEQ ID NO: 408261 - protein, 11 aa, Influenza virus
CPIGEAPSPYN

SEQ ID NO: 408262 - protein, 11 aa, Influenza virus
PIGEAPSPYNS

SEQ ID NO: 408263 - protein, 11 aa, Influenza virus
GEAPSPYNSRF

SEQ ID NO: 408264 - protein, 11 aa, Influenza virus
EAPSPYNSRFE

SEQ ID NO: 408265 - protein, 11 aa, Influenza virus
APSPYNSRFES

SEQ ID NO: 408266 - protein, 11 aa, Influenza virus
AWSASACHDGT

SEQ ID NO: 408267 - protein, 11 aa, Influenza virus
SWLTIGISGPD

SEQ ID NO: 408268 - protein, 11 aa, Influenza virus
WITIGISGPDD

SEQ ID NO: 408269 - protein, 11 aa, Influenza virus
ITIGISGPDDG

SEQ ID NO: 408270 - protein, 11 aa, Influenza virus
IGISGPDNEAV

SEQ ID NO: 408271 - protein, 11 aa, Influenza virus
GISGPDNEAVA

SEQ ID NO: 408272 - protein, 11 aa, Influenza virus
ISGPDNEAVAV

SEQ ID NO: 408273 - protein, 11 aa, Influenza virus
SGPDNEAVAVL

SEQ ID NO: 408274 - protein, 11 aa, Influenza virus
GPDNEAVAVLK

SEQ ID NO: 408275 - protein, 11 aa, Influenza virus
PDNEAVAVLKY

SEQ ID NO: 408276 - protein, 11 aa, Influenza virus
DNGAVAVLKYK

SEQ ID NO: 408277 - protein, 11 aa, Influenza virus
NGAVAVLKYKG

SEQ ID NO: 408278 - protein, 11 aa, Influenza virus
GAVAVLKYNDI

SEQ ID NO: 408279 - protein, 11 aa, Influenza virus
AVAVLKYNDII

SEQ ID NO: 408280 - protein, 11 aa, Influenza virus
VAVLKYNDIIT

SEQ ID NO: 408281 - protein, 11 aa, Influenza virus
AVLKYNGIITE

SEQ ID NO: 408282 - protein, 11 aa, Influenza virus
VLKYNGIITET

SEQ ID NO: 408283 - protein, 11 aa, Influenza virus
LRTQESECVCV

SEQ ID NO: 408284 - protein, 11 aa, Influenza virus
QESECVCVNGS

SEQ ID NO: 408285 - protein, 11 aa, Influenza virus
ESECVCVNGSC

SEQ ID NO: 408286 - protein, 11 aa, Influenza virus
NGSCFTVLTDG

SEQ ID NO: 408287 - protein, 11 aa, Influenza virus
GSCFTVLTDGP

SEQ ID NO: 408288 - protein, 11 aa, Influenza virus
SCFTVLTDGPS

SEQ ID NO: 408289 - protein, 11 aa, Influenza virus
APNFYYEECSC

SEQ ID NO: 408290 - protein, 11 aa, Influenza virus
PNFYYEECSCY

SEQ ID NO: 408291 - protein, 11 aa, Influenza virus
NFYYEECSCYP

SEQ ID NO: 408292 - protein, 11 aa, Influenza virus
DNWHASNRPWI

SEQ ID NO: 408293 - protein, 11 aa, Influenza virus
NWHASNRPWIS

SEQ ID NO: 408294 - protein, 11 aa, Influenza virus
WHASNRPWISF

SEQ ID NO: 408295 - protein, 11 aa, Influenza virus
HGSNRPWVSFD

SEQ ID NO: 408296 - protein, 11 aa, Influenza virus
NRPWVSFNQDL

SEQ ID NO: 408297 - protein, 11 aa, Influenza virus
MGYICSGIFGD

SEQ ID NO: 408298 - protein, 11 aa, Influenza virus
CSGVFGDNPRS

SEQ ID NO: 408299 - protein, 11 aa, Influenza virus
GFSFRYGNGVW

SEQ ID NO: 408300 - protein, 11 aa, Influenza virus
KYDNGVWIGRT

SEQ ID NO: 408301 - protein, 11 aa, Influenza virus
YGNGVWMGRTK

SEQ ID NO: 408302 - protein, 11 aa, Influenza virus
GNGVWMGRTKS

SEQ ID NO: 408303 - protein, 11 aa, Influenza virus
GFEMVWDPNGW

SEQ ID NO: 408304 - protein, 11 aa, Influenza virus
FEMVWDPNGWT

SEQ ID NO: 408305 - protein, 11 aa, Influenza virus
NDWSGYSGSFV

SEQ ID NO: 408306 - protein, 11 aa, Influenza virus
FVQHPELTGLN

SEQ ID NO: 408307 - protein, 11 aa, Influenza virus
VQHPELTGLNC

SEQ ID NO: 408308 - protein, 11 aa, Influenza virus
QHPELTGMNCI

SEQ ID NO: 408309 - protein, 11 aa, Influenza virus
NCIRPCFWVEL

SEQ ID NO: 408310 - protein, 11 aa, Influenza virus
CMRPCFWVELI

SEQ ID NO: 408311 - protein, 11 aa, Influenza virus
MRPCFWVELIR

SEQ ID NO: 408312 - protein, 11 aa, Influenza virus
KPCFWVELIRG

SEQ ID NO: 408313 - protein, 11 aa, Influenza virus
PCFWVELIRGQ

SEQ ID NO: 408314 - protein, 11 aa, Influenza virus
CFWVELIRGQP

SEQ ID NO: 408315 - protein, 11 aa, Influenza virus
TIWTSASSISF

SEQ ID NO: 408316 - protein, 11 aa, Influenza virus
IWTSGSIISFC

SEQ ID NO: 408317 - protein, 11 aa, Influenza virus
WTSGSIISFCG

SEQ ID NO: 408318 - protein, 11 aa, Influenza virus
TSASSISFCGV

SEQ ID NO: 408319 - protein, 11 aa, Influenza virus
SGSIISFCGVN

SEQ ID NO: 408320 - protein, 11 aa, Influenza virus
WSWPDGAKLPF

SEQ ID NO: 408321 - protein, 11 aa, Influenza virus
DTICVGYHANN

SEQ ID NO: 408322 - protein, 11 aa, Influenza virus
TICVGYHANNS

SEQ ID NO: 408323 - protein, 11 aa, Influenza virus
ICVGYHANNST

SEQ ID NO: 408324 - protein, 11 aa, Influenza virus
CIGYHANNSTE

SEQ ID NO: 408325 - protein, 11 aa, Influenza virus
IGYHANNSTET

SEQ ID NO: 408326 - protein, 11 aa, Influenza virus
GYHANNSTDTI

SEQ ID NO: 408327 - protein, 11 aa, Influenza virus
YHANNSTDTID

SEQ ID NO: 408328 - protein, 11 aa, Influenza virus
HANNSTDTIDT

SEQ ID NO: 408329 - protein, 11 aa, Influenza virus
KNITVTHSVNL

SEQ ID NO: 408330 - protein, 11 aa, Influenza virus
NVTVTHSINLL

SEQ ID NO: 408331 - protein, 11 aa, Influenza virus
VTVTHSINLLE

SEQ ID NO: 408332 - protein, 11 aa, Influenza virus
PFQNVHPITIG

SEQ ID NO: 408333 - protein, 11 aa, Influenza virus
HPATIGECPKY

SEQ ID NO: 408334 - protein, 11 aa, Influenza virus
PATIGECPKYV

SEQ ID NO: 408335 - protein, 11 aa, Influenza virus
ITIGECPKYVK

SEQ ID NO: 408336 - protein, 11 aa, Influenza virus
TIGKCPKYVKS

SEQ ID NO: 408337 - protein, 11 aa, Influenza virus
SIHSRGLFGAI

SEQ ID NO: 408338 - protein, 11 aa, Influenza virus
VQSRGLFGAIA

SEQ ID NO: 408339 - protein, 11 aa, Influenza virus
QTRGLFGAIAG

SEQ ID NO: 408340 - protein, 11 aa, Influenza virus
SKGLFGAIAGF

SEQ ID NO: 408341 - protein, 11 aa, Influenza virus
FIEGGWTGMVN

SEQ ID NO: 408342 - protein, 11 aa, Influenza virus
IEGGWTGMVNG

SEQ ID NO: 408343 - protein, 11 aa, Influenza virus
EGGWTGMVNGW

SEQ ID NO: 408344 - protein, 11 aa, Influenza virus
GGWTGMVNGWY

SEQ ID NO: 408345 - protein, 11 aa, Influenza virus
GWTGMVNGWYG

SEQ ID NO: 408346 - protein, 11 aa, Influenza virus
WTGMVNGWYGY

SEQ ID NO: 408347 - protein, 11 aa, Influenza virus
VWTYNAELLIL

SEQ ID NO: 408348 - protein, 11 aa, Influenza virus
AEMLVLLENER

SEQ ID NO: 408349 - protein, 11 aa, Influenza virus
ILLENERTLDL

SEQ ID NO: 408350 - protein, 11 aa, Influenza virus
LLENERTLDLH

SEQ ID NO: 408351 - protein, 11 aa, Influenza virus
LENERTLDLHD

SEQ ID NO: 408352 - protein, 11 aa, Influenza virus
ENERTLDLHDS

SEQ ID NO: 408353 - protein, 11 aa, Influenza virus
NERTLDLHDSN

SEQ ID NO: 408354 - protein, 11 aa, Influenza virus
ERTLDLHDSNV

SEQ ID NO: 408355 - protein, 11 aa, Influenza virus
NNAQEIGNGCF

SEQ ID NO: 408356 - protein, 11 aa, Influenza virus
NAQEIGNGCFE

SEQ ID NO: 408357 - protein, 11 aa, Influenza virus
AQEIGNGCFEF

SEQ ID NO: 408358 - protein, 11 aa, Influenza virus
KETGNGCFEFY

SEQ ID NO: 408359 - protein, 11 aa, Influenza virus
IGNGCFEFYHR

SEQ ID NO: 408360 - protein, 11 aa, Influenza virus
NGCFEFYHRCD

SEQ ID NO: 408361 - protein, 11 aa, Influenza virus
GCFEFYHKCND

SEQ ID NO: 408362 - protein, 11 aa, Influenza virus
GFWMCSNGSLQ

SEQ ID NO: 408363 - protein, 11 aa, Influenza virus
FWMCPNGSLQC

SEQ ID NO: 408364 - protein, 11 aa, Influenza virus
WMCSNGSLHGR

SEQ ID NO: 408365 - protein, 11 aa, Influenza virus
MCSNGSLQCRV

SEQ ID NO: 408366 - protein, 11 aa, Influenza virus
KNNQVILCEQT

SEQ ID NO: 408367 - protein, 11 aa, Influenza virus
VTGFAPFSKDN

SEQ ID NO: 408368 - protein, 11 aa, Influenza virus
AGFAPFSKDNS

SEQ ID NO: 408369 - protein, 11 aa, Influenza virus
DNSIRLSASGD

SEQ ID NO: 408370 - protein, 11 aa, Influenza virus
NSIRVSAGGDI

SEQ ID NO: 408371 - protein, 11 aa, Influenza virus
SVRLSAGGDIW

SEQ ID NO: 408372 - protein, 11 aa, Influenza virus
RLSAGGDIWIT

SEQ ID NO: 408373 - protein, 11 aa, Influenza virus
LSAGGDIWITR

SEQ ID NO: 408374 - protein, 11 aa, Influenza virus
SAGGDIWITRE

SEQ ID NO: 408375 - protein, 11 aa, Influenza virus
AGGDIWITREP

SEQ ID NO: 408376 - protein, 11 aa, Influenza virus
GGDIWITREPY

SEQ ID NO: 408377 - protein, 11 aa, Influenza virus
GDIWITREPYV

SEQ ID NO: 408378 - protein, 11 aa, Influenza virus
DIWITREPYVS

SEQ ID NO: 408379 - protein, 11 aa, Influenza virus
IWITREPYVSC

SEQ ID NO: 408380 - protein, 11 aa, Influenza virus
QFALGQGTTLS

SEQ ID NO: 408381 - protein, 11 aa, Influenza virus
FALGQGTTLSN

SEQ ID NO: 408382 - protein, 11 aa, Influenza virus
SYRTLLMNELG

SEQ ID NO: 408383 - protein, 11 aa, Influenza virus
YRTLLMNELGI

SEQ ID NO: 408384 - protein, 11 aa, Influenza virus
RTLLMSELGVP

SEQ ID NO: 408385 - protein, 11 aa, Influenza virus
LLMNELGVPFY

SEQ ID NO: 408386 - protein, 11 aa, Influenza virus
LMNELGVPFYL

SEQ ID NO: 408387 - protein, 11 aa, Influenza virus
MNELGVPFYLG

SEQ ID NO: 408388 - protein, 11 aa, Influenza virus
NELGVPFYLGT

SEQ ID NO: 408389 - protein, 11 aa, Influenza virus
ELGIPFHLGTK

SEQ ID NO: 408390 - protein, 11 aa, Influenza virus
LGTRQVCMAWS

SEQ ID NO: 408391 - protein, 11 aa, Influenza virus
GTRQVCMAWSS

SEQ ID NO: 408392 - protein, 11 aa, Influenza virus
TRQVCMAWSSS

SEQ ID NO: 408393 - protein, 11 aa, Influenza virus
RQVCMAWSSSS

SEQ ID NO: 408394 - protein, 11 aa, Influenza virus
VCIAWSSSSCY

SEQ ID NO: 408395 - protein, 11 aa, Influenza virus
CIAWSSSSCYD

SEQ ID NO: 408396 - protein, 11 aa, Influenza virus
IAWSSSSCYDG

SEQ ID NO: 408397 - protein, 11 aa, Influenza virus
AWSSSSCHDGR

SEQ ID NO: 408398 - protein, 11 aa, Influenza virus
WSSSSCHDGRA

SEQ ID NO: 408399 - protein, 11 aa, Influenza virus
SSSSCHDGRAW

SEQ ID NO: 408400 - protein, 11 aa, Influenza virus
SSSCHDGRAWL

SEQ ID NO: 408401 - protein, 11 aa, Influenza virus
SSCHDGRAWLH

SEQ ID NO: 408402 - protein, 11 aa, Influenza virus
SCHDGRAWLHV

SEQ ID NO: 408403 - protein, 11 aa, Influenza virus
CHDGRAWLHVC

SEQ ID NO: 408404 - protein, 11 aa, Influenza virus
ILRTHESECVC

SEQ ID NO: 408405 - protein, 11 aa, Influenza virus
LRTQESECVCV

SEQ ID NO: 408406 - protein, 11 aa, Influenza virus
TCTVIMTDGSA

SEQ ID NO: 408407 - protein, 11 aa, Influenza virus
CTVIMTDGSAS

SEQ ID NO: 408408 - protein, 11 aa, Influenza virus
GGAQHVEECSC

SEQ ID NO: 408409 - protein, 11 aa, Influenza virus
GAQHVEECSCY

SEQ ID NO: 408410 - protein, 11 aa, Influenza virus
QHIEEGSVYPR

SEQ ID NO: 408411 - protein, 11 aa, Influenza virus
HIEECSCYPRY

SEQ ID NO: 408412 - protein, 11 aa, Influenza virus
IEECSCYPRYP

SEQ ID NO: 408413 - protein, 11 aa, Influenza virus
VRCVCRDNWRG

SEQ ID NO: 408414 - protein, 11 aa, Influenza virus
RCVCRDNWRGS

SEQ ID NO: 408415 - protein, 11 aa, Influenza virus
CVCRDNWRGSN

SEQ ID NO: 408416 - protein, 11 aa, Influenza virus
VCRDNWRGSNR

SEQ ID NO: 408417 - protein, 11 aa, Influenza virus
RDNWRGSNRPI

SEQ ID NO: 408418 - protein, 11 aa, Influenza virus
DNWKGSNRPII

SEQ ID NO: 408419 - protein, 11 aa, Influenza virus
NWKGSNRPIID

SEQ ID NO: 408420 - protein, 11 aa, Influenza virus
WKGSNRPIIDI

SEQ ID NO: 408421 - protein, 11 aa, Influenza virus
SSYICSGLVGD

SEQ ID NO: 408422 - protein, 11 aa, Influenza virus
SYICSGLVGDT

SEQ ID NO: 408423 - protein, 11 aa, Influenza virus
YICSGLVGDTP

SEQ ID NO: 408424 - protein, 11 aa, Influenza virus
ICSGLVGDTPR

SEQ ID NO: 408425 - protein, 11 aa, Influenza virus
GNPGVKGWAFD

SEQ ID NO: 408426 - protein, 11 aa, Influenza virus
RCINRCFYVEL

SEQ ID NO: 408427 - protein, 11 aa, Influenza virus
CFYVELIRGRN

SEQ ID NO: 408428 - protein, 11 aa, Influenza virus
VGWTSNSIVVF

SEQ ID NO: 408429 - protein, 11 aa, Influenza virus
GWTSNSIVVFC

SEQ ID NO: 408430 - protein, 11 aa, Influenza virus
WTSTSIVVFCG

SEQ ID NO: 408431 - protein, 11 aa, Influenza virus
TSNSVVVFCGT

SEQ ID NO: 408432 - protein, 11 aa, Influenza virus
SNSIVVFCGTP

SEQ ID NO: 408433 - protein, 11 aa, Influenza virus
NSVVVFCGTSG

SEQ ID NO: 408434 - protein, 11 aa, Influenza virus
SIVAFCGTSGT

SEQ ID NO: 408435 - protein, 11 aa, Influenza virus
VVFCSTSGTYG

SEQ ID NO: 408436 - protein, 11 aa, Influenza virus
MDNKTKKMTIT

SEQ ID NO: 408437 - protein, 11 aa, Influenza virus
DNKTKKMTITF

SEQ ID NO: 408438 - protein, 11 aa, Influenza virus
NKTKKMTITFL

SEQ ID NO: 408439 - protein, 11 aa, Influenza virus
KTKKMTITFLI

SEQ ID NO: 408440 - protein, 11 aa, Influenza virus
GDQICVGYHSN

SEQ ID NO: 408441 - protein, 11 aa, Influenza virus
DQICVGYHSNN

SEQ ID NO: 408442 - protein, 11 aa, Influenza virus
QICVGYHSNNS

SEQ ID NO: 408443 - protein, 11 aa, Influenza virus
ICVGYHSNNST

SEQ ID NO: 408444 - protein, 11 aa, Influenza virus
CVGYHSNNSTE

SEQ ID NO: 408445 - protein, 11 aa, Influenza virus
DTILEKNVTVT

SEQ ID NO: 408446 - protein, 11 aa, Influenza virus
TILEKNVTVTH

SEQ ID NO: 408447 - protein, 11 aa, Influenza virus
ILEKNVTVTHA

SEQ ID NO: 408448 - protein, 11 aa, Influenza virus
LEQNVTVTHAK

SEQ ID NO: 408449 - protein, 11 aa, Influenza virus
NVTVTHAKNIL

SEQ ID NO: 408450 - protein, 11 aa, Influenza virus
VTVTHAKNILE

SEQ ID NO: 408451 - protein, 11 aa, Influenza virus
TVTHAKNILEK

SEQ ID NO: 408452 - protein, 11 aa, Influenza virus
DILEKVHNGKL

SEQ ID NO: 408453 - protein, 11 aa, Influenza virus
ILERTHNGKLC

SEQ ID NO: 408454 - protein, 11 aa, Influenza virus
GIPPLVLGDCS

SEQ ID NO: 408455 - protein, 11 aa, Influenza virus
IPPLVLGDCSI

SEQ ID NO: 408456 - protein, 11 aa, Influenza virus
PPLVLGDCSIA

SEQ ID NO: 408457 - protein, 11 aa, Influenza virus
PLVLGDCSIAG

SEQ ID NO: 408458 - protein, 11 aa, Influenza virus
LVLGDCSIAGW

SEQ ID NO: 408459 - protein, 11 aa, Influenza virus
VLGDCSIAGWL

SEQ ID NO: 408460 - protein, 11 aa, Influenza virus
GWLLGNPECDL

SEQ ID NO: 408461 - protein, 11 aa, Influenza virus
WLLGNPECDLL

SEQ ID NO: 408462 - protein, 11 aa, Influenza virus
LLGNPECDLLL

SEQ ID NO: 408463 - protein, 11 aa, Influenza virus
VPEWSYIVERE

SEQ ID NO: 408464 - protein, 11 aa, Influenza virus
PSFFRNMIWLT

SEQ ID NO: 408465 - protein, 11 aa, Influenza virus
SYNNTSGEQIL

SEQ ID NO: 408466 - protein, 11 aa, Influenza virus
ISFESTGNLIA

SEQ ID NO: 408467 - protein, 11 aa, Influenza virus
SFESTGNLIAP

SEQ ID NO: 408468 - protein, 11 aa, Influenza virus
FESNGNLIAPE

SEQ ID NO: 408469 - protein, 11 aa, Influenza virus
ESNGNLIAPEY

SEQ ID NO: 408470 - protein, 11 aa, Influenza virus
SNGNLIAPEYG

SEQ ID NO: 408471 - protein, 11 aa, Influenza virus
NGNLIAPEYGF

SEQ ID NO: 408472 - protein, 11 aa, Influenza virus
GNLIAPEYGFR

SEQ ID NO: 408473 - protein, 11 aa, Influenza virus
NLIAPEYGFRI

SEQ ID NO: 408474 - protein, 11 aa, Influenza virus
LIAPEYGFRIS

SEQ ID NO: 408475 - protein, 11 aa, Influenza virus
IAPEYGFRISK

SEQ ID NO: 408476 - protein, 11 aa, Influenza virus
EYGFRISKRGS

SEQ ID NO: 408477 - protein, 11 aa, Influenza virus
YGFRISKRGSS

SEQ ID NO: 408478 - protein, 11 aa, Influenza virus
GFRISKRGSSG

SEQ ID NO: 408479 - protein, 11 aa, Influenza virus
FRISKRGSSGI

SEQ ID NO: 408480 - protein, 11 aa, Influenza virus
ISKRGSSGIVK

SEQ ID NO: 408481 - protein, 11 aa, Influenza virus
SKRGSSGIVKT

SEQ ID NO: 408482 - protein, 11 aa, Influenza virus
CETQCQTPLGA

SEQ ID NO: 408483 - protein, 11 aa, Influenza virus
TQCQTPLGAIN

SEQ ID NO: 408484 - protein, 11 aa, Influenza virus
QCQTPLGAINT

SEQ ID NO: 408485 - protein, 11 aa, Influenza virus
CQSPLGAINTT

SEQ ID NO: 408486 - protein, 11 aa, Influenza virus
QSPLGAINTTL

SEQ ID NO: 408487 - protein, 11 aa, Influenza virus
SPLGAINTTLP

SEQ ID NO: 408488 - protein, 11 aa, Influenza virus
ALNTTLPFHNI

SEQ ID NO: 408489 - protein, 11 aa, Influenza virus
LNTTLPFHNIH

SEQ ID NO: 408490 - protein, 11 aa, Influenza virus
TLPFHNIHPLA

SEQ ID NO: 408491 - protein, 11 aa, Influenza virus
LPFHNIHPLAI

SEQ ID NO: 408492 - protein, 11 aa, Influenza virus
PFHNIHPLAIG

SEQ ID NO: 408493 - protein, 11 aa, Influenza virus
FHNIHPLAIGE

SEQ ID NO: 408494 - protein, 11 aa, Influenza virus
HNIHPLAIGEC

SEQ ID NO: 408495 - protein, 11 aa, Influenza virus
NIHPLAIGECP

SEQ ID NO: 408496 - protein, 11 aa, Influenza virus
IHPLAIGECPK

SEQ ID NO: 408497 - protein, 11 aa, Influenza virus
PLTIGECPKYI

SEQ ID NO: 408498 - protein, 11 aa, Influenza virus
LTIGECPKYIK

SEQ ID NO: 408499 - protein, 11 aa, Influenza virus
TIGECPKYIKS

SEQ ID NO: 408500 - protein, 11 aa, Influenza virus
PQMESRGLFGA

SEQ ID NO: 408501 - protein, 11 aa, Influenza virus
QIEPRGLFGAI

SEQ ID NO: 408502 - protein, 11 aa, Influenza virus
IEPRGLFGAIA

SEQ ID NO: 408503 - protein, 11 aa, Influenza virus
EARGLFGAIAG

SEQ ID NO: 408504 - protein, 11 aa, Influenza virus
ARGLFGAIAGF

SEQ ID NO: 408505 - protein, 11 aa, Influenza virus
DQGSGYAADKA

SEQ ID NO: 408506 - protein, 11 aa, Influenza virus
QGSGYAADKAS

SEQ ID NO: 408507 - protein, 11 aa, Influenza virus
GSGYAADKAST

SEQ ID NO: 408508 - protein, 11 aa, Influenza virus
SGYAADKASTQ

SEQ ID NO: 408509 - protein, 11 aa, Influenza virus
GYAADKASTQK

SEQ ID NO: 408510 - protein, 11 aa, Influenza virus
YAADKASTQKA

SEQ ID NO: 408511 - protein, 11 aa, Influenza virus
SLERRLENLNK

SEQ ID NO: 408512 - protein, 11 aa, Influenza virus
LEKRLGNLNKK

SEQ ID NO: 408513 - protein, 11 aa, Influenza virus
RLGNLNKKMED

SEQ ID NO: 408514 - protein, 11 aa, Influenza virus
LGNLNKKMEDG

SEQ ID NO: 408515 - protein, 11 aa, Influenza virus
GNLNKKMEDGF

SEQ ID NO: 408516 - protein, 11 aa, Influenza virus
VWTYNAEVLVL

SEQ ID NO: 408517 - protein, 11 aa, Influenza virus
WTYNAEVLVLM

SEQ ID NO: 408518 - protein, 11 aa, Influenza virus
TYNVELLVLME

SEQ ID NO: 408519 - protein, 11 aa, Influenza virus
YNAEVLVLMEN

SEQ ID NO: 408520 - protein, 11 aa, Influenza virus
NVELLVLMENE

SEQ ID NO: 408521 - protein, 11 aa, Influenza virus
AEVLVLMENER

SEQ ID NO: 408522 - protein, 11 aa, Influenza virus
EVLVLMENERT

SEQ ID NO: 408523 - protein, 11 aa, Influenza virus
LLVLMENEMTL

SEQ ID NO: 408524 - protein, 11 aa, Influenza virus
LVLMENERTLG

SEQ ID NO: 408525 - protein, 11 aa, Influenza virus
VLMENEMTLDF

SEQ ID NO: 408526 - protein, 11 aa, Influenza virus
LMENEMTLDFH

SEQ ID NO: 408527 - protein, 11 aa, Influenza virus
MENEMTLDFHD

SEQ ID NO: 408528 - protein, 11 aa, Influenza virus
ENEMTLDFHDS

SEQ ID NO: 408529 - protein, 11 aa, Influenza virus
NEMTLDFHDSN

SEQ ID NO: 408530 - protein, 11 aa, Influenza virus
EMTLDFHDSNV

SEQ ID NO: 408531 - protein, 11 aa, Influenza virus
LDFHDSNVKSL

SEQ ID NO: 408532 - protein, 11 aa, Influenza virus
DFHDSNVKSLY

SEQ ID NO: 408533 - protein, 11 aa, Influenza virus
LYEKVRMQLRD

SEQ ID NO: 408534 - protein, 11 aa, Influenza virus
YEKVRMQLRDN

SEQ ID NO: 408535 - protein, 11 aa, Influenza virus
RVRMQLRDNAK

SEQ ID NO: 408536 - protein, 11 aa, Influenza virus
VRMQLKDNAKE

SEQ ID NO: 408537 - protein, 11 aa, Influenza virus
MQLRDNAKELG

SEQ ID NO: 408538 - protein, 11 aa, Influenza virus
DNAKELGNGCF

SEQ ID NO: 408539 - protein, 11 aa, Influenza virus
NAKELGNGCFE

SEQ ID NO: 408540 - protein, 11 aa, Influenza virus
AKELGNGCFEF

SEQ ID NO: 408541 - protein, 11 aa, Influenza virus
KETGNGCFEFY

SEQ ID NO: 408542 - protein, 11 aa, Influenza virus
EVGNGCFEFYH

SEQ ID NO: 408543 - protein, 11 aa, Influenza virus
VGNGCFEFYHK

SEQ ID NO: 408544 - protein, 11 aa, Influenza virus
GCFEFYHKCND

SEQ ID NO: 408545 - protein, 11 aa, Influenza virus
CFEFYHKCNDE

SEQ ID NO: 408546 - protein, 11 aa, Influenza virus
FEFYHKCNDEC

SEQ ID NO: 408547 - protein, 11 aa, Influenza virus
EFYHKCNDECM

SEQ ID NO: 408548 - protein, 11 aa, Influenza virus
FYHKCDNECMD

SEQ ID NO: 408549 - protein, 11 aa, Influenza virus
YHKCDNECMDS

SEQ ID NO: 408550 - protein, 11 aa, Influenza virus
GTYNYPKYEEE

SEQ ID NO: 408551 - protein, 11 aa, Influenza virus
TYNYPKYEEES

SEQ ID NO: 408552 - protein, 11 aa, Influenza virus
YSKYEEESKLN

SEQ ID NO: 408553 - protein, 11 aa, Influenza virus
SKYEEESKLNR

SEQ ID NO: 408554 - protein, 11 aa, Influenza virus
KYEEESKLNRT

SEQ ID NO: 408555 - protein, 11 aa, Influenza virus
YEEESKLNRTE

SEQ ID NO: 408556 - protein, 11 aa, Influenza virus
EEESKLNRTEI

SEQ ID NO: 408557 - protein, 11 aa, Influenza virus
ESKLNRTEIKG

SEQ ID NO: 408558 - protein, 11 aa, Influenza virus
MGVYQILVIYA

SEQ ID NO: 408559 - protein, 11 aa, Influenza virus
GVYQVLAIYAT

SEQ ID NO: 408560 - protein, 11 aa, Influenza virus
AYQILAIYATV

SEQ ID NO: 408561 - protein, 11 aa, Influenza virus
VAGSLSLAIMV

SEQ ID NO: 408562 - protein, 11 aa, Influenza virus
AGSLSLAIMVA

SEQ ID NO: 408563 - protein, 11 aa, Influenza virus
GSLSLAIMVAG

SEQ ID NO: 408564 - protein, 11 aa, Influenza virus
SLSLAIMVAGI

SEQ ID NO: 408565 - protein, 11 aa, Influenza virus
LSLAIMVAGIS

SEQ ID NO: 408566 - protein, 11 aa, Influenza virus
AGISIWMCSNG

SEQ ID NO: 408567 - protein, 11 aa, Influenza virus
GISIWMCSNGS

SEQ ID NO: 408568 - protein, 11 aa, Influenza virus
ISIWMCSNGSL

SEQ ID NO: 408569 - protein, 11 aa, Influenza virus
SIWMCSNGSLQ

SEQ ID NO: 408570 - protein, 11 aa, Influenza virus
IWMCSNGSLQC

SEQ ID NO: 408571 - protein, 11 aa, Influenza virus
VRGDQICVGYH

SEQ ID NO: 408572 - protein, 11 aa, Influenza virus
RGDQICIGYHS

SEQ ID NO: 408573 - protein, 11 aa, Influenza virus
GDQICVGYHSN

SEQ ID NO: 408574 - protein, 11 aa, Influenza virus
DQICVGYHSNN

SEQ ID NO: 408575 - protein, 11 aa, Influenza virus
QICVGYHSNNS

SEQ ID NO: 408576 - protein, 11 aa, Influenza virus
ICVGYHSNNST

SEQ ID NO: 408577 - protein, 11 aa, Influenza virus
CVGYHSNNSTE

SEQ ID NO: 408578 - protein, 11 aa, Influenza virus
IGYHANNSTET

SEQ ID NO: 408579 - protein, 11 aa, Influenza virus
KIDTILERNVT

SEQ ID NO: 408580 - protein, 11 aa, Influenza virus
VDTNLERNVTV

SEQ ID NO: 408581 - protein, 11 aa, Influenza virus
ERNVTVTHAKN

SEQ ID NO: 408582 - protein, 11 aa, Influenza virus
RNVTVTHAKNI

SEQ ID NO: 408583 - protein, 11 aa, Influenza virus
NVTVTHAKNIL

SEQ ID NO: 408584 - protein, 11 aa, Influenza virus
VTVTHAKNILE

SEQ ID NO: 408585 - protein, 11 aa, Influenza virus
TVTHAKNILEK

SEQ ID NO: 408586 - protein, 11 aa, Influenza virus
VTHAKNILEKT

SEQ ID NO: 408587 - protein, 11 aa, Influenza virus
THAKNILEKTH

SEQ ID NO: 408588 - protein, 11 aa, Influenza virus
HAKNILEKTHN

SEQ ID NO: 408589 - protein, 11 aa, Influenza virus
AKNILEKTHNG

SEQ ID NO: 408590 - protein, 11 aa, Influenza virus
DILERTHNGKL

SEQ ID NO: 408591 - protein, 11 aa, Influenza virus
ILEKTHNGRLC

SEQ ID NO: 408592 - protein, 11 aa, Influenza virus
LEKAHNGKLCR

SEQ ID NO: 408593 - protein, 11 aa, Influenza virus
EKAHNGKLCRL

SEQ ID NO: 408594 - protein, 11 aa, Influenza virus
KTHNGKLCRLR

SEQ ID NO: 408595 - protein, 11 aa, Influenza virus
THNGKLCRLRG

SEQ ID NO: 408596 - protein, 11 aa, Influenza virus
HNGKLCRLRGI

SEQ ID NO: 408597 - protein, 11 aa, Influenza virus
NGKLCRLRGIP

SEQ ID NO: 408598 - protein, 11 aa, Influenza virus
GKLCRLRGIPP

SEQ ID NO: 408599 - protein, 11 aa, Influenza virus
KLCRLRGIPPL

SEQ ID NO: 408600 - protein, 11 aa, Influenza virus
LCRLRGIPPLE

SEQ ID NO: 408601 - protein, 11 aa, Influenza virus
CRLRGIPPLEL

SEQ ID NO: 408602 - protein, 11 aa, Influenza virus
RLRGIPPLELG

SEQ ID NO: 408603 - protein, 11 aa, Influenza virus
LRGIPPLELGD

SEQ ID NO: 408604 - protein, 11 aa, Influenza virus
RGIPPLELGDC

SEQ ID NO: 408605 - protein, 11 aa, Influenza virus
LGNPECDRLLT

SEQ ID NO: 408606 - protein, 11 aa, Influenza virus
VPEWSYIVEKE

SEQ ID NO: 408607 - protein, 11 aa, Influenza virus
PEWSYIVERET

SEQ ID NO: 408608 - protein, 11 aa, Influenza virus
EWSYIVERETP

SEQ ID NO: 408609 - protein, 11 aa, Influenza virus
LCYPGSLNDYE

SEQ ID NO: 408610 - protein, 11 aa, Influenza virus
CYPGNFNDYEE

SEQ ID NO: 408611 - protein, 11 aa, Influenza virus
YPGSLNDYEEL

SEQ ID NO: 408612 - protein, 11 aa, Influenza virus
PGSLNDYEELK

SEQ ID NO: 408613 - protein, 11 aa, Influenza virus
HFEKVRILPKD

SEQ ID NO: 408614 - protein, 11 aa, Influenza virus
PSFFRNMIWLT

SEQ ID NO: 408615 - protein, 11 aa, Influenza virus
ARGSYNNTSGE

SEQ ID NO: 408616 - protein, 11 aa, Influenza virus
QGSYNNTSGEQ

SEQ ID NO: 408617 - protein, 11 aa, Influenza virus
GSYNNTNGEQI

SEQ ID NO: 408618 - protein, 11 aa, Influenza virus
SYNNTSGKQML

SEQ ID NO: 408619 - protein, 11 aa, Influenza virus
YNNTNGEQILI

SEQ ID NO: 408620 - protein, 11 aa, Influenza virus
NNTNGEQILII

SEQ ID NO: 408621 - protein, 11 aa, Influenza virus
NTNGEQILIIW

SEQ ID NO: 408622 - protein, 11 aa, Influenza virus
TNGEQILIIWG

SEQ ID NO: 408623 - protein, 11 aa, Influenza virus
WDVISFESTGN

SEQ ID NO: 408624 - protein, 11 aa, Influenza virus
DVISFESTGNL

SEQ ID NO: 408625 - protein, 11 aa, Influenza virus
VINFESTGNLI

SEQ ID NO: 408626 - protein, 11 aa, Influenza virus
ISFESTGNLIA

SEQ ID NO: 408627 - protein, 11 aa, Influenza virus
SFESTGNLIAP

SEQ ID NO: 408628 - protein, 11 aa, Influenza virus
GNLIAPEYGFR

SEQ ID NO: 408629 - protein, 11 aa, Influenza virus
NLIAPEYGFRI

SEQ ID NO: 408630 - protein, 11 aa, Influenza virus
LIAPEYGFRIS

SEQ ID NO: 408631 - protein, 11 aa, Influenza virus
IAPEYGFRISK

SEQ ID NO: 408632 - protein, 11 aa, Influenza virus
APEYGFRISKR

SEQ ID NO: 408633 - protein, 11 aa, Influenza virus
EYGFRISKRGS

SEQ ID NO: 408634 - protein, 11 aa, Influenza virus
YGFKISRRGNS

SEQ ID NO: 408635 - protein, 11 aa, Influenza virus
GFKISRRGNSG

SEQ ID NO: 408636 - protein, 11 aa, Influenza virus
FKISKRGSSGV

SEQ ID NO: 408637 - protein, 11 aa, Influenza virus
KISKRGSSGVM

SEQ ID NO: 408638 - protein, 11 aa, Influenza virus
ISKRGSSGVMK

SEQ ID NO: 408639 - protein, 11 aa, Influenza virus
SKRGSSGVMKT

SEQ ID NO: 408640 - protein, 11 aa, Influenza virus
KRGSSGIMKTG

SEQ ID NO: 408641 - protein, 11 aa, Influenza virus
DCETKCQTPLG

SEQ ID NO: 408642 - protein, 11 aa, Influenza virus
CDTKCQTPLGA

SEQ ID NO: 408643 - protein, 11 aa, Influenza virus
ETKCQSPLGAI

SEQ ID NO: 408644 - protein, 11 aa, Influenza virus
TKCQSPLGAIN

SEQ ID NO: 408645 - protein, 11 aa, Influenza virus
KCQSPLGAINT

SEQ ID NO: 408646 - protein, 11 aa, Influenza virus
CQSPLGAINTT

SEQ ID NO: 408647 - protein, 11 aa, Influenza virus
QSPLGAINTTL

SEQ ID NO: 408648 - protein, 11 aa, Influenza virus
SPLGAINTTLP

SEQ ID NO: 408649 - protein, 11 aa, Influenza virus
ALNTTLPFHNI

SEQ ID NO: 408650 - protein, 11 aa, Influenza virus
LNTTLPFHNIH

SEQ ID NO: 408651 - protein, 11 aa, Influenza virus
LPFHNVHPLAI

SEQ ID NO: 408652 - protein, 11 aa, Influenza virus
PFHNIHPLTMG

SEQ ID NO: 408653 - protein, 11 aa, Influenza virus
FHNVHPLAIGE

SEQ ID NO: 408654 - protein, 11 aa, Influenza virus
HNVHPLAIGEC

SEQ ID NO: 408655 - protein, 11 aa, Influenza virus
NVHPLAIGECP

SEQ ID NO: 408656 - protein, 11 aa, Influenza virus
IHPLTMGECPK

SEQ ID NO: 408657 - protein, 11 aa, Influenza virus
HPLTIGECPRY

SEQ ID NO: 408658 - protein, 11 aa, Influenza virus
PLAIGECPKYV

SEQ ID NO: 408659 - protein, 11 aa, Influenza virus
LTMGECPKYVK

SEQ ID NO: 408660 - protein, 11 aa, Influenza virus
AIGECPKYVKS

SEQ ID NO: 408661 - protein, 11 aa, Influenza virus
IGECPKYVRSE

SEQ ID NO: 408662 - protein, 11 aa, Influenza virus
GECPKYVKSER

SEQ ID NO: 408663 - protein, 11 aa, Influenza virus
ECPKYVKSERL

SEQ ID NO: 408664 - protein, 11 aa, Influenza virus
CPKYVKSERLV

SEQ ID NO: 408665 - protein, 11 aa, Influenza virus
PKYVKSERLVL

SEQ ID NO: 408666 - protein, 11 aa, Influenza virus
KYVKSERLVLA

SEQ ID NO: 408667 - protein, 11 aa, Influenza virus
YVKSERLVLAT

SEQ ID NO: 408668 - protein, 11 aa, Influenza virus
VKSERLVLATG

SEQ ID NO: 408669 - protein, 11 aa, Influenza virus
SERLVLATGLR

SEQ ID NO: 408670 - protein, 11 aa, Influenza virus
ERLVLATGLRN

SEQ ID NO: 408671 - protein, 11 aa, Influenza virus
RLVLATGLRNI

SEQ ID NO: 408672 - protein, 11 aa, Influenza virus
LVLATGPRNVP

SEQ ID NO: 408673 - protein, 11 aa, Influenza virus
VLATGPRNVPQ

SEQ ID NO: 408674 - protein, 11 aa, Influenza virus
LATGPRNVPQI

SEQ ID NO: 408675 - protein, 11 aa, Influenza virus
ATGLRNVPQME

SEQ ID NO: 408676 - protein, 11 aa, Influenza virus
RNVPQMESRGL

SEQ ID NO: 408677 - protein, 11 aa, Influenza virus
NVPQMESRGLF

SEQ ID NO: 408678 - protein, 11 aa, Influenza virus
VPQMESRGLFG

SEQ ID NO: 408679 - protein, 11 aa, Influenza virus
PQIEPRGLFGA

SEQ ID NO: 408680 - protein, 11 aa, Influenza virus
KMESRGLFGAI

SEQ ID NO: 408681 - protein, 11 aa, Influenza virus
IEARGLFGAIA

SEQ ID NO: 408682 - protein, 11 aa, Influenza virus
DQGAGYAADKE

SEQ ID NO: 408683 - protein, 11 aa, Influenza virus
QGAGYAADKES

SEQ ID NO: 408684 - protein, 11 aa, Influenza virus
GAGYAADKEST

SEQ ID NO: 408685 - protein, 11 aa, Influenza virus
AGYAADKESTQ

SEQ ID NO: 408686 - protein, 11 aa, Influenza virus
GYAADKESTQR

SEQ ID NO: 408687 - protein, 11 aa, Influenza virus
YAADKESTQRA

SEQ ID NO: 408688 - protein, 11 aa, Influenza virus
AADKASTQKAI

SEQ ID NO: 408689 - protein, 11 aa, Influenza virus
KEFNNLERRLE

SEQ ID NO: 408690 - protein, 11 aa, Influenza virus
EFNNLERRLEN

SEQ ID NO: 408691 - protein, 11 aa, Influenza virus
FNNLERRLENL

SEQ ID NO: 408692 - protein, 11 aa, Influenza virus
NLERRLENLSK

SEQ ID NO: 408693 - protein, 11 aa, Influenza virus
LERRLENLSKR

SEQ ID NO: 408694 - protein, 11 aa, Influenza virus
RLENLDKKMED

SEQ ID NO: 408695 - protein, 11 aa, Influenza virus
LENLNKRMEDG

SEQ ID NO: 408696 - protein, 11 aa, Influenza virus
VEDGFLDVWTY

SEQ ID NO: 408697 - protein, 11 aa, Influenza virus
EDGFLGVWTYN

SEQ ID NO: 408698 - protein, 11 aa, Influenza virus
DGFLGVWTYNA

SEQ ID NO: 408699 - protein, 11 aa, Influenza virus
GFLDVWTYNTE

SEQ ID NO: 408700 - protein, 11 aa, Influenza virus
FRDVWTYNAEL

SEQ ID NO: 408701 - protein, 11 aa, Influenza virus
LDVWTYNTELL

SEQ ID NO: 408702 - protein, 11 aa, Influenza virus
LVLMENERILD

SEQ ID NO: 408703 - protein, 11 aa, Influenza virus
VLMENERILDF

SEQ ID NO: 408704 - protein, 11 aa, Influenza virus
LMENERTLGFH

SEQ ID NO: 408705 - protein, 11 aa, Influenza virus
MENERILDFHD

SEQ ID NO: 408706 - protein, 11 aa, Influenza virus
ENERILDFHDS

SEQ ID NO: 408707 - protein, 11 aa, Influenza virus
NERILDFHDSN

SEQ ID NO: 408708 - protein, 11 aa, Influenza virus
ERILDFHDSNV

SEQ ID NO: 408709 - protein, 11 aa, Influenza virus
RTLDFHDSNVR

SEQ ID NO: 408710 - protein, 11 aa, Influenza virus
TLDFHDSNVRN

SEQ ID NO: 408711 - protein, 11 aa, Influenza virus
LDFHDSNVRNL

SEQ ID NO: 408712 - protein, 11 aa, Influenza virus
DFHDSNVRNLY

SEQ ID NO: 408713 - protein, 11 aa, Influenza virus
FHDSNVKNLYN

SEQ ID NO: 408714 - protein, 11 aa, Influenza virus
VKNLYNKVRMQ

SEQ ID NO: 408715 - protein, 11 aa, Influenza virus
KNLYNKVRMQL

SEQ ID NO: 408716 - protein, 11 aa, Influenza virus
NLYNKVRMQLR

SEQ ID NO: 408717 - protein, 11 aa, Influenza virus
LYEKVRMQLRD

SEQ ID NO: 408718 - protein, 11 aa, Influenza virus
YEKVRMQLRDN

SEQ ID NO: 408719 - protein, 11 aa, Influenza virus
NKVRMQLRDNV

SEQ ID NO: 408720 - protein, 11 aa, Influenza virus
RVRMQLRDNAK

SEQ ID NO: 408721 - protein, 11 aa, Influenza virus
RMQLRDNAKEL

SEQ ID NO: 408722 - protein, 11 aa, Influenza virus
MQLRDNAKELG

SEQ ID NO: 408723 - protein, 11 aa, Influenza virus
QLRDNAKELGN

SEQ ID NO: 408724 - protein, 11 aa, Influenza virus
LRDNAKELGNG

SEQ ID NO: 408725 - protein, 11 aa, Influenza virus
RDNAKELGNGC

SEQ ID NO: 408726 - protein, 11 aa, Influenza virus
DNAKELGNGCF

SEQ ID NO: 408727 - protein, 11 aa, Influenza virus
NAKELGNGCFE

SEQ ID NO: 408728 - protein, 11 aa, Influenza virus
AKELGNGCFEF

SEQ ID NO: 408729 - protein, 11 aa, Influenza virus
GCFEFYHKCND

SEQ ID NO: 408730 - protein, 11 aa, Influenza virus
CFEFYHKCNDE

SEQ ID NO: 408731 - protein, 11 aa, Influenza virus
FEFYHKCNDEC

SEQ ID NO: 408732 - protein, 11 aa, Influenza virus
EFYHKCNDECM

SEQ ID NO: 408733 - protein, 11 aa, Influenza virus
KNGTYYYPKYE

SEQ ID NO: 408734 - protein, 11 aa, Influenza virus
NGTYDYSKYEE

SEQ ID NO: 408735 - protein, 11 aa, Influenza virus
GTYNYPKYEEE

SEQ ID NO: 408736 - protein, 11 aa, Influenza virus
TYDYSKYEEES

SEQ ID NO: 408737 - protein, 11 aa, Influenza virus
YDYPKYEEESR

SEQ ID NO: 408738 - protein, 11 aa, Influenza virus
YYPKYEEESKL

SEQ ID NO: 408739 - protein, 11 aa, Influenza virus
YPKYEEESRLN

SEQ ID NO: 408740 - protein, 11 aa, Influenza virus
PKYEEESRLNR

SEQ ID NO: 408741 - protein, 11 aa, Influenza virus
KYEEESRLNRN

SEQ ID NO: 408742 - protein, 11 aa, Influenza virus
YEEESRLNRNE

SEQ ID NO: 408743 - protein, 11 aa, Influenza virus
EEESRLNRNEI

SEQ ID NO: 408744 - protein, 11 aa, Influenza virus
EESRLNRNEIK

SEQ ID NO: 408745 - protein, 11 aa, Influenza virus
ESRLNRNEIKG

SEQ ID NO: 408746 - protein, 11 aa, Influenza virus
SRLNRNEIKGV

SEQ ID NO: 408747 - protein, 11 aa, Influenza virus
RLNRNEIKGVK

SEQ ID NO: 408748 - protein, 11 aa, Influenza virus
LKRNEIKGVEL

SEQ ID NO: 408749 - protein, 11 aa, Influenza virus
KRNEIKGVELS

SEQ ID NO: 408750 - protein, 11 aa, Influenza virus
RNEIKGVELSS

SEQ ID NO: 408751 - protein, 11 aa, Influenza virus
NEIKGVELSSM

SEQ ID NO: 408752 - protein, 11 aa, Influenza virus
EIKGVELSSMG

SEQ ID NO: 408753 - protein, 11 aa, Influenza virus
IKGVKLSNMGI

SEQ ID NO: 408754 - protein, 11 aa, Influenza virus
KGVKLSNMGIY

SEQ ID NO: 408755 - protein, 11 aa, Influenza virus
GVKLSNMGIYQ

SEQ ID NO: 408756 - protein, 11 aa, Influenza virus
VKLSNMGIYQI

SEQ ID NO: 408757 - protein, 11 aa, Influenza virus
KLSNMGIYQIL

SEQ ID NO: 408758 - protein, 11 aa, Influenza virus
LSNMGIYQILA

SEQ ID NO: 408759 - protein, 11 aa, Influenza virus
SNMGIYQILAI

SEQ ID NO: 408760 - protein, 11 aa, Influenza virus
NMGIYQILAIY

SEQ ID NO: 408761 - protein, 11 aa, Influenza virus
MGVYQILVIYA

SEQ ID NO: 408762 - protein, 11 aa, Influenza virus
GVYQVLAIYAT

SEQ ID NO: 408763 - protein, 11 aa, Influenza virus
VYQVLAIYATV

SEQ ID NO: 408764 - protein, 11 aa, Influenza virus
VAGSLSLAIMV

SEQ ID NO: 408765 - protein, 11 aa, Influenza virus
AGSLSLAIMVA

SEQ ID NO: 408766 - protein, 11 aa, Influenza virus
GSLSLAIMVAG

SEQ ID NO: 408767 - protein, 11 aa, Influenza virus
SLSLAIMVAGI

SEQ ID NO: 408768 - protein, 11 aa, Influenza virus
LSLAIMVAGIS

SEQ ID NO: 408769 - protein, 11 aa, Influenza virus
AGIFLWMCSNG

SEQ ID NO: 408770 - protein, 11 aa, Influenza virus
GIFLWMCSNGS

SEQ ID NO: 408771 - protein, 11 aa, Influenza virus
IFLWMCSNGSL

SEQ ID NO: 408772 - protein, 11 aa, Influenza virus
FLWMCSNGSLQ

SEQ ID NO: 408773 - protein, 11 aa, Influenza virus
MNPNQKIITID

SEQ ID NO: 408774 - protein, 11 aa, Influenza virus
NPNQKIITMGS

SEQ ID NO: 408775 - protein, 11 aa, Influenza virus
NQKTITIGSVS

SEQ ID NO: 408776 - protein, 11 aa, Influenza virus
QKTITIGSVSL

SEQ ID NO: 408777 - protein, 11 aa, Influenza virus
QIAILAATVTL

SEQ ID NO: 408778 - protein, 11 aa, Influenza virus
IAILATTITLH

SEQ ID NO: 408779 - protein, 11 aa, Influenza virus
AILATTITLHF

SEQ ID NO: 408780 - protein, 11 aa, Influenza virus
ILAATVTLHFK

SEQ ID NO: 408781 - protein, 11 aa, Influenza virus
LAATVTLHFKQ

SEQ ID NO: 408782 - protein, 11 aa, Influenza virus
ATTVTLHFKQN

SEQ ID NO: 408783 - protein, 11 aa, Influenza virus
TITLHFKQNEC

SEQ ID NO: 408784 - protein, 11 aa, Influenza virus
WSKPQCHITGF

SEQ ID NO: 408785 - protein, 11 aa, Influenza virus
SKTQCQITGFA

SEQ ID NO: 408786 - protein, 11 aa, Influenza virus
KTQCQITGFAP

SEQ ID NO: 408787 - protein, 11 aa, Influenza virus
TQCQITGFAPF

SEQ ID NO: 408788 - protein, 11 aa, Influenza virus
QCHITGFAPFS

SEQ ID NO: 408789 - protein, 11 aa, Influenza virus
CHITGFAPFSK

SEQ ID NO: 408790 - protein, 11 aa, Influenza virus
HITGFAPFSKD

SEQ ID NO: 408791 - protein, 11 aa, Influenza virus
SKDNSIRLSAD

SEQ ID NO: 408792 - protein, 11 aa, Influenza virus
KDNSIRLSASG

SEQ ID NO: 408793 - protein, 11 aa, Influenza virus
DNSIRLSASGD

SEQ ID NO: 408794 - protein, 11 aa, Influenza virus
NSIRLSADGDI

SEQ ID NO: 408795 - protein, 11 aa, Influenza virus
SIRLSADGDIW

SEQ ID NO: 408796 - protein, 11 aa, Influenza virus
IRLSADGDIWV

SEQ ID NO: 408797 - protein, 11 aa, Influenza virus
RLSASGDIWVT

SEQ ID NO: 408798 - protein, 11 aa, Influenza virus
LSASGDIWVTR

SEQ ID NO: 408799 - protein, 11 aa, Influenza virus
SGGGDIWVTRE

SEQ ID NO: 408800 - protein, 11 aa, Influenza virus
ADGDIWVTREP

SEQ ID NO: 408801 - protein, 11 aa, Influenza virus
SGDIWVTREPY

SEQ ID NO: 408802 - protein, 11 aa, Influenza virus
WVTREPYVSCS

SEQ ID NO: 408803 - protein, 11 aa, Influenza virus
VKCYQFALGQG

SEQ ID NO: 408804 - protein, 11 aa, Influenza virus
QFALGQGTTLN

SEQ ID NO: 408805 - protein, 11 aa, Influenza virus
FALGQGTTLEN

SEQ ID NO: 408806 - protein, 11 aa, Influenza virus
ALGQGTTLNNK

SEQ ID NO: 408807 - protein, 11 aa, Influenza virus
LGQGTTLENKH

SEQ ID NO: 408808 - protein, 11 aa, Influenza virus
GQGTTLNNKHS

SEQ ID NO: 408809 - protein, 11 aa, Influenza virus
QGTTLNNKHSN

SEQ ID NO: 408810 - protein, 11 aa, Influenza virus
GTTLENKHSNG

SEQ ID NO: 408811 - protein, 11 aa, Influenza virus
TTLNNKHSNGT

SEQ ID NO: 408812 - protein, 11 aa, Influenza virus
TLDNKHSNDTV

SEQ ID NO: 408813 - protein, 11 aa, Influenza virus
LDNKHSNDTVH

SEQ ID NO: 408814 - protein, 11 aa, Influenza virus
DNKHSNDTVHD

SEQ ID NO: 408815 - protein, 11 aa, Influenza virus
NKHSNDTVHDR

SEQ ID NO: 408816 - protein, 11 aa, Influenza virus
TIHDRTPHRTL

SEQ ID NO: 408817 - protein, 11 aa, Influenza virus
IHDRTPHRTLL

SEQ ID NO: 408818 - protein, 11 aa, Influenza virus
HDRSPHRTLLM

SEQ ID NO: 408819 - protein, 11 aa, Influenza virus
DRSPHRTLLMN

SEQ ID NO: 408820 - protein, 11 aa, Influenza virus
RSPHRTLLMNE

SEQ ID NO: 408821 - protein, 11 aa, Influenza virus
SPHRTLLMNEL

SEQ ID NO: 408822 - protein, 11 aa, Influenza virus
ELGVSFHLGTK

SEQ ID NO: 408823 - protein, 11 aa, Influenza virus
LGVSFHLGTKQ

SEQ ID NO: 408824 - protein, 11 aa, Influenza virus
GVSFHLGTKQV

SEQ ID NO: 408825 - protein, 11 aa, Influenza virus
VSFHLGTKQVC

SEQ ID NO: 408826 - protein, 11 aa, Influenza virus
FHLGTKQVCIA

SEQ ID NO: 408827 - protein, 11 aa, Influenza virus
HLGTKQVCIAW

SEQ ID NO: 408828 - protein, 11 aa, Influenza virus
LGTKQVCIAWS

SEQ ID NO: 408829 - protein, 11 aa, Influenza virus
GTKQVCIAWSS

SEQ ID NO: 408830 - protein, 11 aa, Influenza virus
TKQVCIAWSSS

SEQ ID NO: 408831 - protein, 11 aa, Influenza virus
KQVCIAWSSSS

SEQ ID NO: 408832 - protein, 11 aa, Influenza virus
QVCAAWSSSSC

SEQ ID NO: 408833 - protein, 11 aa, Influenza virus
VCAAWSSSSCH

SEQ ID NO: 408834 - protein, 11 aa, Influenza virus
CAAWSSSSCHD

SEQ ID NO: 408835 - protein, 11 aa, Influenza virus
AAWSSSSCHDG

SEQ ID NO: 408836 - protein, 11 aa, Influenza virus
SCHDGKAWLHI

SEQ ID NO: 408837 - protein, 11 aa, Influenza virus
CHDGKAWLHIC

SEQ ID NO: 408838 - protein, 11 aa, Influenza virus
HDGRAWLHVCV

SEQ ID NO: 408839 - protein, 11 aa, Influenza virus
DGRAWLHVCVT

SEQ ID NO: 408840 - protein, 11 aa, Influenza virus
GRAWLHVCVTG

SEQ ID NO: 408841 - protein, 11 aa, Influenza virus
RAWLHVCVTGD

SEQ ID NO: 408842 - protein, 11 aa, Influenza virus
AWLHICVTGDD

SEQ ID NO: 408843 - protein, 11 aa, Influenza virus
CITGDDKNATA

SEQ ID NO: 408844 - protein, 11 aa, Influenza virus
ITGDDKNATAS

SEQ ID NO: 408845 - protein, 11 aa, Influenza virus
TGDDRNATASL

SEQ ID NO: 408846 - protein, 11 aa, Influenza virus
GDDRNATASLI

SEQ ID NO: 408847 - protein, 11 aa, Influenza virus
DDRNATASLIY

SEQ ID NO: 408848 - protein, 11 aa, Influenza virus
DSVGSWSQNIL

SEQ ID NO: 408849 - protein, 11 aa, Influenza virus
SISSWSQNILR

SEQ ID NO: 408850 - protein, 11 aa, Influenza virus
IGSWSHNILRT

SEQ ID NO: 408851 - protein, 11 aa, Influenza virus
GSWSHNILRTQ

SEQ ID NO: 408852 - protein, 11 aa, Influenza virus
RTQESECICIN

SEQ ID NO: 408853 - protein, 11 aa, Influenza virus
THESECVCING

SEQ ID NO: 408854 - protein, 11 aa, Influenza virus
QESECVCINGI

SEQ ID NO: 408855 - protein, 11 aa, Influenza virus
ESECVCINGIC

SEQ ID NO: 408856 - protein, 11 aa, Influenza virus
SECVCINGICT

SEQ ID NO: 408857 - protein, 11 aa, Influenza virus
ECVCINGICTV

SEQ ID NO: 408858 - protein, 11 aa, Influenza virus
CVCINGICTVV

SEQ ID NO: 408859 - protein, 11 aa, Influenza virus
VCINGICTVVM

SEQ ID NO: 408860 - protein, 11 aa, Influenza virus
CINGICTVVMT

SEQ ID NO: 408861 - protein, 11 aa, Influenza virus
INGICTVVMTD

SEQ ID NO: 408862 - protein, 11 aa, Influenza virus
NGICTVVMTDG

SEQ ID NO: 408863 - protein, 11 aa, Influenza virus
GICTVVMTDGS

SEQ ID NO: 408864 - protein, 11 aa, Influenza virus
ICTVVMTDGSA

SEQ ID NO: 408865 - protein, 11 aa, Influenza virus
DGSASGRADTK

SEQ ID NO: 408866 - protein, 11 aa, Influenza virus
GSASGRADTKI

SEQ ID NO: 408867 - protein, 11 aa, Influenza virus
SASGRADTKIL

SEQ ID NO: 408868 - protein, 11 aa, Influenza virus
ASGRADTKILF

SEQ ID NO: 408869 - protein, 11 aa, Influenza virus
SGKADTRILFV

SEQ ID NO: 408870 - protein, 11 aa, Influenza virus
ADTRILFVKEG

SEQ ID NO: 408871 - protein, 11 aa, Influenza virus
DTRILFVKEGK

SEQ ID NO: 408872 - protein, 11 aa, Influenza virus
VHIGPLSGSAQ

SEQ ID NO: 408873 - protein, 11 aa, Influenza virus
HISPLAGSAQH

SEQ ID NO: 408874 - protein, 11 aa, Influenza virus
IGPLSGSAQHI

SEQ ID NO: 408875 - protein, 11 aa, Influenza virus
GPLSGSAQHIE

SEQ ID NO: 408876 - protein, 11 aa, Influenza virus
PLAGSAQHVEE

SEQ ID NO: 408877 - protein, 11 aa, Influenza virus
LAGSAQHVEEC

SEQ ID NO: 408878 - protein, 11 aa, Influenza virus
AGSAQHVEECS

SEQ ID NO: 408879 - protein, 11 aa, Influenza virus
QHIEECSCYPQ

SEQ ID NO: 408880 - protein, 11 aa, Influenza virus
HIEECSCYSRY

SEQ ID NO: 408881 - protein, 11 aa, Influenza virus
IEECSCYPQYP

SEQ ID NO: 408882 - protein, 11 aa, Influenza virus
EECSCYPRYPN

SEQ ID NO: 408883 - protein, 11 aa, Influenza virus
ECSCYPRYPNV

SEQ ID NO: 408884 - protein, 11 aa, Influenza virus
CSCYPRYPNVR

SEQ ID NO: 408885 - protein, 11 aa, Influenza virus
SCYPRYPNVRC

SEQ ID NO: 408886 - protein, 11 aa, Influenza virus
YPNVRCVCRDN

SEQ ID NO: 408887 - protein, 11 aa, Influenza virus
PNVRCVCRDNW

SEQ ID NO: 408888 - protein, 11 aa, Influenza virus
VRCVCRDNWRG

SEQ ID NO: 408889 - protein, 11 aa, Influenza virus
RCVCRDNWRGS

SEQ ID NO: 408890 - protein, 11 aa, Influenza virus
CVCRDNWRGSN

SEQ ID NO: 408891 - protein, 11 aa, Influenza virus
VCRDNWRGSNR

SEQ ID NO: 408892 - protein, 11 aa, Influenza virus
RDNWRGSNRPV

SEQ ID NO: 408893 - protein, 11 aa, Influenza virus
DISMEDYSIDS

SEQ ID NO: 408894 - protein, 11 aa, Influenza virus
EYSIDSSYVCS

SEQ ID NO: 408895 - protein, 11 aa, Influenza virus
YSIDSGYVCSG

SEQ ID NO: 408896 - protein, 11 aa, Influenza virus
SIDSNYVCSGL

SEQ ID NO: 408897 - protein, 11 aa, Influenza virus
IDSGYVCSGLV

SEQ ID NO: 408898 - protein, 11 aa, Influenza virus
DSGYVCSGLVG

SEQ ID NO: 408899 - protein, 11 aa, Influenza virus
SGYVCSGLVGD

SEQ ID NO: 408900 - protein, 11 aa, Influenza virus
NYVCSGLVGDT

SEQ ID NO: 408901 - protein, 11 aa, Influenza virus
SGLVGDTPRSD

SEQ ID NO: 408902 - protein, 11 aa, Influenza virus
GLVGDTPRNND

SEQ ID NO: 408903 - protein, 11 aa, Influenza virus
LVGDTPRNGDS

SEQ ID NO: 408904 - protein, 11 aa, Influenza virus
VGDTPRNGDSS

SEQ ID NO: 408905 - protein, 11 aa, Influenza virus
GDTPRNDDRFS

SEQ ID NO: 408906 - protein, 11 aa, Influenza virus
SSSNCRDPNNE

SEQ ID NO: 408907 - protein, 11 aa, Influenza virus
SNCRNPNNEKG

SEQ ID NO: 408908 - protein, 11 aa, Influenza virus
PNNEKGNQGVK

SEQ ID NO: 408909 - protein, 11 aa, Influenza virus
NNEKGNQGVKG

SEQ ID NO: 408910 - protein, 11 aa, Influenza virus
NEKGNQGVKGW

SEQ ID NO: 408911 - protein, 11 aa, Influenza virus
EKGNQGVKGWA

SEQ ID NO: 408912 - protein, 11 aa, Influenza virus
KGNQGVKGWAF

SEQ ID NO: 408913 - protein, 11 aa, Influenza virus
GTQGVKGWAFD

SEQ ID NO: 408914 - protein, 11 aa, Influenza virus
PGVKGWAFDSG

SEQ ID NO: 408915 - protein, 11 aa, Influenza virus
KDSRSGYETFR

SEQ ID NO: 408916 - protein, 11 aa, Influenza virus
DSRSGYETFRV

SEQ ID NO: 408917 - protein, 11 aa, Influenza virus
SRSGYETFRVI

SEQ ID NO: 408918 - protein, 11 aa, Influenza virus
RSGYETFRVTG

SEQ ID NO: 408919 - protein, 11 aa, Influenza virus
LGYETFKVIGG

SEQ ID NO: 408920 - protein, 11 aa, Influenza virus
YETFRVIGGWA

SEQ ID NO: 408921 - protein, 11 aa, Influenza virus
ETFRVIGGWAT

SEQ ID NO: 408922 - protein, 11 aa, Influenza virus
SNNWSGYSGIF

SEQ ID NO: 408923 - protein, 11 aa, Influenza virus
NNRSGYSGIFS

SEQ ID NO: 408924 - protein, 11 aa, Influenza virus
SGYSGIFSVEH

SEQ ID NO: 408925 - protein, 11 aa, Influenza virus
GYSGIFSVENK

SEQ ID NO: 408926 - protein, 11 aa, Influenza virus
KRCINRCFYVE

SEQ ID NO: 408927 - protein, 11 aa, Influenza virus
RCINRCFYVEL

SEQ ID NO: 408928 - protein, 11 aa, Influenza virus
CFYVELIRGRQ

SEQ ID NO: 408929 - protein, 11 aa, Influenza virus
FYVELIRGRQQ

SEQ ID NO: 408930 - protein, 11 aa, Influenza virus
YVELIRGRQQE

SEQ ID NO: 408931 - protein, 11 aa, Influenza virus
TRVWWTSNSIA

SEQ ID NO: 408932 - protein, 11 aa, Influenza virus
WWTSSSIVVFC

SEQ ID NO: 408933 - protein, 11 aa, Influenza virus
WTSSSIVVFCG

SEQ ID NO: 408934 - protein, 11 aa, Influenza virus
TSSSIVVFCGT

SEQ ID NO: 408935 - protein, 11 aa, Influenza virus
SNSIVVFVAPS

SEQ ID NO: 408936 - protein, 11 aa, Influenza virus
GKGSWPDGANI

SEQ ID NO: 408937 - protein, 11 aa, Influenza virus
TGSWPDGANID

SEQ ID NO: 408938 - protein, 11 aa, Influenza virus
GSWPDGADINF

SEQ ID NO: 408939 - protein, 11 aa, Influenza virus
SWPDGADINFM

SEQ ID NO: 408940 - protein, 11 aa, Influenza virus
WPDGADINFMP

SEQ ID NO: 408941 - protein, 11 aa, Influenza virus
PDGADINFMPI

SEQ ID NO: 408942 - protein, 11 aa, Influenza virus
IFNFILLTHWA

SEQ ID NO: 408943 - protein, 11 aa, Influenza virus
FIFLLLTHWAY

SEQ ID NO: 408944 - protein, 11 aa, Influenza virus
AATLCLGHHAV

SEQ ID NO: 408945 - protein, 11 aa, Influenza virus
ATLCLGHHAVQ

SEQ ID NO: 408946 - protein, 11 aa, Influenza virus
TLCLGHHAVQN

SEQ ID NO: 408947 - protein, 11 aa, Influenza virus
LCLGHHAVQNG

SEQ ID NO: 408948 - protein, 11 aa, Influenza virus
CLGHHAVQNGT

SEQ ID NO: 408949 - protein, 11 aa, Influenza virus
DQVEVTNATEL

SEQ ID NO: 408950 - protein, 11 aa, Influenza virus
QVEVTNATELV

SEQ ID NO: 408951 - protein, 11 aa, Influenza virus
EVTNATELVQI

SEQ ID NO: 408952 - protein, 11 aa, Influenza virus
CTLIDAMLGDP

SEQ ID NO: 408953 - protein, 11 aa, Influenza virus
SLRSIVASSGT

SEQ ID NO: 408954 - protein, 11 aa, Influenza virus
LRSIVASSGTL

SEQ ID NO: 408955 - protein, 11 aa, Influenza virus
FDKLYIWGIHH

SEQ ID NO: 408956 - protein, 11 aa, Influenza virus
DKLYIWGIHHP

SEQ ID NO: 408957 - protein, 11 aa, Influenza virus
SNGNLVAPRGY

SEQ ID NO: 408958 - protein, 11 aa, Influenza virus
NGNLVAPRGYF

SEQ ID NO: 408959 - protein, 11 aa, Influenza virus
GNLIAPRGYFR

SEQ ID NO: 408960 - protein, 11 aa, Influenza virus
ACITPNGSIPN

SEQ ID NO: 408961 - protein, 11 aa, Influenza virus
CITPNGSIPNE

SEQ ID NO: 408962 - protein, 11 aa, Influenza virus
KPFQNVNKVTY

SEQ ID NO: 408963 - protein, 11 aa, Influenza virus
PFQNVNKVTYG

SEQ ID NO: 408964 - protein, 11 aa, Influenza virus
LATGMRNIPEK

SEQ ID NO: 408965 - protein, 11 aa, Influenza virus
KGLFGAIAGFI

SEQ ID NO: 408966 - protein, 11 aa, Influenza virus
GFIENGWEGMM

SEQ ID NO: 408967 - protein, 11 aa, Influenza virus
FIENGWEGMMD

SEQ ID NO: 408968 - protein, 11 aa, Influenza virus
IENGWEGMMDG

SEQ ID NO: 408969 - protein, 11 aa, Influenza virus
ENGWEGMMDGW

SEQ ID NO: 408970 - protein, 11 aa, Influenza virus
NGWEGMMDGWY

SEQ ID NO: 408971 - protein, 11 aa, Influenza virus
GWEGMMDGWYG

SEQ ID NO: 408972 - protein, 11 aa, Influenza virus
WEGMMDGWYGF

SEQ ID NO: 408973 - protein, 11 aa, Influenza virus
EGMMDGWYGFR

SEQ ID NO: 408974 - protein, 11 aa, Influenza virus
GMMDGWYGFRH

SEQ ID NO: 408975 - protein, 11 aa, Influenza virus
NGWYGFRHQNS

SEQ ID NO: 408976 - protein, 11 aa, Influenza virus
GWYGFRHLNSE

SEQ ID NO: 408977 - protein, 11 aa, Influenza virus
WYGFRHHNSEG

SEQ ID NO: 408978 - protein, 11 aa, Influenza virus
NSEGRGQAADL

SEQ ID NO: 408979 - protein, 11 aa, Influenza virus
SEGRGQAADLK

SEQ ID NO: 408980 - protein, 11 aa, Influenza virus
EGRGQAADLKS

SEQ ID NO: 408981 - protein, 11 aa, Influenza virus
GRGQAADLKST

SEQ ID NO: 408982 - protein, 11 aa, Influenza virus
RGQAADLKSTQ

SEQ ID NO: 408983 - protein, 11 aa, Influenza virus
AADFKSTQAAI

SEQ ID NO: 408984 - protein, 11 aa, Influenza virus
DLKSTQTAIDQ

SEQ ID NO: 408985 - protein, 11 aa, Influenza virus
IERTNEKFHQI

SEQ ID NO: 408986 - protein, 11 aa, Influenza virus
ERTNEKFHQIE

SEQ ID NO: 408987 - protein, 11 aa, Influenza virus
EKEFTEVEGRI

SEQ ID NO: 408988 - protein, 11 aa, Influenza virus
KEFTEVEGRIQ

SEQ ID NO: 408989 - protein, 11 aa, Influenza virus
EFTEVEGRIQD

SEQ ID NO: 408990 - protein, 11 aa, Influenza virus
FTEVEGRIQDL

SEQ ID NO: 408991 - protein, 11 aa, Influenza virus
TEVEGRIQDLE

SEQ ID NO: 408992 - protein, 11 aa, Influenza virus
EVEGRIQDLER

SEQ ID NO: 408993 - protein, 11 aa, Influenza virus
VEGRIQDLERY

SEQ ID NO: 408994 - protein, 11 aa, Influenza virus
EGRIQDLEKYI

SEQ ID NO: 408995 - protein, 11 aa, Influenza virus
GRIQDLEKYIE

SEQ ID NO: 408996 - protein, 11 aa, Influenza virus
RIQDLEKYIED

SEQ ID NO: 408997 - protein, 11 aa, Influenza virus
IQDLEKYIEDT

SEQ ID NO: 408998 - protein, 11 aa, Influenza virus
DLERYVEDTKI

SEQ ID NO: 408999 - protein, 11 aa, Influenza virus
LERYVEDTKID

SEQ ID NO: 409000 - protein, 11 aa, Influenza virus
ERYVEDTKIDL

SEQ ID NO: 409001 - protein, 11 aa, Influenza virus
RYVEDTKIDLW

SEQ ID NO: 409002 - protein, 11 aa, Influenza virus
TKIDLWSYNAG

SEQ ID NO: 409003 - protein, 11 aa, Influenza virus
KIDLWSYNAGL

SEQ ID NO: 409004 - protein, 11 aa, Influenza virus
IDLWSYNAGLL

SEQ ID NO: 409005 - protein, 11 aa, Influenza virus
DLWSYNADVLV

SEQ ID NO: 409006 - protein, 11 aa, Influenza virus
LWSYNADVLVA

SEQ ID NO: 409007 - protein, 11 aa, Influenza virus
WSYNADVLVAL

SEQ ID NO: 409008 - protein, 11 aa, Influenza virus
SYNADVLVALE

SEQ ID NO: 409009 - protein, 11 aa, Influenza virus
YNADVLVALEN

SEQ ID NO: 409010 - protein, 11 aa, Influenza virus
NADVLVALENQ

SEQ ID NO: 409011 - protein, 11 aa, Influenza virus
LLVALENQNTI

SEQ ID NO: 409012 - protein, 11 aa, Influenza virus
LVALENQNTID

SEQ ID NO: 409013 - protein, 11 aa, Influenza virus
VALENQNTIDL

SEQ ID NO: 409014 - protein, 11 aa, Influenza virus
ALENQNTIDLT

SEQ ID NO: 409015 - protein, 11 aa, Influenza virus
LENQNTIDLTD

SEQ ID NO: 409016 - protein, 11 aa, Influenza virus
ENQHTIHLTDS

SEQ ID NO: 409017 - protein, 11 aa, Influenza virus
NQHTIHLTDSE

SEQ ID NO: 409018 - protein, 11 aa, Influenza virus
QHTIHLTDSEM

SEQ ID NO: 409019 - protein, 11 aa, Influenza virus
TRKQLRENAED

SEQ ID NO: 409020 - protein, 11 aa, Influenza virus
KQLRENAEDLG

SEQ ID NO: 409021 - protein, 11 aa, Influenza virus
QLRENAEDMGD

SEQ ID NO: 409022 - protein, 11 aa, Influenza virus
LRENAEDMGDG

SEQ ID NO: 409023 - protein, 11 aa, Influenza virus
RENAEDMGDGC

SEQ ID NO: 409024 - protein, 11 aa, Influenza virus
ENAEDMGNGCL

SEQ ID NO: 409025 - protein, 11 aa, Influenza virus
GCLKIYHKCDN

SEQ ID NO: 409026 - protein, 11 aa, Influenza virus
EYKDWILWISF

SEQ ID NO: 409027 - protein, 11 aa, Influenza virus
YKNWILWISFA

SEQ ID NO: 409028 - protein, 11 aa, Influenza virus
KDWILWISFAT

SEQ ID NO: 409029 - protein, 11 aa, Influenza virus
DWILWISFATS

SEQ ID NO: 409030 - protein, 11 aa, Influenza virus
WILWISFATSC

SEQ ID NO: 409031 - protein, 11 aa, Influenza virus
ILWISFATSCF

SEQ ID NO: 409032 - protein, 11 aa, Influenza virus
LWISFAMSCFL

SEQ ID NO: 409033 - protein, 11 aa, Influenza virus
GFIVWACQRGN

SEQ ID NO: 409034 - protein, 11 aa, Influenza virus
MWACQKGNIKC

SEQ ID NO: 409035 - protein, 11 aa, Influenza virus
WACQKGNIKCN

SEQ ID NO: 409036 - protein, 11 aa, Influenza virus
ACQKGNIKCNI

SEQ ID NO: 409037 - protein, 11 aa, Influenza virus
CQKGNIKCNIC

SEQ ID NO: 409038 - protein, 11 aa, Influenza virus
QKGNIKCNICI

SEQ ID NO: 409039 - protein, 11 aa, Influenza virus
AATLCLGHHAV

SEQ ID NO: 409040 - protein, 11 aa, Influenza virus
LGHHAVPNGTV

SEQ ID NO: 409041 - protein, 11 aa, Influenza virus
GHHAVPNGTVV

SEQ ID NO: 409042 - protein, 11 aa, Influenza virus
HHAVPNGTVVK

SEQ ID NO: 409043 - protein, 11 aa, Influenza virus
HAVPNGTVVKT

SEQ ID NO: 409044 - protein, 11 aa, Influenza virus
AVPNGTVVKTI

SEQ ID NO: 409045 - protein, 11 aa, Influenza virus
VPNGTVVKTIT

SEQ ID NO: 409046 - protein, 11 aa, Influenza virus
DQVEVTNATEL

SEQ ID NO: 409047 - protein, 11 aa, Influenza virus
QVEVTNATELV

SEQ ID NO: 409048 - protein, 11 aa, Influenza virus
EVTNATELVQI

SEQ ID NO: 409049 - protein, 11 aa, Influenza virus
CTLVDALLGDP

SEQ ID NO: 409050 - protein, 11 aa, Influenza virus
TLMDALLGDPH

SEQ ID NO: 409051 - protein, 11 aa, Influenza virus
LMDALLGDPHC

SEQ ID NO: 409052 - protein, 11 aa, Influenza virus
MDALLGDPHCD

SEQ ID NO: 409053 - protein, 11 aa, Influenza virus
SLRSIVASSGT

SEQ ID NO: 409054 - protein, 11 aa, Influenza virus
LRSIVASSGTL

SEQ ID NO: 409055 - protein, 11 aa, Influenza virus
RSIVASSGTLE

SEQ ID NO: 409056 - protein, 11 aa, Influenza virus
SIVASSGTLEF

SEQ ID NO: 409057 - protein, 11 aa, Influenza virus
SDKLYIWGVHH

SEQ ID NO: 409058 - protein, 11 aa, Influenza virus
DKLYIWGIHHP

SEQ ID NO: 409059 - protein, 11 aa, Influenza virus
SIHWTIVKPGD

SEQ ID NO: 409060 - protein, 11 aa, Influenza virus
CTGNLIAPRGY

SEQ ID NO: 409061 - protein, 11 aa, Influenza virus
NGNLIAPRGYY

SEQ ID NO: 409062 - protein, 11 aa, Influenza virus
GNLIAPRGYYK

SEQ ID NO: 409063 - protein, 11 aa, Influenza virus
NLIAPRGYFKV

SEQ ID NO: 409064 - protein, 11 aa, Influenza virus
ECITPNGSISN

SEQ ID NO: 409065 - protein, 11 aa, Influenza virus
CITPNGSISND

SEQ ID NO: 409066 - protein, 11 aa, Influenza virus
TPNGSISNDKP

SEQ ID NO: 409067 - protein, 11 aa, Influenza virus
NGSISNDKPFQ

SEQ ID NO: 409068 - protein, 11 aa, Influenza virus
GSISNDKPFQN

SEQ ID NO: 409069 - protein, 11 aa, Influenza virus
FQNVNRITYGP

SEQ ID NO: 409070 - protein, 11 aa, Influenza virus
QNVNRITYGPC

SEQ ID NO: 409071 - protein, 11 aa, Influenza virus
NVNRITYGPCP

SEQ ID NO: 409072 - protein, 11 aa, Influenza virus
YIKQNTLKLAT

SEQ ID NO: 409073 - protein, 11 aa, Influenza virus
IKQNTLKLATG

SEQ ID NO: 409074 - protein, 11 aa, Influenza virus
KQKTLKLATGM

SEQ ID NO: 409075 - protein, 11 aa, Influenza virus
QKTLKLATGMR

SEQ ID NO: 409076 - protein, 11 aa, Influenza virus
KTLKLATGMRN

SEQ ID NO: 409077 - protein, 11 aa, Influenza virus
LATGMRNVPET

SEQ ID NO: 409078 - protein, 11 aa, Influenza virus
ATGMRNIPEKQ

SEQ ID NO: 409079 - protein, 11 aa, Influenza virus
TGMRNVPERQT

SEQ ID NO: 409080 - protein, 11 aa, Influenza virus
GMRNVPERQTR

SEQ ID NO: 409081 - protein, 11 aa, Influenza virus
MRNVPERQTRG

SEQ ID NO: 409082 - protein, 11 aa, Influenza virus
PETQTRGIFGA

SEQ ID NO: 409083 - protein, 11 aa, Influenza virus
ETQTRGIFGAI

SEQ ID NO: 409084 - protein, 11 aa, Influenza virus
TQTRGIFGAIA

SEQ ID NO: 409085 - protein, 11 aa, Influenza virus
GFIENGWEGMI

SEQ ID NO: 409086 - protein, 11 aa, Influenza virus
FIENGWEGMID

SEQ ID NO: 409087 - protein, 11 aa, Influenza virus
IENGWEGMIDG

SEQ ID NO: 409088 - protein, 11 aa, Influenza virus
ENGWEGMIDGW

SEQ ID NO: 409089 - protein, 11 aa, Influenza virus
NGWEGMIDGWY

SEQ ID NO: 409090 - protein, 11 aa, Influenza virus
GWEGMIDGWYG

SEQ ID NO: 409091 - protein, 11 aa, Influenza virus
WEGMIDGWYGF

SEQ ID NO: 409092 - protein, 11 aa, Influenza virus
EGMIDGWYGFR

SEQ ID NO: 409093 - protein, 11 aa, Influenza virus
GMIDGWYGFRH

SEQ ID NO: 409094 - protein, 11 aa, Influenza virus
MIDGWYGFRHQ

SEQ ID NO: 409095 - protein, 11 aa, Influenza virus
IDGWYGFRHQN

SEQ ID NO: 409096 - protein, 11 aa, Influenza virus
DGWYGFRHHNS

SEQ ID NO: 409097 - protein, 11 aa, Influenza virus
GWYGFRHLNSE

SEQ ID NO: 409098 - protein, 11 aa, Influenza virus
WYGFRHLNSEG

SEQ ID NO: 409099 - protein, 11 aa, Influenza virus
NSEGRGQAADL

SEQ ID NO: 409100 - protein, 11 aa, Influenza virus
SEGRGQAADLK

SEQ ID NO: 409101 - protein, 11 aa, Influenza virus
EGRGQAADLKS

SEQ ID NO: 409102 - protein, 11 aa, Influenza virus
GRGQAADLKST

SEQ ID NO: 409103 - protein, 11 aa, Influenza virus
RGQAADLKSTQ

SEQ ID NO: 409104 - protein, 11 aa, Influenza virus
AADLKSTQAAV

SEQ ID NO: 409105 - protein, 11 aa, Influenza virus
ADLKSTQAAVN

SEQ ID NO: 409106 - protein, 11 aa, Influenza virus
DLKSTQAAVNQ

SEQ ID NO: 409107 - protein, 11 aa, Influenza virus
IKKTNEKFHQI

SEQ ID NO: 409108 - protein, 11 aa, Influenza virus
KKTNEKFHQIE

SEQ ID NO: 409109 - protein, 11 aa, Influenza virus
GRIQDLEKYIE

SEQ ID NO: 409110 - protein, 11 aa, Influenza virus
RIQDLEKYIED

SEQ ID NO: 409111 - protein, 11 aa, Influenza virus
IQDLEKYIEDT

SEQ ID NO: 409112 - protein, 11 aa, Influenza virus
QDLEKYIEDTK

SEQ ID NO: 409113 - protein, 11 aa, Influenza virus
DLERYVEDTKI

SEQ ID NO: 409114 - protein, 11 aa, Influenza virus
LERYVEDTKID

SEQ ID NO: 409115 - protein, 11 aa, Influenza virus
ERYVEDTKIDL

SEQ ID NO: 409116 - protein, 11 aa, Influenza virus
RYVEDTKIDLW

SEQ ID NO: 409117 - protein, 11 aa, Influenza virus
TKVDLWSYNAE

SEQ ID NO: 409118 - protein, 11 aa, Influenza virus
KVDLWSYNAEL

SEQ ID NO: 409119 - protein, 11 aa, Influenza virus
VDLWSYNAELL

SEQ ID NO: 409120 - protein, 11 aa, Influenza virus
DLWSYNAELLI

SEQ ID NO: 409121 - protein, 11 aa, Influenza virus
LWSYNAELLIA

SEQ ID NO: 409122 - protein, 11 aa, Influenza virus
WSYNAEFLVAL

SEQ ID NO: 409123 - protein, 11 aa, Influenza virus
SYNAEFLVALE

SEQ ID NO: 409124 - protein, 11 aa, Influenza virus
YNAEFLVALEN

SEQ ID NO: 409125 - protein, 11 aa, Influenza virus
NAEFLVALENQ

SEQ ID NO: 409126 - protein, 11 aa, Influenza virus
FLVALENQHTI

SEQ ID NO: 409127 - protein, 11 aa, Influenza virus
LVALENQNTID

SEQ ID NO: 409128 - protein, 11 aa, Influenza virus
VALENQNTIDL

SEQ ID NO: 409129 - protein, 11 aa, Influenza virus
ALENQNTIDLT

SEQ ID NO: 409130 - protein, 11 aa, Influenza virus
LENQNTIDLTD

SEQ ID NO: 409131 - protein, 11 aa, Influenza virus
ENQNTIDLTDS

SEQ ID NO: 409132 - protein, 11 aa, Influenza virus
NQNTIDLTDSE

SEQ ID NO: 409133 - protein, 11 aa, Influenza virus
QNTIDLTDSEM

SEQ ID NO: 409134 - protein, 11 aa, Influenza virus
HTIHLTDSEMN

SEQ ID NO: 409135 - protein, 11 aa, Influenza virus
TIHLTDSEMNK

SEQ ID NO: 409136 - protein, 11 aa, Influenza virus
IHLTDSEMNKL

SEQ ID NO: 409137 - protein, 11 aa, Influenza virus
HLTDSEMNKLF

SEQ ID NO: 409138 - protein, 11 aa, Influenza virus
LTDSEMNKLFD

SEQ ID NO: 409139 - protein, 11 aa, Influenza virus
TDSEMSKLFER

SEQ ID NO: 409140 - protein, 11 aa, Influenza virus
DSEMSKLFERT

SEQ ID NO: 409141 - protein, 11 aa, Influenza virus
TRRQLRENAED

SEQ ID NO: 409142 - protein, 11 aa, Influenza virus
KQLRENAEDLG

SEQ ID NO: 409143 - protein, 11 aa, Influenza virus
ENAEEMGNGCF

SEQ ID NO: 409144 - protein, 11 aa, Influenza virus
NAEDMGNGCLK

SEQ ID NO: 409145 - protein, 11 aa, Influenza virus
AEDMGNGCLKI

SEQ ID NO: 409146 - protein, 11 aa, Influenza virus
EDMGNGCLKIY

SEQ ID NO: 409147 - protein, 11 aa, Influenza virus
MGNGCLKIYHK

SEQ ID NO: 409148 - protein, 11 aa, Influenza virus
GNGCLKIYHKC

SEQ ID NO: 409149 - protein, 11 aa, Influenza virus
NGCLKIYHKCD

SEQ ID NO: 409150 - protein, 11 aa, Influenza virus
GCLKIYHKCDN

SEQ ID NO: 409151 - protein, 11 aa, Influenza virus
IGSIRNETYDH

SEQ ID NO: 409152 - protein, 11 aa, Influenza virus
YRNEALNNRFQ

SEQ ID NO: 409153 - protein, 11 aa, Influenza virus
EYKDWILWISF

SEQ ID NO: 409154 - protein, 11 aa, Influenza virus
YKNWILWISFA

SEQ ID NO: 409155 - protein, 11 aa, Influenza virus
KDWILWISFAT

SEQ ID NO: 409156 - protein, 11 aa, Influenza virus
WILWISFATSC

SEQ ID NO: 409157 - protein, 11 aa, Influenza virus
ILWISFATSCF

SEQ ID NO: 409158 - protein, 11 aa, Influenza virus
LWISFAMSCFL

SEQ ID NO: 409159 - protein, 11 aa, Influenza virus
WISFAMSCFLL

SEQ ID NO: 409160 - protein, 11 aa, Influenza virus
ISFAMSCFLLC

SEQ ID NO: 409161 - protein, 11 aa, Influenza virus
LGFIMWTCQKG

SEQ ID NO: 409162 - protein, 11 aa, Influenza virus
GFIMWTCQKGN

SEQ ID NO: 409163 - protein, 11 aa, Influenza virus
FIMWTCQKGNI

SEQ ID NO: 409164 - protein, 11 aa, Influenza virus
IMWACQKGNIK

SEQ ID NO: 409165 - protein, 11 aa, Influenza virus
MWACQKGNIKC

SEQ ID NO: 409166 - protein, 11 aa, Influenza virus
WACQKGNIKCN

SEQ ID NO: 409167 - protein, 11 aa, Influenza virus
ACQKGNIKCNI

SEQ ID NO: 409168 - protein, 11 aa, Influenza virus
CQKGNIKCNIC

SEQ ID NO: 409169 - protein, 11 aa, Influenza virus
QKGNIKCNICI

SEQ ID NO: 409170 - protein, 11 aa, Influenza virus
DNSIRLAAGGD

SEQ ID NO: 409171 - protein, 11 aa, Influenza virus
NSIRLAAGGDI

SEQ ID NO: 409172 - protein, 11 aa, Influenza virus
SIRLAAGGDIW

SEQ ID NO: 409173 - protein, 11 aa, Influenza virus
IRLAAGGDIWV

SEQ ID NO: 409174 - protein, 11 aa, Influenza virus
RLAAGGDIWVT

SEQ ID NO: 409175 - protein, 11 aa, Influenza virus
LAAGGDIWVTR

SEQ ID NO: 409176 - protein, 11 aa, Influenza virus
AAGGDIWVTRE

SEQ ID NO: 409177 - protein, 11 aa, Influenza virus
AGGAIWVTREP

SEQ ID NO: 409178 - protein, 11 aa, Influenza virus
GGAIWVTREPY

SEQ ID NO: 409179 - protein, 11 aa, Influenza virus
GAIWVTREPYV

SEQ ID NO: 409180 - protein, 11 aa, Influenza virus
AIWVTREPYVS

SEQ ID NO: 409181 - protein, 11 aa, Influenza virus
WVTRELYVSCD

SEQ ID NO: 409182 - protein, 11 aa, Influenza virus
SKCYQFALGQG

SEQ ID NO: 409183 - protein, 11 aa, Influenza virus
QFALGQGTTLS

SEQ ID NO: 409184 - protein, 11 aa, Influenza virus
FALGQGTTLSN

SEQ ID NO: 409185 - protein, 11 aa, Influenza virus
RTPHRTLLMNE

SEQ ID NO: 409186 - protein, 11 aa, Influenza virus
TPHRTLLMNEL

SEQ ID NO: 409187 - protein, 11 aa, Influenza virus
LLMNELGIPFH

SEQ ID NO: 409188 - protein, 11 aa, Influenza virus
LMNELGIPFHL

SEQ ID NO: 409189 - protein, 11 aa, Influenza virus
MNELGIPFHLG

SEQ ID NO: 409190 - protein, 11 aa, Influenza virus
NELGIPFHLGT

SEQ ID NO: 409191 - protein, 11 aa, Influenza virus
ELGVPFYLGTK

SEQ ID NO: 409192 - protein, 11 aa, Influenza virus
LGVPFYLGTKQ

SEQ ID NO: 409193 - protein, 11 aa, Influenza virus
GVPFYLGTKQV

SEQ ID NO: 409194 - protein, 11 aa, Influenza virus
VPFYLGTKQVC

SEQ ID NO: 409195 - protein, 11 aa, Influenza virus
PFHLGTRQVCM

SEQ ID NO: 409196 - protein, 11 aa, Influenza virus
FHLGTRQVCMA

SEQ ID NO: 409197 - protein, 11 aa, Influenza virus
HLGTRQVCMAW

SEQ ID NO: 409198 - protein, 11 aa, Influenza virus
LGTRQVCMAWS

SEQ ID NO: 409199 - protein, 11 aa, Influenza virus
GTRQVCMAWSS

SEQ ID NO: 409200 - protein, 11 aa, Influenza virus
TRQVCMAWSSS

SEQ ID NO: 409201 - protein, 11 aa, Influenza virus
RQVCMAWSSSS

SEQ ID NO: 409202 - protein, 11 aa, Influenza virus
HDGRAWLHVCV

SEQ ID NO: 409203 - protein, 11 aa, Influenza virus
NILRTQESECV

SEQ ID NO: 409204 - protein, 11 aa, Influenza virus
QESECVCISGT

SEQ ID NO: 409205 - protein, 11 aa, Influenza virus
SECICINGTCT

SEQ ID NO: 409206 - protein, 11 aa, Influenza virus
ECICINGTCTV

SEQ ID NO: 409207 - protein, 11 aa, Influenza virus
CICINGTCTVV

SEQ ID NO: 409208 - protein, 11 aa, Influenza virus
CISGTCAVVMT

SEQ ID NO: 409209 - protein, 11 aa, Influenza virus
ISGTCAVVMTD

SEQ ID NO: 409210 - protein, 11 aa, Influenza virus
SGTCAVVMTDG

SEQ ID NO: 409211 - protein, 11 aa, Influenza virus
GTCTVVMTDGN

SEQ ID NO: 409212 - protein, 11 aa, Influenza virus
TCTVVMTDGNA

SEQ ID NO: 409213 - protein, 11 aa, Influenza virus
CTVVMTDGNAS

SEQ ID NO: 409214 - protein, 11 aa, Influenza virus
AVVMTDGSASG

SEQ ID NO: 409215 - protein, 11 aa, Influenza virus
LLGSAQHVEEC

SEQ ID NO: 409216 - protein, 11 aa, Influenza virus
LGSAQHVEECS

SEQ ID NO: 409217 - protein, 11 aa, Influenza virus
HVEECSCYPRF

SEQ ID NO: 409218 - protein, 11 aa, Influenza virus
VEECSCYPRYS

SEQ ID NO: 409219 - protein, 11 aa, Influenza virus
EECSCYPRYPD

SEQ ID NO: 409220 - protein, 11 aa, Influenza virus
IRCVCRDNWKG

SEQ ID NO: 409221 - protein, 11 aa, Influenza virus
RCVCRDNWRGS

SEQ ID NO: 409222 - protein, 11 aa, Influenza virus
CVCRDNWRGSN

SEQ ID NO: 409223 - protein, 11 aa, Influenza virus
VCRDNWRGSNR

SEQ ID NO: 409224 - protein, 11 aa, Influenza virus
RDNWRGSNRPI

SEQ ID NO: 409225 - protein, 11 aa, Influenza virus
DNWKGSNRPVI

SEQ ID NO: 409226 - protein, 11 aa, Influenza virus
NWKGSNRPVID

SEQ ID NO: 409227 - protein, 11 aa, Influenza virus
WKGSNRPVIDI

SEQ ID NO: 409228 - protein, 11 aa, Influenza virus
SSYMCSGLVGD

SEQ ID NO: 409229 - protein, 11 aa, Influenza virus
SYMCSGLVGDT

SEQ ID NO: 409230 - protein, 11 aa, Influenza virus
YLCSGLVGDTP

SEQ ID NO: 409231 - protein, 11 aa, Influenza virus
LCSGLVGDTPR

SEQ ID NO: 409232 - protein, 11 aa, Influenza virus
MSGYSGIFSVE

SEQ ID NO: 409233 - protein, 11 aa, Influenza virus
SGYSGIFSVEN

SEQ ID NO: 409234 - protein, 11 aa, Influenza virus
GYSGIFSVENK

SEQ ID NO: 409235 - protein, 11 aa, Influenza virus
KNCINRCFYVE

SEQ ID NO: 409236 - protein, 11 aa, Influenza virus
NCINRCFYVEL

SEQ ID NO: 409237 - protein, 11 aa, Influenza virus
VWWTSNSIVAF

SEQ ID NO: 409238 - protein, 11 aa, Influenza virus
WWTSNSIVAFC

SEQ ID NO: 409239 - protein, 11 aa, Influenza virus
AFCGTSGTYGT

SEQ ID NO: 409240 - protein, 11 aa, Influenza virus
YGSGSWPDGAD

SEQ ID NO: 409241 - protein, 11 aa, Influenza virus
DGADIKSHAYI

SEQ ID NO: 409242 - protein, 11 aa, Influenza virus
GADIKSHAYIS

SEQ ID NO: 409243 - protein, 11 aa, Influenza virus
YTENPVICLGH

SEQ ID NO: 409244 - protein, 11 aa, Influenza virus
TENPVICLGHH

SEQ ID NO: 409245 - protein, 11 aa, Influenza virus
GNPVICLGHHS

SEQ ID NO: 409246 - protein, 11 aa, Influenza virus
NPVICLGHHSV

SEQ ID NO: 409247 - protein, 11 aa, Influenza virus
IEVVAAQELVE

SEQ ID NO: 409248 - protein, 11 aa, Influenza virus
EVVTAQELVEA

SEQ ID NO: 409249 - protein, 11 aa, Influenza virus
CDIVNSALGSP

SEQ ID NO: 409250 - protein, 11 aa, Influenza virus
DIVNSALGSPG

SEQ ID NO: 409251 - protein, 11 aa, Influenza virus
IVNSALGSPGC

SEQ ID NO: 409252 - protein, 11 aa, Influenza virus
VNSALGSPGCD

SEQ ID NO: 409253 - protein, 11 aa, Influenza virus
NSALGSPGCDH

SEQ ID NO: 409254 - protein, 11 aa, Influenza virus
SALGSPGCDHL

SEQ ID NO: 409255 - protein, 11 aa, Influenza virus
CYPFDVPNYQS

SEQ ID NO: 409256 - protein, 11 aa, Influenza virus
VPNYQSLRSIL

SEQ ID NO: 409257 - protein, 11 aa, Influenza virus
PNYQSLRSILA

SEQ ID NO: 409258 - protein, 11 aa, Influenza virus
DYQSIRSILAN

SEQ ID NO: 409259 - protein, 11 aa, Influenza virus
IRSILANNGKF

SEQ ID NO: 409260 - protein, 11 aa, Influenza virus
LANNGKFEFIV

SEQ ID NO: 409261 - protein, 11 aa, Influenza virus
ANNGKFEFIVE

SEQ ID NO: 409262 - protein, 11 aa, Influenza virus
NNGKFEFIAED

SEQ ID NO: 409263 - protein, 11 aa, Influenza virus
NGKFEFIAEDF

SEQ ID NO: 409264 - protein, 11 aa, Influenza virus
TVKQDGKSSAC

SEQ ID NO: 409265 - protein, 11 aa, Influenza virus
VKQDGKSSACK

SEQ ID NO: 409266 - protein, 11 aa, Influenza virus
KQDGKSSACKR

SEQ ID NO: 409267 - protein, 11 aa, Influenza virus
QDGKSSACKRA

SEQ ID NO: 409268 - protein, 11 aa, Influenza virus
DGKSSACKRAN

SEQ ID NO: 409269 - protein, 11 aa, Influenza virus
QNLTKVNSGDY

SEQ ID NO: 409270 - protein, 11 aa, Influenza virus
NSGDYARLYIW

SEQ ID NO: 409271 - protein, 11 aa, Influenza virus
SGDYARLYIWG

SEQ ID NO: 409272 - protein, 11 aa, Influenza virus
GNYARLYIWGV

SEQ ID NO: 409273 - protein, 11 aa, Influenza virus
NYARLYIWGVH

SEQ ID NO: 409274 - protein, 11 aa, Influenza virus
IWGVHHPSTDA

SEQ ID NO: 409275 - protein, 11 aa, Influenza virus
WGVHHPSTDAE

SEQ ID NO: 409276 - protein, 11 aa, Influenza virus
GVHHPSTDAEQ

SEQ ID NO: 409277 - protein, 11 aa, Influenza virus
VRSQSGRISFY

SEQ ID NO: 409278 - protein, 11 aa, Influenza virus
RSQSGRISFYW

SEQ ID NO: 409279 - protein, 11 aa, Influenza virus
SQSGRISFYWT

SEQ ID NO: 409280 - protein, 11 aa, Influenza virus
LSSRISFYWTI

SEQ ID NO: 409281 - protein, 11 aa, Influenza virus
SSRISFYWTIV

SEQ ID NO: 409282 - protein, 11 aa, Influenza virus
GRISFYWTIVD

SEQ ID NO: 409283 - protein, 11 aa, Influenza virus
RISFYWTIVDP

SEQ ID NO: 409284 - protein, 11 aa, Influenza virus
ISFYWTIVDPG

SEQ ID NO: 409285 - protein, 11 aa, Influenza virus
SFYWTIVEPGN

SEQ ID NO: 409286 - protein, 11 aa, Influenza virus
PGDLILFNTIG

SEQ ID NO: 409287 - protein, 11 aa, Influenza virus
GDLILFNTIGN

SEQ ID NO: 409288 - protein, 11 aa, Influenza virus
DLILFNTIGNL

SEQ ID NO: 409289 - protein, 11 aa, Influenza virus
LIVFNTIGNLV

SEQ ID NO: 409290 - protein, 11 aa, Influenza virus
ILFNTIGNLIA

SEQ ID NO: 409291 - protein, 11 aa, Influenza virus
LFNTIGNLIAP

SEQ ID NO: 409292 - protein, 11 aa, Influenza virus
GNLIAPRGHYR

SEQ ID NO: 409293 - protein, 11 aa, Influenza virus
NLIAPRGHYRL

SEQ ID NO: 409294 - protein, 11 aa, Influenza virus
GECPKYVKQGS

SEQ ID NO: 409295 - protein, 11 aa, Influenza virus
DCPKYIKQGSL

SEQ ID NO: 409296 - protein, 11 aa, Influenza virus
CPRYVKQGSLK

SEQ ID NO: 409297 - protein, 11 aa, Influenza virus
PRYVKQGSLKL

SEQ ID NO: 409298 - protein, 11 aa, Influenza virus
RYVKQGSLKLA

SEQ ID NO: 409299 - protein, 11 aa, Influenza virus
YVKQGSLRLAT

SEQ ID NO: 409300 - protein, 11 aa, Influenza virus
VKQGSLRLATG

SEQ ID NO: 409301 - protein, 11 aa, Influenza virus
DLKSTQAAIDK

SEQ ID NO: 409302 - protein, 11 aa, Influenza virus
LKSTQAAIDKI

SEQ ID NO: 409303 - protein, 11 aa, Influenza virus
TQTAIDQITGK

SEQ ID NO: 409304 - protein, 11 aa, Influenza virus
QTAIDQITGKL

SEQ ID NO: 409305 - protein, 11 aa, Influenza virus
TAIDQITGKLN

SEQ ID NO: 409306 - protein, 11 aa, Influenza virus
AIDQISGKLNR

SEQ ID NO: 409307 - protein, 11 aa, Influenza virus
INQINGKLNRL

SEQ ID NO: 409308 - protein, 11 aa, Influenza virus
DQISGKLNRLI

SEQ ID NO: 409309 - protein, 11 aa, Influenza virus
QISGKLNRLIE

SEQ ID NO: 409310 - protein, 11 aa, Influenza virus
ITGKLNRLIEK

SEQ ID NO: 409311 - protein, 11 aa, Influenza virus
TGKLNRLIEKT

SEQ ID NO: 409312 - protein, 11 aa, Influenza virus
KLNRLIERTNE

SEQ ID NO: 409313 - protein, 11 aa, Influenza virus
LNRLIEKTNDK

SEQ ID NO: 409314 - protein, 11 aa, Influenza virus
NRLIERTNEKY

SEQ ID NO: 409315 - protein, 11 aa, Influenza virus
RLIEKTNDKYH

SEQ ID NO: 409316 - protein, 11 aa, Influenza virus
LIEKTNDKYHQ

SEQ ID NO: 409317 - protein, 11 aa, Influenza virus
IERTNEKYHQI

SEQ ID NO: 409318 - protein, 11 aa, Influenza virus
EKTNDKYHQIE

SEQ ID NO: 409319 - protein, 11 aa, Influenza virus
RTNEKYHQIEK

SEQ ID NO: 409320 - protein, 11 aa, Influenza virus
EKYHQIEKEFG

SEQ ID NO: 409321 - protein, 11 aa, Influenza virus
EKEFEQVEGRT

SEQ ID NO: 409322 - protein, 11 aa, Influenza virus
KEFEQVEGRTQ

SEQ ID NO: 409323 - protein, 11 aa, Influenza virus
EFEQVEGRIQY

SEQ ID NO: 409324 - protein, 11 aa, Influenza virus
FEQVEGRTQDL

SEQ ID NO: 409325 - protein, 11 aa, Influenza virus
QDLENYVEDTK

SEQ ID NO: 409326 - protein, 11 aa, Influenza virus
DLERYVEDTKI

SEQ ID NO: 409327 - protein, 11 aa, Influenza virus
LERYVEDTKID

SEQ ID NO: 409328 - protein, 11 aa, Influenza virus
ERYVEDTKIDL

SEQ ID NO: 409329 - protein, 11 aa, Influenza virus
RYVEDTKIDLW

SEQ ID NO: 409330 - protein, 11 aa, Influenza virus
ALENQHIIDVT

SEQ ID NO: 409331 - protein, 11 aa, Influenza virus
ENQHIIDVTDS

SEQ ID NO: 409332 - protein, 11 aa, Influenza virus
NQHTIDVADSE

SEQ ID NO: 409333 - protein, 11 aa, Influenza virus
QHTIDVADSEM

SEQ ID NO: 409334 - protein, 11 aa, Influenza virus
HTIDVTDSEMD

SEQ ID NO: 409335 - protein, 11 aa, Influenza virus
TDSEMNRLFER

SEQ ID NO: 409336 - protein, 11 aa, Influenza virus
DSEMNRLFERV

SEQ ID NO: 409337 - protein, 11 aa, Influenza virus
KLFERVKRQLR

SEQ ID NO: 409338 - protein, 11 aa, Influenza virus
LFERVKRQLRE

SEQ ID NO: 409339 - protein, 11 aa, Influenza virus
FERVKRQLREN

SEQ ID NO: 409340 - protein, 11 aa, Influenza virus
ERVKRQLRENA

SEQ ID NO: 409341 - protein, 11 aa, Influenza virus
RVKRQLRENAE

SEQ ID NO: 409342 - protein, 11 aa, Influenza virus
VKRQLRENAED

SEQ ID NO: 409343 - protein, 11 aa, Influenza virus
RHQLRENAEDK

SEQ ID NO: 409344 - protein, 11 aa, Influenza virus
HQLRENAEDKG

SEQ ID NO: 409345 - protein, 11 aa, Influenza virus
KGNGCFEIFHR

SEQ ID NO: 409346 - protein, 11 aa, Influenza virus
GNGCFEIFHRC

SEQ ID NO: 409347 - protein, 11 aa, Influenza virus
NGCFEIFHRCD

SEQ ID NO: 409348 - protein, 11 aa, Influenza virus
GCFEIFHRCDN

SEQ ID NO: 409349 - protein, 11 aa, Influenza virus
CDNKCIESIRN

SEQ ID NO: 409350 - protein, 11 aa, Influenza virus
NKCIESIRNGT

SEQ ID NO: 409351 - protein, 11 aa, Influenza virus
KCIESIRNGTY

SEQ ID NO: 409352 - protein, 11 aa, Influenza virus
ESIRNGTYDHN

SEQ ID NO: 409353 - protein, 11 aa, Influenza virus
YRNEAINNRFQ

SEQ ID NO: 409354 - protein, 11 aa, Influenza virus
RNEAINNRFQI

SEQ ID NO: 409355 - protein, 11 aa, Influenza virus
EAINSRFQIQG

SEQ ID NO: 409356 - protein, 11 aa, Influenza virus
AINSRFQIQGV

SEQ ID NO: 409357 - protein, 11 aa, Influenza virus
RFQIQGVKLAQ

SEQ ID NO: 409358 - protein, 11 aa, Influenza virus
FQIQGVKLAQG

SEQ ID NO: 409359 - protein, 11 aa, Influenza virus
QIQGVKLAQGY

SEQ ID NO: 409360 - protein, 11 aa, Influenza virus
IQGVKLAQGYK

SEQ ID NO: 409361 - protein, 11 aa, Influenza virus
QGVKLAQGYKD

SEQ ID NO: 409362 - protein, 11 aa, Influenza virus
KLAQGYKDIIL

SEQ ID NO: 409363 - protein, 11 aa, Influenza virus
LIQGYKDIILW

SEQ ID NO: 409364 - protein, 11 aa, Influenza virus
QGYKDIILWFS

SEQ ID NO: 409365 - protein, 11 aa, Influenza virus
GYKDVILWISF

SEQ ID NO: 409366 - protein, 11 aa, Influenza virus
YKDVILWISFS

SEQ ID NO: 409367 - protein, 11 aa, Influenza virus
KDIILWFSFSI

SEQ ID NO: 409368 - protein, 11 aa, Influenza virus
DIILWFSFSIS

SEQ ID NO: 409369 - protein, 11 aa, Influenza virus
IILWFSFSISC

SEQ ID NO: 409370 - protein, 11 aa, Influenza virus
ISFSISCFLLI

SEQ ID NO: 409371 - protein, 11 aa, Influenza virus
SFSISCFLLIA

SEQ ID NO: 409372 - protein, 11 aa, Influenza virus
FSISCFLLIAL

SEQ ID NO: 409373 - protein, 11 aa, Influenza virus
SISCFLLVALF

SEQ ID NO: 409374 - protein, 11 aa, Influenza virus
ISCFLLVALLI

SEQ ID NO: 409375 - protein, 11 aa, Influenza virus
ALLLAFVLWAC

SEQ ID NO: 409376 - protein, 11 aa, Influenza virus
LLLAFMLWACQ

SEQ ID NO: 409377 - protein, 11 aa, Influenza virus
LWACQNGNVRC

SEQ ID NO: 409378 - protein, 11 aa, Influenza virus
WACQNGNVRCQ

SEQ ID NO: 409379 - protein, 11 aa, Influenza virus
ACQNGNVRCQI

SEQ ID NO: 409380 - protein, 11 aa, Influenza virus
CQNGNVRCQIC

SEQ ID NO: 409381 - protein, 11 aa, Influenza virus
QNGNVRCQICI

SEQ ID NO: 409382 - protein, 11 aa, Influenza virus
KMEKIVLLLAI

SEQ ID NO: 409383 - protein, 11 aa, Influenza virus
SDHICIGYHAN

SEQ ID NO: 409384 - protein, 11 aa, Influenza virus
DRICIGYHANN

SEQ ID NO: 409385 - protein, 11 aa, Influenza virus
RICIGYHANNS

SEQ ID NO: 409386 - protein, 11 aa, Influenza virus
ICIGYHANKST

SEQ ID NO: 409387 - protein, 11 aa, Influenza virus
CVGYHANNSTE

SEQ ID NO: 409388 - protein, 11 aa, Influenza virus
IDTIMEKNVTV

SEQ ID NO: 409389 - protein, 11 aa, Influenza virus
DTIMEKNITVT

SEQ ID NO: 409390 - protein, 11 aa, Influenza virus
TIMEKNITVTH

SEQ ID NO: 409391 - protein, 11 aa, Influenza virus
IMEKNITVTHA

SEQ ID NO: 409392 - protein, 11 aa, Influenza virus
ERNVTVTHAQD

SEQ ID NO: 409393 - protein, 11 aa, Influenza virus
DCSVSGWLLGN

SEQ ID NO: 409394 - protein, 11 aa, Influenza virus
SIAGWLLGNPM

SEQ ID NO: 409395 - protein, 11 aa, Influenza virus
IAGWLLGNPMC

SEQ ID NO: 409396 - protein, 11 aa, Influenza virus
SGWLLGNPMCD

SEQ ID NO: 409397 - protein, 11 aa, Influenza virus
GWLLGNPMCDK

SEQ ID NO: 409398 - protein, 11 aa, Influenza virus
WLLGNPMCDKF

SEQ ID NO: 409399 - protein, 11 aa, Influenza virus
SGRSSFFRNVV

SEQ ID NO: 409400 - protein, 11 aa, Influenza virus
FDSNGNFIAPE

SEQ ID NO: 409401 - protein, 11 aa, Influenza virus
ESTGNFIAPEY

SEQ ID NO: 409402 - protein, 11 aa, Influenza virus
STGNFIAPEYA

SEQ ID NO: 409403 - protein, 11 aa, Influenza virus
TGNFIAPEYAY

SEQ ID NO: 409404 - protein, 11 aa, Influenza virus
GNFIAPEYAYI

SEQ ID NO: 409405 - protein, 11 aa, Influenza virus
NFIAPEYAYIV

SEQ ID NO: 409406 - protein, 11 aa, Influenza virus
PFHNVHPFTIG

SEQ ID NO: 409407 - protein, 11 aa, Influenza virus
HPFTIGECPRY

SEQ ID NO: 409408 - protein, 11 aa, Influenza virus
TIGKCPKYVKS

SEQ ID NO: 409409 - protein, 11 aa, Influenza virus
RRGLFGAIAGF

SEQ ID NO: 409410 - protein, 11 aa, Influenza virus
WQGMIDGWYGY

SEQ ID NO: 409411 - protein, 11 aa, Influenza virus
QGMIDGWYGYH

SEQ ID NO: 409412 - protein, 11 aa, Influenza virus
GMIDGWYGYHH

SEQ ID NO: 409413 - protein, 11 aa, Influenza virus
QGSGYAADKKS

SEQ ID NO: 409414 - protein, 11 aa, Influenza virus
GSGYAADKKST

SEQ ID NO: 409415 - protein, 11 aa, Influenza virus
GYAADQESTQK

SEQ ID NO: 409416 - protein, 11 aa, Influenza virus
YAADQESTQKA

SEQ ID NO: 409417 - protein, 11 aa, Influenza virus
GVWTYNAELLV

SEQ ID NO: 409418 - protein, 11 aa, Influenza virus
RTLDFHDSNVR

SEQ ID NO: 409419 - protein, 11 aa, Influenza virus
TLDFHDSNVRN

SEQ ID NO: 409420 - protein, 11 aa, Influenza virus
LDFHDSNVRNL

SEQ ID NO: 409421 - protein, 11 aa, Influenza virus
DFHDSNVRNLY

SEQ ID NO: 409422 - protein, 11 aa, Influenza virus
LHDSNVKNLYD

SEQ ID NO: 409423 - protein, 11 aa, Influenza virus
HDSNVRNLYDK

SEQ ID NO: 409424 - protein, 11 aa, Influenza virus
VRLQLKDNARE

SEQ ID NO: 409425 - protein, 11 aa, Influenza virus
RLQLKDNAREL

SEQ ID NO: 409426 - protein, 11 aa, Influenza virus
LQLKDNARELG

SEQ ID NO: 409427 - protein, 11 aa, Influenza virus
QLKDNARELGN

SEQ ID NO: 409428 - protein, 11 aa, Influenza virus
LKDNARELGNG

SEQ ID NO: 409429 - protein, 11 aa, Influenza virus
KDNARELGNGC

SEQ ID NO: 409430 - protein, 11 aa, Influenza virus
NGCFEFYHKCN

SEQ ID NO: 409431 - protein, 11 aa, Influenza virus
GCFEFYHKCDD

SEQ ID NO: 409432 - protein, 11 aa, Influenza virus
LSIYSTVVSSL

SEQ ID NO: 409433 - protein, 11 aa, Influenza virus
LWMCFNGSLQC

SEQ ID NO: 409434 - protein, 11 aa, Influenza virus
WMCFNGSLQCR

SEQ ID NO: 409435 - protein, 11 aa, Influenza virus
MCSNGSLQCKI

SEQ ID NO: 409436 - protein, 11 aa, Influenza virus
SNGSLQCKICI

SEQ ID NO: 409437 - protein, 11 aa, Influenza virus
ICIRFVNSDCS

SEQ ID NO: 409438 - protein, 11 aa, Influenza virus
KMEKIVLLLAI

SEQ ID NO: 409439 - protein, 11 aa, Influenza virus
GDQICIGYHAN

SEQ ID NO: 409440 - protein, 11 aa, Influenza virus
DQICVGYHANN

SEQ ID NO: 409441 - protein, 11 aa, Influenza virus
QICVGYHANNS

SEQ ID NO: 409442 - protein, 11 aa, Influenza virus
CIGYHANNSTV

SEQ ID NO: 409443 - protein, 11 aa, Influenza virus
ANNSTVQVDTI

SEQ ID NO: 409444 - protein, 11 aa, Influenza virus
NNSTVQVDTIM

SEQ ID NO: 409445 - protein, 11 aa, Influenza virus
RVDTIMEKNVT

SEQ ID NO: 409446 - protein, 11 aa, Influenza virus
TIMEKNITVTH

SEQ ID NO: 409447 - protein, 11 aa, Influenza virus
IMEKNITVTHA

SEQ ID NO: 409448 - protein, 11 aa, Influenza virus
MEKNVTVTHAK

SEQ ID NO: 409449 - protein, 11 aa, Influenza virus
EKNVTVTHAQN

SEQ ID NO: 409450 - protein, 11 aa, Influenza virus
KNVTVTHAQNI

SEQ ID NO: 409451 - protein, 11 aa, Influenza virus
NVTVTHAKDIL

SEQ ID NO: 409452 - protein, 11 aa, Influenza virus
VTVTHAKDILE

SEQ ID NO: 409453 - protein, 11 aa, Influenza virus
TVTHAQNILEK

SEQ ID NO: 409454 - protein, 11 aa, Influenza virus
RPLILRDCSVA

SEQ ID NO: 409455 - protein, 11 aa, Influenza virus
PLILKDCSIAG

SEQ ID NO: 409456 - protein, 11 aa, Influenza virus
LILKDCSIAGW

SEQ ID NO: 409457 - protein, 11 aa, Influenza virus
ILKDCSIAGWL

SEQ ID NO: 409458 - protein, 11 aa, Influenza virus
GWLLGNPMCDK

SEQ ID NO: 409459 - protein, 11 aa, Influenza virus
WLLGNPMCDKF

SEQ ID NO: 409460 - protein, 11 aa, Influenza virus
DVPEWSYIVEK

SEQ ID NO: 409461 - protein, 11 aa, Influenza virus
YEELKHLLSST

SEQ ID NO: 409462 - protein, 11 aa, Influenza virus
TYVSVGTSTLN

SEQ ID NO: 409463 - protein, 11 aa, Influenza virus
ISVGTSTLNLR

SEQ ID NO: 409464 - protein, 11 aa, Influenza virus
SVGTSTLNLRL

SEQ ID NO: 409465 - protein, 11 aa, Influenza virus
SFESNGNFIAP

SEQ ID NO: 409466 - protein, 11 aa, Influenza virus
FESNGNFITPE

SEQ ID NO: 409467 - protein, 11 aa, Influenza virus
DSNGNFIAPEY

SEQ ID NO: 409468 - protein, 11 aa, Influenza virus
SNGNFITPEYA

SEQ ID NO: 409469 - protein, 11 aa, Influenza virus
NGNFITPEYAY

SEQ ID NO: 409470 - protein, 11 aa, Influenza virus
GNFIAPEYAYI

SEQ ID NO: 409471 - protein, 11 aa, Influenza virus
NFIAPEYAYIV

SEQ ID NO: 409472 - protein, 11 aa, Influenza virus
GAINSSMPLHN

SEQ ID NO: 409473 - protein, 11 aa, Influenza virus
AVNSSMPFHNI

SEQ ID NO: 409474 - protein, 11 aa, Influenza virus
VNSSMPFHNIH

SEQ ID NO: 409475 - protein, 11 aa, Influenza virus
NSSMPLHNIHP

SEQ ID NO: 409476 - protein, 11 aa, Influenza virus
SSMPLHNIHPL

SEQ ID NO: 409477 - protein, 11 aa, Influenza virus
SMPLHNIHPLT

SEQ ID NO: 409478 - protein, 11 aa, Influenza virus
MPLHNIHPLTI

SEQ ID NO: 409479 - protein, 11 aa, Influenza virus
PLHNIHPLTIG

SEQ ID NO: 409480 - protein, 11 aa, Influenza virus
FHNIHPLTIGK

SEQ ID NO: 409481 - protein, 11 aa, Influenza virus
HNIHPLTIGKC

SEQ ID NO: 409482 - protein, 11 aa, Influenza virus
NIHPLTIGKCP

SEQ ID NO: 409483 - protein, 11 aa, Influenza virus
IHPLTIGKCPK

SEQ ID NO: 409484 - protein, 11 aa, Influenza virus
IGECPKYVKSS

SEQ ID NO: 409485 - protein, 11 aa, Influenza virus
RRKRGLFGAIA

SEQ ID NO: 409486 - protein, 11 aa, Influenza virus
RKRGLFGAIAG

SEQ ID NO: 409487 - protein, 11 aa, Influenza virus
RRGLFGAIAGF

SEQ ID NO: 409488 - protein, 11 aa, Influenza virus
WQGMIDGWYGY

SEQ ID NO: 409489 - protein, 11 aa, Influenza virus
QGMIDGWYGYH

SEQ ID NO: 409490 - protein, 11 aa, Influenza virus
GMIDGWYGYHH

SEQ ID NO: 409491 - protein, 11 aa, Influenza virus
MIDGWYGYHHS

SEQ ID NO: 409492 - protein, 11 aa, Influenza virus
IDGWYGYHHSN

SEQ ID NO: 409493 - protein, 11 aa, Influenza virus
HNNEQGSGYAA

SEQ ID NO: 409494 - protein, 11 aa, Influenza virus
NNEQGSGYAAD

SEQ ID NO: 409495 - protein, 11 aa, Influenza virus
NEQGSGYAADQ

SEQ ID NO: 409496 - protein, 11 aa, Influenza virus
QGSGYAADRES

SEQ ID NO: 409497 - protein, 11 aa, Influenza virus
GSGYAADREST

SEQ ID NO: 409498 - protein, 11 aa, Influenza virus
SGYAADRESTQ

SEQ ID NO: 409499 - protein, 11 aa, Influenza virus
GYAADQESTQK

SEQ ID NO: 409500 - protein, 11 aa, Influenza virus
YAADQESTQKA

SEQ ID NO: 409501 - protein, 11 aa, Influenza virus
STQRAIDGVTN

SEQ ID NO: 409502 - protein, 11 aa, Influenza virus
TQRAIDGVTNK

SEQ ID NO: 409503 - protein, 11 aa, Influenza virus
AINGVTNKVNS

SEQ ID NO: 409504 - protein, 11 aa, Influenza virus
INGVTNKVNSI

SEQ ID NO: 409505 - protein, 11 aa, Influenza virus
NGVTNKVNSII

SEQ ID NO: 409506 - protein, 11 aa, Influenza virus
GITNKVNSIID

SEQ ID NO: 409507 - protein, 11 aa, Influenza virus
ITNKVNSIIDK

SEQ ID NO: 409508 - protein, 11 aa, Influenza virus
TNKVNSIIGKM

SEQ ID NO: 409509 - protein, 11 aa, Influenza virus
NKINSIIDKMN

SEQ ID NO: 409510 - protein, 11 aa, Influenza virus
KINSIIDKMNT

SEQ ID NO: 409511 - protein, 11 aa, Influenza virus
VNSIIGKMNTQ

SEQ ID NO: 409512 - protein, 11 aa, Influenza virus
NSIIGKMNTQF

SEQ ID NO: 409513 - protein, 11 aa, Influenza virus
SIIGKMNTQFE

SEQ ID NO: 409514 - protein, 11 aa, Influenza virus
IIGKMNTQFEA

SEQ ID NO: 409515 - protein, 11 aa, Influenza virus
KMNTQFEAIGR

SEQ ID NO: 409516 - protein, 11 aa, Influenza virus
MNTQFEAIGRE

SEQ ID NO: 409517 - protein, 11 aa, Influenza virus
NTQFEAIGREF

SEQ ID NO: 409518 - protein, 11 aa, Influenza virus
LERRIESLNKK

SEQ ID NO: 409519 - protein, 11 aa, Influenza virus
ERRIESLNKKM

SEQ ID NO: 409520 - protein, 11 aa, Influenza virus
RRIESLNKKME

SEQ ID NO: 409521 - protein, 11 aa, Influenza virus
RIENLNRKMED

SEQ ID NO: 409522 - protein, 11 aa, Influenza virus
IENLNRKMEDG

SEQ ID NO: 409523 - protein, 11 aa, Influenza virus
ENLNRKMEDGF

SEQ ID NO: 409524 - protein, 11 aa, Influenza virus
NLNRKMEDGFL

SEQ ID NO: 409525 - protein, 11 aa, Influenza virus
LNKKMEDGFLN

SEQ ID NO: 409526 - protein, 11 aa, Influenza virus
NKKMEDGFLNV

SEQ ID NO: 409527 - protein, 11 aa, Influenza virus
KKMEDGFLNVW

SEQ ID NO: 409528 - protein, 11 aa, Influenza virus
FHDSNVRNLYD

SEQ ID NO: 409529 - protein, 11 aa, Influenza virus
HDSNVRNLYDK

SEQ ID NO: 409530 - protein, 11 aa, Influenza virus
DSNVRNLYDKV

SEQ ID NO: 409531 - protein, 11 aa, Influenza virus
SNVRNLYDKVR

SEQ ID NO: 409532 - protein, 11 aa, Influenza virus
NVRNLYDKVRL

SEQ ID NO: 409533 - protein, 11 aa, Influenza virus
VRNLYDKVRLQ

SEQ ID NO: 409534 - protein, 11 aa, Influenza virus
RNLYDKVRLQL

SEQ ID NO: 409535 - protein, 11 aa, Influenza virus
NLYEKVRLQLR

SEQ ID NO: 409536 - protein, 11 aa, Influenza virus
LYEKVRLQLRD

SEQ ID NO: 409537 - protein, 11 aa, Influenza virus
YEKVRLQLRDN

SEQ ID NO: 409538 - protein, 11 aa, Influenza virus
EKVRLQLRDNA

SEQ ID NO: 409539 - protein, 11 aa, Influenza virus
RVRLQLRDNAK

SEQ ID NO: 409540 - protein, 11 aa, Influenza virus
IRLQLRDNAKE

SEQ ID NO: 409541 - protein, 11 aa, Influenza virus
NGCFEFYHKCN

SEQ ID NO: 409542 - protein, 11 aa, Influenza virus
GCFEFYHKCDD

SEQ ID NO: 409543 - protein, 11 aa, Influenza virus
VTYQILSIYST

SEQ ID NO: 409544 - protein, 11 aa, Influenza virus
YQILSIYSTVV

SEQ ID NO: 409545 - protein, 11 aa, Influenza virus
QILSIYSTVVS

SEQ ID NO: 409546 - protein, 11 aa, Influenza virus
ILSIYSTVTSS

SEQ ID NO: 409547 - protein, 11 aa, Influenza virus
LSIYSTVVSSL

SEQ ID NO: 409548 - protein, 11 aa, Influenza virus
YSTAASSLALA

SEQ ID NO: 409549 - protein, 11 aa, Influenza virus
STAASSLALAI

SEQ ID NO: 409550 - protein, 11 aa, Influenza virus
AGLSFWMCSNG

SEQ ID NO: 409551 - protein, 11 aa, Influenza virus
GLSFWMCSNGS

SEQ ID NO: 409552 - protein, 11 aa, Influenza virus
LWMCFNGSLQC

SEQ ID NO: 409553 - protein, 11 aa, Influenza virus
WMCFNGSLQCR

SEQ ID NO: 409554 - protein, 11 aa, Influenza virus
MCSNGSLQCKI

SEQ ID NO: 409555 - protein, 11 aa, Influenza virus
CSNGSLQCRIA

SEQ ID NO: 409556 - protein, 11 aa, Influenza virus
SNGSLQCKICI

SEQ ID NO: 409557 - protein, 11 aa, Influenza virus
ICIRFVNSDCS

SEQ ID NO: 409558 - protein, 11 aa, Influenza virus
VFREQKQEFKM

SEQ ID NO: 409559 - protein, 11 aa, Influenza virus
SGSQKQEFKMN

SEQ ID NO: 409560 - protein, 11 aa, Influenza virus
EIKMNPNQKIM

SEQ ID NO: 409561 - protein, 11 aa, Influenza virus
IKMNPNQKIIT

SEQ ID NO: 409562 - protein, 11 aa, Influenza virus
KMNPNQKIMTI

SEQ ID NO: 409563 - protein, 11 aa, Influenza virus
YKNNTWVNQTY

SEQ ID NO: 409564 - protein, 11 aa, Influenza virus
YSKDNGIRIGS

SEQ ID NO: 409565 - protein, 11 aa, Influenza virus
SKDNGIRIGSK

SEQ ID NO: 409566 - protein, 11 aa, Influenza virus
KDNGIRIGSKG

SEQ ID NO: 409567 - protein, 11 aa, Influenza virus
DNGIRIGSKGD

SEQ ID NO: 409568 - protein, 11 aa, Influenza virus
NGIRIGSKGDV

SEQ ID NO: 409569 - protein, 11 aa, Influenza virus
GIRIGSKGDVF

SEQ ID NO: 409570 - protein, 11 aa, Influenza virus
IRIGSRGDVFI

SEQ ID NO: 409571 - protein, 11 aa, Influenza virus
EPFISCSHSEC

SEQ ID NO: 409572 - protein, 11 aa, Influenza virus
PFISCSHSECR

SEQ ID NO: 409573 - protein, 11 aa, Influenza virus
VSCSHLECRTF

SEQ ID NO: 409574 - protein, 11 aa, Influenza virus
SCSHSECRTFF

SEQ ID NO: 409575 - protein, 11 aa, Influenza virus
CSHSECRTFFL

SEQ ID NO: 409576 - protein, 11 aa, Influenza virus
SHSECRTFFLT

SEQ ID NO: 409577 - protein, 11 aa, Influenza virus
SECRTFFLTQG

SEQ ID NO: 409578 - protein, 11 aa, Influenza virus
ECRTFFLTHGA

SEQ ID NO: 409579 - protein, 11 aa, Influenza virus
CRTFFLTHGAL

SEQ ID NO: 409580 - protein, 11 aa, Influenza virus
RTFFLTHGALL

SEQ ID NO: 409581 - protein, 11 aa, Influenza virus
TFFLTHGALLN

SEQ ID NO: 409582 - protein, 11 aa, Influenza virus
FFLTHGALLND

SEQ ID NO: 409583 - protein, 11 aa, Influenza virus
FLTHGALLNDK

SEQ ID NO: 409584 - protein, 11 aa, Influenza virus
LTHGALLNDKH

SEQ ID NO: 409585 - protein, 11 aa, Influenza virus
THGALLNDKHS

SEQ ID NO: 409586 - protein, 11 aa, Influenza virus
HGALLNDKHSN

SEQ ID NO: 409587 - protein, 11 aa, Influenza virus
GALLNDKHSNE

SEQ ID NO: 409588 - protein, 11 aa, Influenza virus
ALLNDKHSNET

SEQ ID NO: 409589 - protein, 11 aa, Influenza virus
LLNDKHSNETV

SEQ ID NO: 409590 - protein, 11 aa, Influenza virus
HSNGTVNDRSP

SEQ ID NO: 409591 - protein, 11 aa, Influenza virus
KDRSPHRALMS

SEQ ID NO: 409592 - protein, 11 aa, Influenza virus
DRSPHRALMSC

SEQ ID NO: 409593 - protein, 11 aa, Influenza virus
RSPHRALMSCP

SEQ ID NO: 409594 - protein, 11 aa, Influenza virus
GEVPSPYNSRF

SEQ ID NO: 409595 - protein, 11 aa, Influenza virus
EVPSPYNSRFE

SEQ ID NO: 409596 - protein, 11 aa, Influenza virus
VPSPYNSRFES

SEQ ID NO: 409597 - protein, 11 aa, Influenza virus
AWSASACHDGS

SEQ ID NO: 409598 - protein, 11 aa, Influenza virus
WSASACHDGTN

SEQ ID NO: 409599 - protein, 11 aa, Influenza virus
SASACHDGTNW

SEQ ID NO: 409600 - protein, 11 aa, Influenza virus
ASACHDGTNWL

SEQ ID NO: 409601 - protein, 11 aa, Influenza virus
SWLTIGVSGPD

SEQ ID NO: 409602 - protein, 11 aa, Influenza virus
WLTIGVSGPDN

SEQ ID NO: 409603 - protein, 11 aa, Influenza virus
IGISGPDSGAV

SEQ ID NO: 409604 - protein, 11 aa, Influenza virus
GISGPDSGAVA

SEQ ID NO: 409605 - protein, 11 aa, Influenza virus
ISGPDSGAVAV

SEQ ID NO: 409606 - protein, 11 aa, Influenza virus
SGPDSGAVAVL

SEQ ID NO: 409607 - protein, 11 aa, Influenza virus
GPDSGAVAVLK

SEQ ID NO: 409608 - protein, 11 aa, Influenza virus
PDSGAVAVLKY

SEQ ID NO: 409609 - protein, 11 aa, Influenza virus
TLRTQESECAC

SEQ ID NO: 409610 - protein, 11 aa, Influenza virus
LRTQESECACI

SEQ ID NO: 409611 - protein, 11 aa, Influenza virus
RTQESECACAN

SEQ ID NO: 409612 - protein, 11 aa, Influenza virus
TQESECACANG

SEQ ID NO: 409613 - protein, 11 aa, Influenza virus
GFCFTVMTDGP

SEQ ID NO: 409614 - protein, 11 aa, Influenza virus
APNYYYEECSC

SEQ ID NO: 409615 - protein, 11 aa, Influenza virus
PNYYYEECSCY

SEQ ID NO: 409616 - protein, 11 aa, Influenza virus
YYYEECSCYPD

SEQ ID NO: 409617 - protein, 11 aa, Influenza virus
HYEECSCYPNA

SEQ ID NO: 409618 - protein, 11 aa, Influenza virus
YEECSCYPDSG

SEQ ID NO: 409619 - protein, 11 aa, Influenza virus
MCVCRDNWHGS

SEQ ID NO: 409620 - protein, 11 aa, Influenza virus
DNWHGSNRPWL

SEQ ID NO: 409621 - protein, 11 aa, Influenza virus
NWHGSNRPWLS

SEQ ID NO: 409622 - protein, 11 aa, Influenza virus
WHGSNRPWLSF

SEQ ID NO: 409623 - protein, 11 aa, Influenza virus
HGSNRPWLSFN

SEQ ID NO: 409624 - protein, 11 aa, Influenza virus
GYICSGVFGDT

SEQ ID NO: 409625 - protein, 11 aa, Influenza virus
YICSGVFGDTP

SEQ ID NO: 409626 - protein, 11 aa, Influenza virus
ICSGVFGDTPR

SEQ ID NO: 409627 - protein, 11 aa, Influenza virus
CSGVFGDTPRP

SEQ ID NO: 409628 - protein, 11 aa, Influenza virus
FKYGDGVWIGR

SEQ ID NO: 409629 - protein, 11 aa, Influenza virus
KYGDGVWIGRT

SEQ ID NO: 409630 - protein, 11 aa, Influenza virus
YGNGAWIGRTK

SEQ ID NO: 409631 - protein, 11 aa, Influenza virus
GNGAWIGRTKS

SEQ ID NO: 409632 - protein, 11 aa, Influenza virus
SRSGFEIIWDP

SEQ ID NO: 409633 - protein, 11 aa, Influenza virus
RSGFEMIWDPD

SEQ ID NO: 409634 - protein, 11 aa, Influenza virus
SGFEMIWDPDG

SEQ ID NO: 409635 - protein, 11 aa, Influenza virus
GFEMIWDPDGW

SEQ ID NO: 409636 - protein, 11 aa, Influenza virus
TTDWSGYSGSF

SEQ ID NO: 409637 - protein, 11 aa, Influenza virus
TEWSGYSGSFV

SEQ ID NO: 409638 - protein, 11 aa, Influenza virus
YSGSFVQHPEM

SEQ ID NO: 409639 - protein, 11 aa, Influenza virus
SGSFVQHPEMT

SEQ ID NO: 409640 - protein, 11 aa, Influenza virus
GSFVQHPEMTG

SEQ ID NO: 409641 - protein, 11 aa, Influenza virus
SFVQHPEMTGL

SEQ ID NO: 409642 - protein, 11 aa, Influenza virus
FIQHPELTGLN

SEQ ID NO: 409643 - protein, 11 aa, Influenza virus
IQHPELTGLNC

SEQ ID NO: 409644 - protein, 11 aa, Influenza virus
NCIRPCFWVEL

SEQ ID NO: 409645 - protein, 11 aa, Influenza virus
CIRPCFWVELV

SEQ ID NO: 409646 - protein, 11 aa, Influenza virus
IRPCFWVELVR

SEQ ID NO: 409647 - protein, 11 aa, Influenza virus
KPCFWVELIRG

SEQ ID NO: 409648 - protein, 11 aa, Influenza virus
PCFWVELVRGR

SEQ ID NO: 409649 - protein, 11 aa, Influenza virus
CFWVELVRGRP

SEQ ID NO: 409650 - protein, 11 aa, Influenza virus
FWVELVRGRPK

SEQ ID NO: 409651 - protein, 11 aa, Influenza virus
WVELVRGRPKE

SEQ ID NO: 409652 - protein, 11 aa, Influenza virus
VWTSGSIISFC

SEQ ID NO: 409653 - protein, 11 aa, Influenza virus
WASGSSISFCG

SEQ ID NO: 409654 - protein, 11 aa, Influenza virus
ASGSSISFCGV

SEQ ID NO: 409655 - protein, 11 aa, Influenza virus
SGSSISFCGVD

SEQ ID NO: 409656 - protein, 11 aa, Influenza virus
WSWPDGAELPS

SEQ ID NO: 409657 - protein, 11 aa, Influenza virus
DRICVGYHANN

SEQ ID NO: 409658 - protein, 11 aa, Influenza virus
QICIGHHANNS

SEQ ID NO: 409659 - protein, 11 aa, Influenza virus
ICIGHHANNST

SEQ ID NO: 409660 - protein, 11 aa, Influenza virus
CIGHHANNSTE

SEQ ID NO: 409661 - protein, 11 aa, Influenza virus
IGHHANNSTEQ

SEQ ID NO: 409662 - protein, 11 aa, Influenza virus
GYHANNSTKQI

SEQ ID NO: 409663 - protein, 11 aa, Influenza virus
YHANNSTKQID

SEQ ID NO: 409664 - protein, 11 aa, Influenza virus
HANNSTKQIDT

SEQ ID NO: 409665 - protein, 11 aa, Influenza virus
ANNSTKQIDTI

SEQ ID NO: 409666 - protein, 11 aa, Influenza virus
DTTMEKNVTVT

SEQ ID NO: 409667 - protein, 11 aa, Influenza virus
PEWSYIVEKNN

SEQ ID NO: 409668 - protein, 11 aa, Influenza virus
SFFRNVVWLVK

SEQ ID NO: 409669 - protein, 11 aa, Influenza virus
FFRNVVWLVKK

SEQ ID NO: 409670 - protein, 11 aa, Influenza virus
NGNFIAPEYAF

SEQ ID NO: 409671 - protein, 11 aa, Influenza virus
GNFIAPEYAYR

SEQ ID NO: 409672 - protein, 11 aa, Influenza virus
NFIAPEYAYRI

SEQ ID NO: 409673 - protein, 11 aa, Influenza virus
YGNCNAKCQTP

SEQ ID NO: 409674 - protein, 11 aa, Influenza virus
KTRGLFGAIAG

SEQ ID NO: 409675 - protein, 11 aa, Influenza virus
GFIEGGWQGLV

SEQ ID NO: 409676 - protein, 11 aa, Influenza virus
FIEGGWQGLVD

SEQ ID NO: 409677 - protein, 11 aa, Influenza virus
IEGGWQGLVDG

SEQ ID NO: 409678 - protein, 11 aa, Influenza virus
EGGWQGLVDGW

SEQ ID NO: 409679 - protein, 11 aa, Influenza virus
GGWQGLVDGWY

SEQ ID NO: 409680 - protein, 11 aa, Influenza virus
GWQGLVDGWYG

SEQ ID NO: 409681 - protein, 11 aa, Influenza virus
WQGLVDGWYGY

SEQ ID NO: 409682 - protein, 11 aa, Influenza virus
QGLVDGWYGYH

SEQ ID NO: 409683 - protein, 11 aa, Influenza virus
GLVDGWYGYHH

SEQ ID NO: 409684 - protein, 11 aa, Influenza virus
VDGWYGYHHIN

SEQ ID NO: 409685 - protein, 11 aa, Influenza virus
GSGYAADRKST

SEQ ID NO: 409686 - protein, 11 aa, Influenza virus
SGYAADRKSTQ

SEQ ID NO: 409687 - protein, 11 aa, Influenza virus
GYAADKESTQR

SEQ ID NO: 409688 - protein, 11 aa, Influenza virus
YAADKESTQRA

SEQ ID NO: 409689 - protein, 11 aa, Influenza virus
VWTYNTELLVL

SEQ ID NO: 409690 - protein, 11 aa, Influenza virus
WTYNAELFVLM

SEQ ID NO: 409691 - protein, 11 aa, Influenza virus
TYNAELFVLME

SEQ ID NO: 409692 - protein, 11 aa, Influenza virus
YNAELLVLIEN

SEQ ID NO: 409693 - protein, 11 aa, Influenza virus
NTELLVLMENE

SEQ ID NO: 409694 - protein, 11 aa, Influenza virus
ELLVLIENERT

SEQ ID NO: 409695 - protein, 11 aa, Influenza virus
LFVLMENERTL

SEQ ID NO: 409696 - protein, 11 aa, Influenza virus
FVLMENERTLD

SEQ ID NO: 409697 - protein, 11 aa, Influenza virus
VLMENERTLYF

SEQ ID NO: 409698 - protein, 11 aa, Influenza virus
LMENERTLYFH

SEQ ID NO: 409699 - protein, 11 aa, Influenza virus
MENERTLYFHD

SEQ ID NO: 409700 - protein, 11 aa, Influenza virus
ENERTLYFHDS

SEQ ID NO: 409701 - protein, 11 aa, Influenza virus
NERTLYFHDSN

SEQ ID NO: 409702 - protein, 11 aa, Influenza virus
ERTLYFHDSNV

SEQ ID NO: 409703 - protein, 11 aa, Influenza virus
RTLDFHDSNVR

SEQ ID NO: 409704 - protein, 11 aa, Influenza virus
TLDFHDSNVRN

SEQ ID NO: 409705 - protein, 11 aa, Influenza virus
LDFHDSNVRNL

SEQ ID NO: 409706 - protein, 11 aa, Influenza virus
DFHDSNVRNLY

SEQ ID NO: 409707 - protein, 11 aa, Influenza virus
FHDSNVRNLYD

SEQ ID NO: 409708 - protein, 11 aa, Influenza virus
HDSNVKNLYNK

SEQ ID NO: 409709 - protein, 11 aa, Influenza virus
DSNVKNLYNKV

SEQ ID NO: 409710 - protein, 11 aa, Influenza virus
SNVKNLYNKVR

SEQ ID NO: 409711 - protein, 11 aa, Influenza virus
DNAKEMGNGCF

SEQ ID NO: 409712 - protein, 11 aa, Influenza virus
NAKEMGNGCFE

SEQ ID NO: 409713 - protein, 11 aa, Influenza virus
AKEMGNGCFEF

SEQ ID NO: 409714 - protein, 11 aa, Influenza virus
KEMGNGCFEFY

SEQ ID NO: 409715 - protein, 11 aa, Influenza virus
EWGNGCFEFYH

SEQ ID NO: 409716 - protein, 11 aa, Influenza virus
MGNGCFEFYHK

SEQ ID NO: 409717 - protein, 11 aa, Influenza virus
NGCFEFYHKCN

SEQ ID NO: 409718 - protein, 11 aa, Influenza virus
KCMESVRNGTY

SEQ ID NO: 409719 - protein, 11 aa, Influenza virus
ILSIYSSVASS

SEQ ID NO: 409720 - protein, 11 aa, Influenza virus
LSIYSSVASSL

SEQ ID NO: 409721 - protein, 11 aa, Influenza virus
LAIMMAGLSFW

SEQ ID NO: 409722 - protein, 11 aa, Influenza virus
MAGLSFWMCSN

SEQ ID NO: 409723 - protein, 11 aa, Influenza virus
GLSLWMCSNGS

SEQ ID NO: 409724 - protein, 11 aa, Influenza virus
LSFWMCSNGSI

SEQ ID NO: 409725 - protein, 11 aa, Influenza virus
SFWRCSNGSLQ

SEQ ID NO: 409726 - protein, 11 aa, Influenza virus
MCSNGSLQCRV

SEQ ID NO: 409727 - protein, 11 aa, Influenza virus
CSNGSLQCRVC

SEQ ID NO: 409728 - protein, 11 aa, Influenza virus
SNGSLQCRVCI

SEQ ID NO: 409729 - protein, 11 aa, Influenza virus
KPQCQIAGFAP

SEQ ID NO: 409730 - protein, 11 aa, Influenza virus
PQCQIAGFAPF

SEQ ID NO: 409731 - protein, 11 aa, Influenza virus
IAGFAPFSKDN

SEQ ID NO: 409732 - protein, 11 aa, Influenza virus
FSKDNSVRLSA

SEQ ID NO: 409733 - protein, 11 aa, Influenza virus
SKDNSVRLSAG

SEQ ID NO: 409734 - protein, 11 aa, Influenza virus
WITREPYVSCD

SEQ ID NO: 409735 - protein, 11 aa, Influenza virus
QFPLGQGTTLD

SEQ ID NO: 409736 - protein, 11 aa, Influenza virus
SYRTLLMNELG

SEQ ID NO: 409737 - protein, 11 aa, Influenza virus
HRTLLMNELGI

SEQ ID NO: 409738 - protein, 11 aa, Influenza virus
RTLLMNELGIP

SEQ ID NO: 409739 - protein, 11 aa, Influenza virus
TLLMNELGIPF

SEQ ID NO: 409740 - protein, 11 aa, Influenza virus
LLMNELGIPFH

SEQ ID NO: 409741 - protein, 11 aa, Influenza virus
LMNELGIPFHL

SEQ ID NO: 409742 - protein, 11 aa, Influenza virus
MNELGIPFHLG

SEQ ID NO: 409743 - protein, 11 aa, Influenza virus
NELGIPFHLGT

SEQ ID NO: 409744 - protein, 11 aa, Influenza virus
ELGIPFHLGTK

SEQ ID NO: 409745 - protein, 11 aa, Influenza virus
LGIPFHLGTKQ

SEQ ID NO: 409746 - protein, 11 aa, Influenza virus
GIPFHLGTKQV

SEQ ID NO: 409747 - protein, 11 aa, Influenza virus
IPFHLGTKQVC

SEQ ID NO: 409748 - protein, 11 aa, Influenza virus
PFHLGTKQVCM

SEQ ID NO: 409749 - protein, 11 aa, Influenza virus
FHLGTKQVCMA

SEQ ID NO: 409750 - protein, 11 aa, Influenza virus
HLGTKQVCMAW

SEQ ID NO: 409751 - protein, 11 aa, Influenza virus
LGTKQVCMAWS

SEQ ID NO: 409752 - protein, 11 aa, Influenza virus
GTKQVCMAWSS

SEQ ID NO: 409753 - protein, 11 aa, Influenza virus
TKQVCMAWSSS

SEQ ID NO: 409754 - protein, 11 aa, Influenza virus
KQVCMAWSSSS

SEQ ID NO: 409755 - protein, 11 aa, Influenza virus
QVCVAWSSSSC

SEQ ID NO: 409756 - protein, 11 aa, Influenza virus
VCVAWSSSSCH

SEQ ID NO: 409757 - protein, 11 aa, Influenza virus
CVAWSSSSCHD

SEQ ID NO: 409758 - protein, 11 aa, Influenza virus
VAWSSSSCHDG

SEQ ID NO: 409759 - protein, 11 aa, Influenza virus
AWSSSSCHDGN

SEQ ID NO: 409760 - protein, 11 aa, Influenza virus
WSSSSCHDGNA

SEQ ID NO: 409761 - protein, 11 aa, Influenza virus
SSSSCHDGNAW

SEQ ID NO: 409762 - protein, 11 aa, Influenza virus
SSSCHDGNAWL

SEQ ID NO: 409763 - protein, 11 aa, Influenza virus
SSCHDGNAWLH

SEQ ID NO: 409764 - protein, 11 aa, Influenza virus
CHDGNAWLHVC

SEQ ID NO: 409765 - protein, 11 aa, Influenza virus
AWLHVCITGDD

SEQ ID NO: 409766 - protein, 11 aa, Influenza virus
TWSQNILRTQE

SEQ ID NO: 409767 - protein, 11 aa, Influenza virus
WSQNILKKQES

SEQ ID NO: 409768 - protein, 11 aa, Influenza virus
SLNILRTQESE

SEQ ID NO: 409769 - protein, 11 aa, Influenza virus
LRTQESECICI

SEQ ID NO: 409770 - protein, 11 aa, Influenza virus
RTQESECVCID

SEQ ID NO: 409771 - protein, 11 aa, Influenza virus
CTVIMTDGSAS

SEQ ID NO: 409772 - protein, 11 aa, Influenza virus
GNAQHIEECSC

SEQ ID NO: 409773 - protein, 11 aa, Influenza virus
SAQHIEGCSCY

SEQ ID NO: 409774 - protein, 11 aa, Influenza virus
VRCICRDNWKG

SEQ ID NO: 409775 - protein, 11 aa, Influenza virus
RCVCRDNWMGS

SEQ ID NO: 409776 - protein, 11 aa, Influenza virus
CVCRDNWMGSN

SEQ ID NO: 409777 - protein, 11 aa, Influenza virus
VCRDNWMGSNR

SEQ ID NO: 409778 - protein, 11 aa, Influenza virus
RDNWMGSNRPV

SEQ ID NO: 409779 - protein, 11 aa, Influenza virus
SRYICSGLVGD

SEQ ID NO: 409780 - protein, 11 aa, Influenza virus
RYICSGLVGDT

SEQ ID NO: 409781 - protein, 11 aa, Influenza virus
LVGDTPRNNDS

SEQ ID NO: 409782 - protein, 11 aa, Influenza virus
SNSNCRDPNNE

SEQ ID NO: 409783 - protein, 11 aa, Influenza virus
GSQGVKGWAFD

SEQ ID NO: 409784 - protein, 11 aa, Influenza virus
SRDSRSGYETF

SEQ ID NO: 409785 - protein, 11 aa, Influenza virus
KNSRSGYETFR

SEQ ID NO: 409786 - protein, 11 aa, Influenza virus
DSRSGYETFRI

SEQ ID NO: 409787 - protein, 11 aa, Influenza virus
SRSGYETFRVT

SEQ ID NO: 409788 - protein, 11 aa, Influenza virus
NWSGYSGIFSI

SEQ ID NO: 409789 - protein, 11 aa, Influenza virus
WSGYSGIFSIE

SEQ ID NO: 409790 - protein, 11 aa, Influenza virus
GCINRCFYVEL

SEQ ID NO: 409791 - protein, 11 aa, Influenza virus
FYVELTRGRPQ

SEQ ID NO: 409792 - protein, 11 aa, Influenza virus
YLELIRGRPQE

SEQ ID NO: 409793 - protein, 11 aa, Influenza virus
RVWWTTNSIVV

SEQ ID NO: 409794 - protein, 11 aa, Influenza virus
VWWTTNSIVVF

SEQ ID NO: 409795 - protein, 11 aa, Influenza virus
WWTTNSIVVFC

SEQ ID NO: 409796 - protein, 11 aa, Influenza virus
WTTNSIVVFCG

SEQ ID NO: 409797 - protein, 11 aa, Influenza virus
TTNSIVVFCGT

SEQ ID NO: 409798 - protein, 11 aa, Influenza virus
TNSIVVFCGTS

SEQ ID NO: 409799 - protein, 11 aa, Influenza virus
TGSWPDGANII

SEQ ID NO: 409800 - protein, 11 aa, Influenza virus
GSWPDGADINF

SEQ ID NO: 409801 - protein, 11 aa, Influenza virus
SWPDGADINFM

SEQ ID NO: 409802 - protein, 11 aa, Influenza virus
WPDGANINFMA

SEQ ID NO: 409803 - protein, 11 aa, Influenza virus
KSDRICIGYHA

SEQ ID NO: 409804 - protein, 11 aa, Influenza virus
SHKICIGYHAN

SEQ ID NO: 409805 - protein, 11 aa, Influenza virus
HKICIGYHANN

SEQ ID NO: 409806 - protein, 11 aa, Influenza virus
GYHANNSTTQI

SEQ ID NO: 409807 - protein, 11 aa, Influenza virus
YHANNSTTQVN

SEQ ID NO: 409808 - protein, 11 aa, Influenza virus
HANNSTTQVNT

SEQ ID NO: 409809 - protein, 11 aa, Influenza virus
ANNSTTQVDTL

SEQ ID NO: 409810 - protein, 11 aa, Influenza virus
VDTILERNVTV

SEQ ID NO: 409811 - protein, 11 aa, Influenza virus
DTILERNVTVT

SEQ ID NO: 409812 - protein, 11 aa, Influenza virus
TILERNVTVTH

SEQ ID NO: 409813 - protein, 11 aa, Influenza virus
ILERNVTVTHS

SEQ ID NO: 409814 - protein, 11 aa, Influenza virus
LERNVTVTHSV

SEQ ID NO: 409815 - protein, 11 aa, Influenza virus
ERNVTVTHSVE

SEQ ID NO: 409816 - protein, 11 aa, Influenza virus
RNVTVTHSVEL

SEQ ID NO: 409817 - protein, 11 aa, Influenza virus
NITVTHSVELL

SEQ ID NO: 409818 - protein, 11 aa, Influenza virus
ITVTHSVELLE

SEQ ID NO: 409819 - protein, 11 aa, Influenza virus
TVTHSIELLEN

SEQ ID NO: 409820 - protein, 11 aa, Influenza virus
LKPGETLKVES

SEQ ID NO: 409821 - protein, 11 aa, Influenza virus
KPGETLKVESN

SEQ ID NO: 409822 - protein, 11 aa, Influenza virus
PGETLNIESNG

SEQ ID NO: 409823 - protein, 11 aa, Influenza virus
GETLNIESNGN

SEQ ID NO: 409824 - protein, 11 aa, Influenza virus
ETLNIESNGNL

SEQ ID NO: 409825 - protein, 11 aa, Influenza virus
TLKVESNGNLI

SEQ ID NO: 409826 - protein, 11 aa, Influenza virus
LKVESNGNLIA

SEQ ID NO: 409827 - protein, 11 aa, Influenza virus
KVESNGNLIAP

SEQ ID NO: 409828 - protein, 11 aa, Influenza virus
IESNGNLIAPW

SEQ ID NO: 409829 - protein, 11 aa, Influenza virus
NGNLIAPWYAF

SEQ ID NO: 409830 - protein, 11 aa, Influenza virus
GNLVAPWYAYK

SEQ ID NO: 409831 - protein, 11 aa, Influenza virus
NKTFQNVSPVW

SEQ ID NO: 409832 - protein, 11 aa, Influenza virus
SLRLATGLRNI

SEQ ID NO: 409833 - protein, 11 aa, Influenza virus
LRLATGLRNIP

SEQ ID NO: 409834 - protein, 11 aa, Influenza virus
RLATGLRNIPQ

SEQ ID NO: 409835 - protein, 11 aa, Influenza virus
NRGLFGAIAGF

SEQ ID NO: 409836 - protein, 11 aa, Influenza virus
GFIEGGWTGLI

SEQ ID NO: 409837 - protein, 11 aa, Influenza virus
FIEGGWTGLID

SEQ ID NO: 409838 - protein, 11 aa, Influenza virus
IEGGWTGLIDG

SEQ ID NO: 409839 - protein, 11 aa, Influenza virus
EGGWTGLIDGW

SEQ ID NO: 409840 - protein, 11 aa, Influenza virus
GGWTGLIDGWY

SEQ ID NO: 409841 - protein, 11 aa, Influenza virus
GWTGLIDGWYG

SEQ ID NO: 409842 - protein, 11 aa, Influenza virus
WTGLIDGWYGY

SEQ ID NO: 409843 - protein, 11 aa, Influenza virus
TGLIDGWYGYH

SEQ ID NO: 409844 - protein, 11 aa, Influenza virus
GLIDGWYGYHH

SEQ ID NO: 409845 - protein, 11 aa, Influenza virus
LIDGWYGYHHE

SEQ ID NO: 409846 - protein, 11 aa, Influenza virus
GYAADRESTQR

SEQ ID NO: 409847 - protein, 11 aa, Influenza virus
YAADRESTQRA

SEQ ID NO: 409848 - protein, 11 aa, Influenza virus
DGFMDVWTYNA

SEQ ID NO: 409849 - protein, 11 aa, Influenza virus
GFMDVWTYNAE

SEQ ID NO: 409850 - protein, 11 aa, Influenza virus
FMDVWTYNAEL

SEQ ID NO: 409851 - protein, 11 aa, Influenza virus
MDVWTYNAELL

SEQ ID NO: 409852 - protein, 11 aa, Influenza virus
DVWTYNAELLI

SEQ ID NO: 409853 - protein, 11 aa, Influenza virus
YNAELLVLLED

SEQ ID NO: 409854 - protein, 11 aa, Influenza virus
NAELLVLLENG

SEQ ID NO: 409855 - protein, 11 aa, Influenza virus
AELLVLLENGR

SEQ ID NO: 409856 - protein, 11 aa, Influenza virus
ELLVLLENGRT

SEQ ID NO: 409857 - protein, 11 aa, Influenza virus
LLVLLENGRTL

SEQ ID NO: 409858 - protein, 11 aa, Influenza virus
LVLLENGRTLD

SEQ ID NO: 409859 - protein, 11 aa, Influenza virus
ENGRTLDMHDA

SEQ ID NO: 409860 - protein, 11 aa, Influenza virus
NGRTLDMHDAN

SEQ ID NO: 409861 - protein, 11 aa, Influenza virus
GRTLDMHDANV

SEQ ID NO: 409862 - protein, 11 aa, Influenza virus
LKDNAKDLGNG

SEQ ID NO: 409863 - protein, 11 aa, Influenza virus
KDNAKDLGNGC

SEQ ID NO: 409864 - protein, 11 aa, Influenza virus
MILGNGCFEFW

SEQ ID NO: 409865 - protein, 11 aa, Influenza virus
GCFEFWHKCNN

SEQ ID NO: 409866 - protein, 11 aa, Influenza virus
CFEFWHKCDND

SEQ ID NO: 409867 - protein, 11 aa, Influenza virus
FEFWHKCDNDC

SEQ ID NO: 409868 - protein, 11 aa, Influenza virus
GIYQILAIYST

SEQ ID NO: 409869 - protein, 11 aa, Influenza virus
VYQILSIYSTV

SEQ ID NO: 409870 - protein, 11 aa, Influenza virus
ILAIYSTISSS

SEQ ID NO: 409871 - protein, 11 aa, Influenza virus
LSIYSTVSSSL

SEQ ID NO: 409872 - protein, 11 aa, Influenza virus
YSTISSSLVLM

SEQ ID NO: 409873 - protein, 11 aa, Influenza virus
STVSSGLVLVG

SEQ ID NO: 409874 - protein, 11 aa, Influenza virus
TVSSGLVLVGL

SEQ ID NO: 409875 - protein, 11 aa, Influenza virus
VSSSLVLAGLI

SEQ ID NO: 409876 - protein, 11 aa, Influenza virus
WMCSNGSMQCN

SEQ ID NO: 409877 - protein, 11 aa, Influenza virus
KSRGYKMNTRI

SEQ ID NO: 409878 - protein, 11 aa, Influenza virus
SRGYKMNTRIL

SEQ ID NO: 409879 - protein, 11 aa, Influenza virus
LTEKGIEVVNA

SEQ ID NO: 409880 - protein, 11 aa, Influenza virus
TEKGIEVVNAT

SEQ ID NO: 409881 - protein, 11 aa, Influenza virus
EKGIEVVNATE

SEQ ID NO: 409882 - protein, 11 aa, Influenza virus
KGIEVVNATET

SEQ ID NO: 409883 - protein, 11 aa, Influenza virus
GVEVVDATETV

SEQ ID NO: 409884 - protein, 11 aa, Influenza virus
VEVVDATETVE

SEQ ID NO: 409885 - protein, 11 aa, Influenza virus
EVVNATETVEQ

SEQ ID NO: 409886 - protein, 11 aa, Influenza virus
GPPQCDRFLEF

SEQ ID NO: 409887 - protein, 11 aa, Influenza virus
SSFYAEMEWLL

SEQ ID NO: 409888 - protein, 11 aa, Influenza virus
FYAEMEWLLSN

SEQ ID NO: 409889 - protein, 11 aa, Influenza virus
FNGAFIAPNRA

SEQ ID NO: 409890 - protein, 11 aa, Influenza virus
NGAFIAPNRAS

SEQ ID NO: 409891 - protein, 11 aa, Influenza virus
GAFIAPNRASF

SEQ ID NO: 409892 - protein, 11 aa, Influenza virus
SLMLATGMKNV

SEQ ID NO: 409893 - protein, 11 aa, Influenza virus
LMLATGMKNVP

SEQ ID NO: 409894 - protein, 11 aa, Influenza virus
MLATGMKNVPE

SEQ ID NO: 409895 - protein, 11 aa, Influenza virus
IHKQLTHHMRK

SEQ ID NO: 409896 - protein, 11 aa, Influenza virus
RKTRGLFGAIA

SEQ ID NO: 409897 - protein, 11 aa, Influenza virus
KTRGLFGAIAG

SEQ ID NO: 409898 - protein, 11 aa, Influenza virus
KRGLFGAIAGF

SEQ ID NO: 409899 - protein, 11 aa, Influenza virus
FIENGWEGLVD

SEQ ID NO: 409900 - protein, 11 aa, Influenza virus
IENGWEGLVDG

SEQ ID NO: 409901 - protein, 11 aa, Influenza virus
ENGWEGLVDGW

SEQ ID NO: 409902 - protein, 11 aa, Influenza virus
NGWEGLVDGWY

SEQ ID NO: 409903 - protein, 11 aa, Influenza virus
GWEGLVDGWYG

SEQ ID NO: 409904 - protein, 11 aa, Influenza virus
WEGLVDGWYGF

SEQ ID NO: 409905 - protein, 11 aa, Influenza virus
EGLVDGWYGFR

SEQ ID NO: 409906 - protein, 11 aa, Influenza virus
GLVDGWYGFRH

SEQ ID NO: 409907 - protein, 11 aa, Influenza virus
LVDGWYGFRHQ

SEQ ID NO: 409908 - protein, 11 aa, Influenza virus
VDGWYGFRHQN

SEQ ID NO: 409909 - protein, 11 aa, Influenza virus
GWYGFRHQNSQ

SEQ ID NO: 409910 - protein, 11 aa, Influenza virus
WYGFRHQNSQG

SEQ ID NO: 409911 - protein, 11 aa, Influenza virus
YGFRHQNSQGE

SEQ ID NO: 409912 - protein, 11 aa, Influenza virus
GFRHQNSQGEG

SEQ ID NO: 409913 - protein, 11 aa, Influenza virus
KHQNAQGEGTA

SEQ ID NO: 409914 - protein, 11 aa, Influenza virus
HQNSQGEGTAA

SEQ ID NO: 409915 - protein, 11 aa, Influenza virus
QNSQGEGTAAD

SEQ ID NO: 409916 - protein, 11 aa, Influenza virus
NSQGEGTAADY

SEQ ID NO: 409917 - protein, 11 aa, Influenza virus
SQGEGTAADYK

SEQ ID NO: 409918 - protein, 11 aa, Influenza virus
ADYKSTQSAVD

SEQ ID NO: 409919 - protein, 11 aa, Influenza virus
DYKSTQSAVDQ

SEQ ID NO: 409920 - protein, 11 aa, Influenza virus
YKSTQSAINQI

SEQ ID NO: 409921 - protein, 11 aa, Influenza virus
KSTQSAINQIT

SEQ ID NO: 409922 - protein, 11 aa, Influenza virus
STQSAINQITG

SEQ ID NO: 409923 - protein, 11 aa, Influenza virus
TQSAINQITGK

SEQ ID NO: 409924 - protein, 11 aa, Influenza virus
QSAINQITGKL

SEQ ID NO: 409925 - protein, 11 aa, Influenza virus
SAINQITGKLN

SEQ ID NO: 409926 - protein, 11 aa, Influenza virus
AINQITGKLNR

SEQ ID NO: 409927 - protein, 11 aa, Influenza virus
NQITGKLNRLI

SEQ ID NO: 409928 - protein, 11 aa, Influenza virus
ERQIGNVINWT

SEQ ID NO: 409929 - protein, 11 aa, Influenza virus
QLGNVINWTRD

SEQ ID NO: 409930 - protein, 11 aa, Influenza virus
IGNVINWTQDA

SEQ ID NO: 409931 - protein, 11 aa, Influenza virus
LLIAMENQHTI

SEQ ID NO: 409932 - protein, 11 aa, Influenza virus
LIAMENQHTID

SEQ ID NO: 409933 - protein, 11 aa, Influenza virus
IAMENQHTIDL

SEQ ID NO: 409934 - protein, 11 aa, Influenza virus
AVENQHTIDLT

SEQ ID NO: 409935 - protein, 11 aa, Influenza virus
ENQHIIDLADS

SEQ ID NO: 409936 - protein, 11 aa, Influenza virus
NQHIIDLADSE

SEQ ID NO: 409937 - protein, 11 aa, Influenza virus
QHIIDLADSEM

SEQ ID NO: 409938 - protein, 11 aa, Influenza virus
VRRQLRENAEE

SEQ ID NO: 409939 - protein, 11 aa, Influenza virus
RRQLRENAEED

SEQ ID NO: 409940 - protein, 11 aa, Influenza virus
RLLRENAEEDG

SEQ ID NO: 409941 - protein, 11 aa, Influenza virus
QLRENAEEDGN

SEQ ID NO: 409942 - protein, 11 aa, Influenza virus
EEDGTGCFEIL

SEQ ID NO: 409943 - protein, 11 aa, Influenza virus
EDGTGCFEILH

SEQ ID NO: 409944 - protein, 11 aa, Influenza virus
DGTGCFEILHK

SEQ ID NO: 409945 - protein, 11 aa, Influenza virus
GTGCFEILHKC

SEQ ID NO: 409946 - protein, 11 aa, Influenza virus
GCFEIFHKCDN

SEQ ID NO: 409947 - protein, 11 aa, Influenza virus
CMESIRNNTYN

SEQ ID NO: 409948 - protein, 11 aa, Influenza virus
MESIRNNTYNH

SEQ ID NO: 409949 - protein, 11 aa, Influenza virus
SGYKEVILWFS

SEQ ID NO: 409950 - protein, 11 aa, Influenza virus
GYKEVILWFSF

SEQ ID NO: 409951 - protein, 11 aa, Influenza virus
YKEVILWFSFG

SEQ ID NO: 409952 - protein, 11 aa, Influenza virus
KEVILWFSFGA

SEQ ID NO: 409953 - protein, 11 aa, Influenza virus
EVILWFSFGAS

SEQ ID NO: 409954 - protein, 11 aa, Influenza virus
LWFSFGASCLI

SEQ ID NO: 409955 - protein, 11 aa, Influenza virus
WFSFGASCFLF

SEQ ID NO: 409956 - protein, 11 aa, Influenza virus
RNGNMRCTICI

SEQ ID NO: 409957 - protein, 11 aa, Influenza virus
TNADKICLGHH

SEQ ID NO: 409958 - protein, 11 aa, Influenza virus
RGDKICLGHHA

SEQ ID NO: 409959 - protein, 11 aa, Influenza virus
HHAVSNGTKIN

SEQ ID NO: 409960 - protein, 11 aa, Influenza virus
HAVSNGTKINT

SEQ ID NO: 409961 - protein, 11 aa, Influenza virus
AVSNGTKINTL

SEQ ID NO: 409962 - protein, 11 aa, Influenza virus
VSNGTKINTLT

SEQ ID NO: 409963 - protein, 11 aa, Influenza virus
SNGTKINTLTE

SEQ ID NO: 409964 - protein, 11 aa, Influenza virus
NGTKINTLTER

SEQ ID NO: 409965 - protein, 11 aa, Influenza virus
GTKINTLTERG

SEQ ID NO: 409966 - protein, 11 aa, Influenza virus
TKVNTLTERGV

SEQ ID NO: 409967 - protein, 11 aa, Influenza virus
KVNTLTERGVE

SEQ ID NO: 409968 - protein, 11 aa, Influenza virus
VNTLTERGVEV

SEQ ID NO: 409969 - protein, 11 aa, Influenza virus
NTLTERGVEVV

SEQ ID NO: 409970 - protein, 11 aa, Influenza virus
TLTERGVEVVN

SEQ ID NO: 409971 - protein, 11 aa, Influenza virus
LTERGVEVVNA

SEQ ID NO: 409972 - protein, 11 aa, Influenza virus
TERGVEVVNAT

SEQ ID NO: 409973 - protein, 11 aa, Influenza virus
ERGVEVVNATE

SEQ ID NO: 409974 - protein, 11 aa, Influenza virus
RGVEVVNATET

SEQ ID NO: 409975 - protein, 11 aa, Influenza virus
EVVNATETVEN

SEQ ID NO: 409976 - protein, 11 aa, Influenza virus
VVNATETVERT

SEQ ID NO: 409977 - protein, 11 aa, Influenza virus
CGLLGTITGPP

SEQ ID NO: 409978 - protein, 11 aa, Influenza virus
IGPPQCDKFLE

SEQ ID NO: 409979 - protein, 11 aa, Influenza virus
GPPHCDQFLEF

SEQ ID NO: 409980 - protein, 11 aa, Influenza virus
DLIIERREGAD

SEQ ID NO: 409981 - protein, 11 aa, Influenza virus
LRQILRESGGI

SEQ ID NO: 409982 - protein, 11 aa, Influenza virus
GFTYSEIRTNG

SEQ ID NO: 409983 - protein, 11 aa, Influenza virus
RSGSSFYAELK

SEQ ID NO: 409984 - protein, 11 aa, Influenza virus
SGSSFYAELKW

SEQ ID NO: 409985 - protein, 11 aa, Influenza virus
SSSFYAEMKWL

SEQ ID NO: 409986 - protein, 11 aa, Influenza virus
YAEMKWLLSSS

SEQ ID NO: 409987 - protein, 11 aa, Influenza virus
AEMKWLLSSSD

SEQ ID NO: 409988 - protein, 11 aa, Influenza virus
EMKWLLSSSDN

SEQ ID NO: 409989 - protein, 11 aa, Influenza virus
EQTKLYGSGSK

SEQ ID NO: 409990 - protein, 11 aa, Influenza virus
QTKLYGSGSKL

SEQ ID NO: 409991 - protein, 11 aa, Influenza virus
TKLYGNGNKLV

SEQ ID NO: 409992 - protein, 11 aa, Influenza virus
TRRIDFHWLLL

SEQ ID NO: 409993 - protein, 11 aa, Influenza virus
RRIDFHWLLLE

SEQ ID NO: 409994 - protein, 11 aa, Influenza virus
QSGRIDFHWLI

SEQ ID NO: 409995 - protein, 11 aa, Influenza virus
SGRIDFHWLIL

SEQ ID NO: 409996 - protein, 11 aa, Influenza virus
GRIDFHWLILN

SEQ ID NO: 409997 - protein, 11 aa, Influenza virus
NDTVTFIFNGA

SEQ ID NO: 409998 - protein, 11 aa, Influenza virus
DTVTFIFNGAF

SEQ ID NO: 409999 - protein, 11 aa, Influenza virus
TVTFIFNGAFI

SEQ ID NO: 410000 - protein, 11 aa, Influenza virus
VTFIFNGAFIA

SEQ ID NO: 410001 - protein, 11 aa, Influenza virus
TFIFNGAFIAP

SEQ ID NO: 410002 - protein, 11 aa, Influenza virus
FTFNGAFIAPN

SEQ ID NO: 410003 - protein, 11 aa, Influenza virus
TFNGAFIAPNR

SEQ ID NO: 410004 - protein, 11 aa, Influenza virus
AFIAPNRASFF

SEQ ID NO: 410005 - protein, 11 aa, Influenza virus
FIAPNRASFFR

SEQ ID NO: 410006 - protein, 11 aa, Influenza virus
IAPNRASFFRG

SEQ ID NO: 410007 - protein, 11 aa, Influenza virus
GGTIISSLPFQ

SEQ ID NO: 410008 - protein, 11 aa, Influenza virus
GTIVSSLPFQS

SEQ ID NO: 410009 - protein, 11 aa, Influenza virus
TIVSSLPFQSI

SEQ ID NO: 410010 - protein, 11 aa, Influenza virus
IVSSLPFQNIS

SEQ ID NO: 410011 - protein, 11 aa, Influenza virus
AVGKCPRYVKQ

SEQ ID NO: 410012 - protein, 11 aa, Influenza virus
VKQESLLLATG

SEQ ID NO: 410013 - protein, 11 aa, Influenza virus
KQESLLLATGM

SEQ ID NO: 410014 - protein, 11 aa, Influenza virus
QESLLLATGMK

SEQ ID NO: 410015 - protein, 11 aa, Influenza virus
ESLLLATGMKN

SEQ ID NO: 410016 - protein, 11 aa, Influenza virus
SLLLATGMRNI

SEQ ID NO: 410017 - protein, 11 aa, Influenza virus
LLLATGMRNIP

SEQ ID NO: 410018 - protein, 11 aa, Influenza virus
LLATGMRNIPE

SEQ ID NO: 410019 - protein, 11 aa, Influenza virus
LATGMKNVPEI

SEQ ID NO: 410020 - protein, 11 aa, Influenza virus
ATGMKNVPEIP

SEQ ID NO: 410021 - protein, 11 aa, Influenza virus
TGMKNVPEIPK

SEQ ID NO: 410022 - protein, 11 aa, Influenza virus
PKTRGLFGAIA

SEQ ID NO: 410023 - protein, 11 aa, Influenza virus
KTRGLFGAIAG

SEQ ID NO: 410024 - protein, 11 aa, Influenza virus
TRGLFGAIAGF

SEQ ID NO: 410025 - protein, 11 aa, Influenza virus
FIENGWEGLVD

SEQ ID NO: 410026 - protein, 11 aa, Influenza virus
IENGWEGLVDG

SEQ ID NO: 410027 - protein, 11 aa, Influenza virus
ENGWEGLVDGW

SEQ ID NO: 410028 - protein, 11 aa, Influenza virus
NGWEGLVDGWY

SEQ ID NO: 410029 - protein, 11 aa, Influenza virus
GWEGLVDGWYG

SEQ ID NO: 410030 - protein, 11 aa, Influenza virus
WEGLVDGWYGF

SEQ ID NO: 410031 - protein, 11 aa, Influenza virus
EGLVDGWYGFR

SEQ ID NO: 410032 - protein, 11 aa, Influenza virus
GLVDGWYGFRH

SEQ ID NO: 410033 - protein, 11 aa, Influenza virus
LVDGWYGFRHQ

SEQ ID NO: 410034 - protein, 11 aa, Influenza virus
VDGWYGFRHQN

SEQ ID NO: 410035 - protein, 11 aa, Influenza virus
DGWYGFRHQNT

SEQ ID NO: 410036 - protein, 11 aa, Influenza virus
QITGKLNRLIS

SEQ ID NO: 410037 - protein, 11 aa, Influenza virus
ITGKLNRLISK

SEQ ID NO: 410038 - protein, 11 aa, Influenza virus
TGKLNRLISKT

SEQ ID NO: 410039 - protein, 11 aa, Influenza virus
GKLNRLISKTN

SEQ ID NO: 410040 - protein, 11 aa, Influenza virus
KLNRLISKTNQ

SEQ ID NO: 410041 - protein, 11 aa, Influenza virus
LNRLISKTNQQ

SEQ ID NO: 410042 - protein, 11 aa, Influenza virus
NRLIEKTNQQF

SEQ ID NO: 410043 - protein, 11 aa, Influenza virus
LISKTNQQFEL

SEQ ID NO: 410044 - protein, 11 aa, Influenza virus
ISKTNQQFELI

SEQ ID NO: 410045 - protein, 11 aa, Influenza virus
TNQQFGLIDNE

SEQ ID NO: 410046 - protein, 11 aa, Influenza virus
NQQFGLIDNEF

SEQ ID NO: 410047 - protein, 11 aa, Influenza virus
NEFTEVEKQIG

SEQ ID NO: 410048 - protein, 11 aa, Influenza virus
EFTEVEKQIGN

SEQ ID NO: 410049 - protein, 11 aa, Influenza virus
FTEVEKQIGNV

SEQ ID NO: 410050 - protein, 11 aa, Influenza virus
TEVEKQIGNVI

SEQ ID NO: 410051 - protein, 11 aa, Influenza virus
EVEKQIGNVIN

SEQ ID NO: 410052 - protein, 11 aa, Influenza virus
VEKQIGNVINW

SEQ ID NO: 410053 - protein, 11 aa, Influenza virus
KQIGNVINWTR

SEQ ID NO: 410054 - protein, 11 aa, Influenza virus
IGNVINWTRDS

SEQ ID NO: 410055 - protein, 11 aa, Influenza virus
GNVINWTRDSM

SEQ ID NO: 410056 - protein, 11 aa, Influenza virus
NVINWTRDSMT

SEQ ID NO: 410057 - protein, 11 aa, Influenza virus
VINWTRDSMTE

SEQ ID NO: 410058 - protein, 11 aa, Influenza virus
INWTRDSMTEV

SEQ ID NO: 410059 - protein, 11 aa, Influenza virus
NWTRDSMTEVW

SEQ ID NO: 410060 - protein, 11 aa, Influenza virus
WTRDSMTEVWS

SEQ ID NO: 410061 - protein, 11 aa, Influenza virus
TRDSMTEVWSY

SEQ ID NO: 410062 - protein, 11 aa, Influenza virus
RDSMTEVWSYN

SEQ ID NO: 410063 - protein, 11 aa, Influenza virus
DSMTEVWSYNA

SEQ ID NO: 410064 - protein, 11 aa, Influenza virus
SMTEVWSYNAE

SEQ ID NO: 410065 - protein, 11 aa, Influenza virus
ITEVWSYNAEL

SEQ ID NO: 410066 - protein, 11 aa, Influenza virus
WSYNAELLVAI

SEQ ID NO: 410067 - protein, 11 aa, Influenza virus
SYNAELLVAIE

SEQ ID NO: 410068 - protein, 11 aa, Influenza virus
AELLVAIENQH

SEQ ID NO: 410069 - protein, 11 aa, Influenza virus
ELLVAIENQHT

SEQ ID NO: 410070 - protein, 11 aa, Influenza virus
LLVAIENQHTI

SEQ ID NO: 410071 - protein, 11 aa, Influenza virus
LVAIENQHTID

SEQ ID NO: 410072 - protein, 11 aa, Influenza virus
VAIENQHTIDL

SEQ ID NO: 410073 - protein, 11 aa, Influenza virus
ALENQHTIDLA

SEQ ID NO: 410074 - protein, 11 aa, Influenza virus
LENQHTIDLAD

SEQ ID NO: 410075 - protein, 11 aa, Influenza virus
QHIIDLADSEM

SEQ ID NO: 410076 - protein, 11 aa, Influenza virus
IDLTDSEMSKL

SEQ ID NO: 410077 - protein, 11 aa, Influenza virus
DLTDSEMSKLY

SEQ ID NO: 410078 - protein, 11 aa, Influenza virus
DSEMKKLYERV

SEQ ID NO: 410079 - protein, 11 aa, Influenza virus
SEMNKLYERVR

SEQ ID NO: 410080 - protein, 11 aa, Influenza virus
KLYERVRRQLR

SEQ ID NO: 410081 - protein, 11 aa, Influenza virus
LYERVRRQLRE

SEQ ID NO: 410082 - protein, 11 aa, Influenza virus
YERVRRQLREN

SEQ ID NO: 410083 - protein, 11 aa, Influenza virus
ERVRRQLRENA

SEQ ID NO: 410084 - protein, 11 aa, Influenza virus
RVRRQLRENAE

SEQ ID NO: 410085 - protein, 11 aa, Influenza virus
VRRQLRENAEE

SEQ ID NO: 410086 - protein, 11 aa, Influenza virus
RRQLRENAEED

SEQ ID NO: 410087 - protein, 11 aa, Influenza virus
CFEIFHKCDDD

SEQ ID NO: 410088 - protein, 11 aa, Influenza virus
FEIFHKCDDDC

SEQ ID NO: 410089 - protein, 11 aa, Influenza virus
EIFHKCDDDCM

SEQ ID NO: 410090 - protein, 11 aa, Influenza virus
IFHKCDDDCMA

SEQ ID NO: 410091 - protein, 11 aa, Influenza virus
FHKCDDDCMAS

SEQ ID NO: 410092 - protein, 11 aa, Influenza virus
HKCDDDCMASI

SEQ ID NO: 410093 - protein, 11 aa, Influenza virus
KCDDDCMASIR

SEQ ID NO: 410094 - protein, 11 aa, Influenza virus
CDDDCMASIRN

SEQ ID NO: 410095 - protein, 11 aa, Influenza virus
DDDCMASIRNN

SEQ ID NO: 410096 - protein, 11 aa, Influenza virus
DDCMASIRNNT

SEQ ID NO: 410097 - protein, 11 aa, Influenza virus
DCMASIRNNTY

SEQ ID NO: 410098 - protein, 11 aa, Influenza virus
CMESIRNNTYN

SEQ ID NO: 410099 - protein, 11 aa, Influenza virus
MESIRNNTYNH

SEQ ID NO: 410100 - protein, 11 aa, Influenza virus
ESIRNNTYNHT

SEQ ID NO: 410101 - protein, 11 aa, Influenza virus
SIRNNTYDHTK

SEQ ID NO: 410102 - protein, 11 aa, Influenza virus
IRNNTYNHTQY

SEQ ID NO: 410103 - protein, 11 aa, Influenza virus
RNNTYDHTKYR

SEQ ID NO: 410104 - protein, 11 aa, Influenza virus
KYRTESLQNRI

SEQ ID NO: 410105 - protein, 11 aa, Influenza virus
YRKEAMQNRIQ

SEQ ID NO: 410106 - protein, 11 aa, Influenza virus
RTGSLQNRIQI

SEQ ID NO: 410107 - protein, 11 aa, Influenza virus
EEAMQNRLKID

SEQ ID NO: 410108 - protein, 11 aa, Influenza virus
ESLQNRIQIDS

SEQ ID NO: 410109 - protein, 11 aa, Influenza virus
SLQNRIQIDSV

SEQ ID NO: 410110 - protein, 11 aa, Influenza virus
LQNRIQIDSVK

SEQ ID NO: 410111 - protein, 11 aa, Influenza virus
QNRIQIDQVKL

SEQ ID NO: 410112 - protein, 11 aa, Influenza virus
NRIQIDQVKLS

SEQ ID NO: 410113 - protein, 11 aa, Influenza virus
RIQIDQVKLSS

SEQ ID NO: 410114 - protein, 11 aa, Influenza virus
IQIDQVKLSSG

SEQ ID NO: 410115 - protein, 11 aa, Influenza virus
QIDQVKLSSGY

SEQ ID NO: 410116 - protein, 11 aa, Influenza virus
IDQVKLSSGYK

SEQ ID NO: 410117 - protein, 11 aa, Influenza virus
DQVKLSSGYKD

SEQ ID NO: 410118 - protein, 11 aa, Influenza virus
SVKLSSGYKDI

SEQ ID NO: 410119 - protein, 11 aa, Influenza virus
VKLSGGYKDII

SEQ ID NO: 410120 - protein, 11 aa, Influenza virus
KLSGGYKDIIL

SEQ ID NO: 410121 - protein, 11 aa, Influenza virus
LSGGYKDIILW

SEQ ID NO: 410122 - protein, 11 aa, Influenza virus
SGGYKDIILWF

SEQ ID NO: 410123 - protein, 11 aa, Influenza virus
GGYKDIILWFS

SEQ ID NO: 410124 - protein, 11 aa, Influenza virus
FGASCFLLLAV

SEQ ID NO: 410125 - protein, 11 aa, Influenza virus
GASCFLLLAIV

SEQ ID NO: 410126 - protein, 11 aa, Influenza virus
AMGLVFMCVKN

SEQ ID NO: 410127 - protein, 11 aa, Influenza virus
MGLVFICVKNG

SEQ ID NO: 410128 - protein, 11 aa, Influenza virus
GLVFICVKNGN

SEQ ID NO: 410129 - protein, 11 aa, Influenza virus
LVFICVKNGNM

SEQ ID NO: 410130 - protein, 11 aa, Influenza virus
VFMCVKNGNMR

SEQ ID NO: 410131 - protein, 11 aa, Influenza virus
FICVKNGNMRC

SEQ ID NO: 410132 - protein, 11 aa, Influenza virus
MCVKNGNMRCT

SEQ ID NO: 410133 - protein, 11 aa, Influenza virus
CVKNGNMRCTI

SEQ ID NO: 410134 - protein, 11 aa, Influenza virus
VKNGNMRCTIC

SEQ ID NO: 410135 - protein, 11 aa, Influenza virus
KIITIGSVSLI

SEQ ID NO: 410136 - protein, 11 aa, Influenza virus
ITIGSVSLIIA

SEQ ID NO: 410137 - protein, 11 aa, Influenza virus
TIGSVSLTIAI

SEQ ID NO: 410138 - protein, 11 aa, Influenza virus
KRNITEIVYLN

SEQ ID NO: 410139 - protein, 11 aa, Influenza virus
NITEIVYLNHT

SEQ ID NO: 410140 - protein, 11 aa, Influenza virus
YRDWSKPQCQI

SEQ ID NO: 410141 - protein, 11 aa, Influenza virus
GFAPFSKDNSV

SEQ ID NO: 410142 - protein, 11 aa, Influenza virus
FAPFSKDNSVR

SEQ ID NO: 410143 - protein, 11 aa, Influenza virus
APFSKDNSVRL

SEQ ID NO: 410144 - protein, 11 aa, Influenza virus
PFSKDNSVRLS

SEQ ID NO: 410145 - protein, 11 aa, Influenza virus
FSKDNSVRLSA

SEQ ID NO: 410146 - protein, 11 aa, Influenza virus
SKDNSVRLSAS

SEQ ID NO: 410147 - protein, 11 aa, Influenza virus
DNSIRLSAGGN

SEQ ID NO: 410148 - protein, 11 aa, Influenza virus
NSVRLSASGDI

SEQ ID NO: 410149 - protein, 11 aa, Influenza virus
SVRLSASGDIW

SEQ ID NO: 410150 - protein, 11 aa, Influenza virus
RLSAGGDIWVT

SEQ ID NO: 410151 - protein, 11 aa, Influenza virus
LSAGGDIWVTR

SEQ ID NO: 410152 - protein, 11 aa, Influenza virus
SAGGDIWVTRE

SEQ ID NO: 410153 - protein, 11 aa, Influenza virus
AGGDIWVTREP

SEQ ID NO: 410154 - protein, 11 aa, Influenza virus
GGDIWVTREPY

SEQ ID NO: 410155 - protein, 11 aa, Influenza virus
GDIWVTREPYV

SEQ ID NO: 410156 - protein, 11 aa, Influenza virus
DIWVTREPYVS

SEQ ID NO: 410157 - protein, 11 aa, Influenza virus
WVTREPYVSCS

SEQ ID NO: 410158 - protein, 11 aa, Influenza virus
GKCYQFALGQG

SEQ ID NO: 410159 - protein, 11 aa, Influenza virus
QFALGQGTTLE

SEQ ID NO: 410160 - protein, 11 aa, Influenza virus
FALGQGTTLEN

SEQ ID NO: 410161 - protein, 11 aa, Influenza virus
ALGQGTTLYNK

SEQ ID NO: 410162 - protein, 11 aa, Influenza virus
LGQGTTLYNKH

SEQ ID NO: 410163 - protein, 11 aa, Influenza virus
GQGTTLYNKHS

SEQ ID NO: 410164 - protein, 11 aa, Influenza virus
QGTTLYNKHSN

SEQ ID NO: 410165 - protein, 11 aa, Influenza virus
GTTLYNKHSNG

SEQ ID NO: 410166 - protein, 11 aa, Influenza virus
TTLYNKHSNGT

SEQ ID NO: 410167 - protein, 11 aa, Influenza virus
NEHSNGTTHDR

SEQ ID NO: 410168 - protein, 11 aa, Influenza virus
KHSNGTIHDRT

SEQ ID NO: 410169 - protein, 11 aa, Influenza virus
HDRTSHRTLLM

SEQ ID NO: 410170 - protein, 11 aa, Influenza virus
DRTSHRTLLMN

SEQ ID NO: 410171 - protein, 11 aa, Influenza virus
RTSHRTLLMNE

SEQ ID NO: 410172 - protein, 11 aa, Influenza virus
TSHRTLLMNEL

SEQ ID NO: 410173 - protein, 11 aa, Influenza virus
FHLGTKQVCMA

SEQ ID NO: 410174 - protein, 11 aa, Influenza virus
HLGTKQVCMAW

SEQ ID NO: 410175 - protein, 11 aa, Influenza virus
LGTKQVCMAWS

SEQ ID NO: 410176 - protein, 11 aa, Influenza virus
GTKQVCMAWSS

SEQ ID NO: 410177 - protein, 11 aa, Influenza virus
TKQVCMAWSSS

SEQ ID NO: 410178 - protein, 11 aa, Influenza virus
KQVCMAWSSSS

SEQ ID NO: 410179 - protein, 11 aa, Influenza virus
HDGKAWLHICV

SEQ ID NO: 410180 - protein, 11 aa, Influenza virus
DGKAWLHICVT

SEQ ID NO: 410181 - protein, 11 aa, Influenza virus
GKAWLHICVTG

SEQ ID NO: 410182 - protein, 11 aa, Influenza virus
KAWLHICVTGD

SEQ ID NO: 410183 - protein, 11 aa, Influenza virus
AWLHVCITGDD

SEQ ID NO: 410184 - protein, 11 aa, Influenza virus
WLHVCITGDDR

SEQ ID NO: 410185 - protein, 11 aa, Influenza virus
LHICVTGDDRN

SEQ ID NO: 410186 - protein, 11 aa, Influenza virus
HICVTGDDRNA

SEQ ID NO: 410187 - protein, 11 aa, Influenza virus
VCITGDDRNAT

SEQ ID NO: 410188 - protein, 11 aa, Influenza virus
CVTGDDKNATA

SEQ ID NO: 410189 - protein, 11 aa, Influenza virus
VTGDDKNATAS

SEQ ID NO: 410190 - protein, 11 aa, Influenza virus
TGDDRNATASL

SEQ ID NO: 410191 - protein, 11 aa, Influenza virus
GDDRNATASLI

SEQ ID NO: 410192 - protein, 11 aa, Influenza virus
DDRNATASLIY

SEQ ID NO: 410193 - protein, 11 aa, Influenza virus
LIDSIGSWSQN

SEQ ID NO: 410194 - protein, 11 aa, Influenza virus
IDSIGSWSQNI

SEQ ID NO: 410195 - protein, 11 aa, Influenza virus
SECVCINGSCA

SEQ ID NO: 410196 - protein, 11 aa, Influenza virus
ECVCINGSCAV

SEQ ID NO: 410197 - protein, 11 aa, Influenza virus
CVCINGSCAVV

SEQ ID NO: 410198 - protein, 11 aa, Influenza virus
VCINGSCAVVM

SEQ ID NO: 410199 - protein, 11 aa, Influenza virus
CINGSCAVVMT

SEQ ID NO: 410200 - protein, 11 aa, Influenza virus
INGSCAVVMTD

SEQ ID NO: 410201 - protein, 11 aa, Influenza virus
NGSCAVVMTDG

SEQ ID NO: 410202 - protein, 11 aa, Influenza virus
GTCTVVMTDGS

SEQ ID NO: 410203 - protein, 11 aa, Influenza virus
TCTVVMTDGSA

SEQ ID NO: 410204 - protein, 11 aa, Influenza virus
CAVVMTDGSAS

SEQ ID NO: 410205 - protein, 11 aa, Influenza virus
AVVMTDGSASG

SEQ ID NO: 410206 - protein, 11 aa, Influenza virus
VVMTDGSASGR

SEQ ID NO: 410207 - protein, 11 aa, Influenza virus
VMTDGSASGRA

SEQ ID NO: 410208 - protein, 11 aa, Influenza virus
MTDGSASGKAE

SEQ ID NO: 410209 - protein, 11 aa, Influenza virus
TDGSASGKAET

SEQ ID NO: 410210 - protein, 11 aa, Influenza virus
EGKIAHISPLS

SEQ ID NO: 410211 - protein, 11 aa, Influenza virus
GKIAHISPLSG

SEQ ID NO: 410212 - protein, 11 aa, Influenza virus
IAHISPLSGSA

SEQ ID NO: 410213 - protein, 11 aa, Influenza virus
AHISPLSGSAQ

SEQ ID NO: 410214 - protein, 11 aa, Influenza virus
EECSCYPRYPD

SEQ ID NO: 410215 - protein, 11 aa, Influenza virus
ECSCYPRYPDV

SEQ ID NO: 410216 - protein, 11 aa, Influenza virus
CSCYPRYPDVR

SEQ ID NO: 410217 - protein, 11 aa, Influenza virus
SCYPRYPDVRC

SEQ ID NO: 410218 - protein, 11 aa, Influenza virus
CYPRYPDVRCV

SEQ ID NO: 410219 - protein, 11 aa, Influenza virus
YPRYPDVRCVC

SEQ ID NO: 410220 - protein, 11 aa, Influenza virus
PRYPDVRCVCR

SEQ ID NO: 410221 - protein, 11 aa, Influenza virus
RYPDVRCVCRD

SEQ ID NO: 410222 - protein, 11 aa, Influenza virus
DNWKGSNRPVV

SEQ ID NO: 410223 - protein, 11 aa, Influenza virus
NWKGSNRPVVD

SEQ ID NO: 410224 - protein, 11 aa, Influenza virus
WKGSNRPIIDI

SEQ ID NO: 410225 - protein, 11 aa, Influenza virus
KGSNRPIIDIN

SEQ ID NO: 410226 - protein, 11 aa, Influenza virus
GSNRPIIDINM

SEQ ID NO: 410227 - protein, 11 aa, Influenza virus
IGSSYVCSGLV

SEQ ID NO: 410228 - protein, 11 aa, Influenza virus
GSSYVCSGLVG

SEQ ID NO: 410229 - protein, 11 aa, Influenza virus
LVGDTPRNDDS

SEQ ID NO: 410230 - protein, 11 aa, Influenza virus
VGDTPRNDDSS

SEQ ID NO: 410231 - protein, 11 aa, Influenza virus
GDTPRNDDSSS

SEQ ID NO: 410232 - protein, 11 aa, Influenza virus
DTPRNDDSSSS

SEQ ID NO: 410233 - protein, 11 aa, Influenza virus
TPRNDDSSSSS

SEQ ID NO: 410234 - protein, 11 aa, Influenza virus
PRNDDSSSSSN

SEQ ID NO: 410235 - protein, 11 aa, Influenza virus
RNDDSSSSSNC

SEQ ID NO: 410236 - protein, 11 aa, Influenza virus
DPNNERGNPGV

SEQ ID NO: 410237 - protein, 11 aa, Influenza virus
PNNERGNPGVK

SEQ ID NO: 410238 - protein, 11 aa, Influenza virus
NNERGNPGVKG

SEQ ID NO: 410239 - protein, 11 aa, Influenza virus
NERGNPGVKGW

SEQ ID NO: 410240 - protein, 11 aa, Influenza virus
ERGSPGVKGWA

SEQ ID NO: 410241 - protein, 11 aa, Influenza virus
RGSPGVKGWAF

SEQ ID NO: 410242 - protein, 11 aa, Influenza virus
NPGVKGWAFDY

SEQ ID NO: 410243 - protein, 11 aa, Influenza virus
PGVKGWAFDYG

SEQ ID NO: 410244 - protein, 11 aa, Influenza virus
GVKGWAFDYGN

SEQ ID NO: 410245 - protein, 11 aa, Influenza virus
VKGWAFDYGND

SEQ ID NO: 410246 - protein, 11 aa, Influenza virus
YGNDVWMGRTI

SEQ ID NO: 410247 - protein, 11 aa, Influenza virus
EDDVWMGRTIS

SEQ ID NO: 410248 - protein, 11 aa, Influenza virus
DDVWMGRTISM

SEQ ID NO: 410249 - protein, 11 aa, Influenza virus
DVWMGRTISMD

SEQ ID NO: 410250 - protein, 11 aa, Influenza virus
VWMGRTISMDS

SEQ ID NO: 410251 - protein, 11 aa, Influenza virus
WMGRTISMDSR

SEQ ID NO: 410252 - protein, 11 aa, Influenza virus
MGRTISMDSRS

SEQ ID NO: 410253 - protein, 11 aa, Influenza virus
GRTISMDSRSG

SEQ ID NO: 410254 - protein, 11 aa, Influenza virus
RTISMDSRSGY

SEQ ID NO: 410255 - protein, 11 aa, Influenza virus
TISMDSRSGYE

SEQ ID NO: 410256 - protein, 11 aa, Influenza virus
ISMDSRSGYET

SEQ ID NO: 410257 - protein, 11 aa, Influenza virus
SMDSRSGYETF

SEQ ID NO: 410258 - protein, 11 aa, Influenza virus
MDSRSGYETFR

SEQ ID NO: 410259 - protein, 11 aa, Influenza virus
RSGYETFRVID

SEQ ID NO: 410260 - protein, 11 aa, Influenza virus
SGYETFRVIDG

SEQ ID NO: 410261 - protein, 11 aa, Influenza virus
GYETFRVIDGW

SEQ ID NO: 410262 - protein, 11 aa, Influenza virus
YETFRVISGWT

SEQ ID NO: 410263 - protein, 11 aa, Influenza virus
VIGGWTIANSK

SEQ ID NO: 410264 - protein, 11 aa, Influenza virus
IGGWTIANSKS

SEQ ID NO: 410265 - protein, 11 aa, Influenza virus
VDNSNWSGYSG

SEQ ID NO: 410266 - protein, 11 aa, Influenza virus
NSNWSGYSGIF

SEQ ID NO: 410267 - protein, 11 aa, Influenza virus
NNWFGYFGIFF

SEQ ID NO: 410268 - protein, 11 aa, Influenza virus
NWSGYSGVFSV

SEQ ID NO: 410269 - protein, 11 aa, Influenza virus
WSGYSGVFSVE

SEQ ID NO: 410270 - protein, 11 aa, Influenza virus
KRCINRCFYVE

SEQ ID NO: 410271 - protein, 11 aa, Influenza virus
RCINRCFYVEL

SEQ ID NO: 410272 - protein, 11 aa, Influenza virus
FYVELIRGMPQ

SEQ ID NO: 410273 - protein, 11 aa, Influenza virus
YVELIRGMPQE

SEQ ID NO: 410274 - protein, 11 aa, Influenza virus
PQENRVWWTSN

SEQ ID NO: 410275 - protein, 11 aa, Influenza virus
QENRVWWTSNS

SEQ ID NO: 410276 - protein, 11 aa, Influenza virus
ETTVWWTSNSI

SEQ ID NO: 410277 - protein, 11 aa, Influenza virus
KVWWTSNSIVV

SEQ ID NO: 410278 - protein, 11 aa, Influenza virus
NSIVVFWGTSG

SEQ ID NO: 410279 - protein, 11 aa, Influenza virus
SIVVFCGTSRT

SEQ ID NO: 410280 - protein, 11 aa, Influenza virus
IVVFCGTSATY

SEQ ID NO: 410281 - protein, 11 aa, Influenza virus
VAFCGTSGTYG

SEQ ID NO: 410282 - protein, 11 aa, Influenza virus
TGSWPDGANID

SEQ ID NO: 410283 - protein, 11 aa, Influenza virus
GSWPDGANIDF

SEQ ID NO: 410284 - protein, 11 aa, Influenza virus
SWPDGANIDFV

SEQ ID NO: 410285 - protein, 11 aa, Influenza virus
SKSRGYKMNNQ

SEQ ID NO: 410286 - protein, 11 aa, Influenza virus
KSRGYKMNTQI

SEQ ID NO: 410287 - protein, 11 aa, Influenza virus
SRGYKMNTRIL

SEQ ID NO: 410288 - protein, 11 aa, Influenza virus
RGYKMNTQILV

SEQ ID NO: 410289 - protein, 11 aa, Influenza virus
GYKMNNQILIL

SEQ ID NO: 410290 - protein, 11 aa, Influenza virus
YKMNNQILILA

SEQ ID NO: 410291 - protein, 11 aa, Influenza virus
KMNNQILILAL

SEQ ID NO: 410292 - protein, 11 aa, Influenza virus
DKICLGHHAVP

SEQ ID NO: 410293 - protein, 11 aa, Influenza virus
KICLGHHAVPN

SEQ ID NO: 410294 - protein, 11 aa, Influenza virus
ICLGHHAVPNG

SEQ ID NO: 410295 - protein, 11 aa, Influenza virus
CLGHHAVPNGT

SEQ ID NO: 410296 - protein, 11 aa, Influenza virus
LGHHAVPNGTK

SEQ ID NO: 410297 - protein, 11 aa, Influenza virus
GHHAVPNGTKV

SEQ ID NO: 410298 - protein, 11 aa, Influenza virus
VNTLTEKGIEV

SEQ ID NO: 410299 - protein, 11 aa, Influenza virus
TLTEKGIEVVN

SEQ ID NO: 410300 - protein, 11 aa, Influenza virus
LTEKGIEVVNA

SEQ ID NO: 410301 - protein, 11 aa, Influenza virus
TEKGIEVVNAT

SEQ ID NO: 410302 - protein, 11 aa, Influenza virus
EKGIEVVNATE

SEQ ID NO: 410303 - protein, 11 aa, Influenza virus
KGIEVVNATET

SEQ ID NO: 410304 - protein, 11 aa, Influenza virus
GVEVVDATETV

SEQ ID NO: 410305 - protein, 11 aa, Influenza virus
VEVVDATETVE

SEQ ID NO: 410306 - protein, 11 aa, Influenza virus
EVVDATETVER

SEQ ID NO: 410307 - protein, 11 aa, Influenza virus
CGLLGTVTGPP

SEQ ID NO: 410308 - protein, 11 aa, Influenza virus
GLLGTVTGPPQ

SEQ ID NO: 410309 - protein, 11 aa, Influenza virus
LLGTVTGPPQC

SEQ ID NO: 410310 - protein, 11 aa, Influenza virus
LGTVTGPPQCD

SEQ ID NO: 410311 - protein, 11 aa, Influenza virus
IGPPQCDLFLE

SEQ ID NO: 410312 - protein, 11 aa, Influenza virus
GPPQCDRFLEF

SEQ ID NO: 410313 - protein, 11 aa, Influenza virus
LRQILRRSGGI

SEQ ID NO: 410314 - protein, 11 aa, Influenza virus
GPSFYAEMKWL

SEQ ID NO: 410315 - protein, 11 aa, Influenza virus
YAEMKWLLSNN

SEQ ID NO: 410316 - protein, 11 aa, Influenza virus
AEMKWLLSNND

SEQ ID NO: 410317 - protein, 11 aa, Influenza virus
EMKWLLSNNDN

SEQ ID NO: 410318 - protein, 11 aa, Influenza virus
PALIVWGIHHS

SEQ ID NO: 410319 - protein, 11 aa, Influenza virus
LYGSGSKLITV

SEQ ID NO: 410320 - protein, 11 aa, Influenza virus
SSNYHQSFVPS

SEQ ID NO: 410321 - protein, 11 aa, Influenza virus
SNYHQSFVPSP

SEQ ID NO: 410322 - protein, 11 aa, Influenza virus
NYHQSFVPSPG

SEQ ID NO: 410323 - protein, 11 aa, Influenza virus
VNGQTGRIDFH

SEQ ID NO: 410324 - protein, 11 aa, Influenza virus
NGQTGRIDFHW

SEQ ID NO: 410325 - protein, 11 aa, Influenza virus
GQSGRINFHWL

SEQ ID NO: 410326 - protein, 11 aa, Influenza virus
FSFNGAFVAPD

SEQ ID NO: 410327 - protein, 11 aa, Influenza virus
SFNGAFVAPDR

SEQ ID NO: 410328 - protein, 11 aa, Influenza virus
FNGAFVAPDRV

SEQ ID NO: 410329 - protein, 11 aa, Influenza virus
NGAFIAPDRAT

SEQ ID NO: 410330 - protein, 11 aa, Influenza virus
GAFIAPDRATF

SEQ ID NO: 410331 - protein, 11 aa, Influenza virus
GGTITSPLPFQ

SEQ ID NO: 410332 - protein, 11 aa, Influenza virus
GTITSPLPFQN

SEQ ID NO: 410333 - protein, 11 aa, Influenza virus
TITSPLPFQNI

SEQ ID NO: 410334 - protein, 11 aa, Influenza virus
ITSPLPFQNIN

SEQ ID NO: 410335 - protein, 11 aa, Influenza virus
SLMLATGMKNV

SEQ ID NO: 410336 - protein, 11 aa, Influenza virus
LMLATGMKNVP

SEQ ID NO: 410337 - protein, 11 aa, Influenza virus
MLATGMKNVPE

SEQ ID NO: 410338 - protein, 11 aa, Influenza virus
LATGMKNVPET

SEQ ID NO: 410339 - protein, 11 aa, Influenza virus
ATGMKNVPETP

SEQ ID NO: 410340 - protein, 11 aa, Influenza virus
TGMKNVPETPK

SEQ ID NO: 410341 - protein, 11 aa, Influenza virus
KRKRGLFGAIA

SEQ ID NO: 410342 - protein, 11 aa, Influenza virus
RRRGLFGAIAG

SEQ ID NO: 410343 - protein, 11 aa, Influenza virus
AYRKRMTRGLF

SEQ ID NO: 410344 - protein, 11 aa, Influenza virus
YRKRMTRGLFG

SEQ ID NO: 410345 - protein, 11 aa, Influenza virus
RCRKTRGLFGA

SEQ ID NO: 410346 - protein, 11 aa, Influenza virus
CRKTRGLFGAI

SEQ ID NO: 410347 - protein, 11 aa, Influenza virus
RKTRGLFGAIA

SEQ ID NO: 410348 - protein, 11 aa, Influenza virus
KTRGLFGAIAG

SEQ ID NO: 410349 - protein, 11 aa, Influenza virus
PRGLFGAIAGF

SEQ ID NO: 410350 - protein, 11 aa, Influenza virus
FIENGWEGLIN

SEQ ID NO: 410351 - protein, 11 aa, Influenza virus
IENGWEGLING

SEQ ID NO: 410352 - protein, 11 aa, Influenza virus
ENGWEGLINGW

SEQ ID NO: 410353 - protein, 11 aa, Influenza virus
NGWEGLINGWY

SEQ ID NO: 410354 - protein, 11 aa, Influenza virus
GWEGLINGWYG

SEQ ID NO: 410355 - protein, 11 aa, Influenza virus
WEGLINGWYGF

SEQ ID NO: 410356 - protein, 11 aa, Influenza virus
EGLINGWYGFR

SEQ ID NO: 410357 - protein, 11 aa, Influenza virus
GLINGWYGFRH

SEQ ID NO: 410358 - protein, 11 aa, Influenza virus
LINGWYGFRHQ

SEQ ID NO: 410359 - protein, 11 aa, Influenza virus
INGWYGFRHQN

SEQ ID NO: 410360 - protein, 11 aa, Influenza virus
DGWYGFKHQNA

SEQ ID NO: 410361 - protein, 11 aa, Influenza virus
FKHQNAQGEGT

SEQ ID NO: 410362 - protein, 11 aa, Influenza virus
KHQNAQGEGTA

SEQ ID NO: 410363 - protein, 11 aa, Influenza virus
EGTAADYKSTP

SEQ ID NO: 410364 - protein, 11 aa, Influenza virus
GTAADYKSTPS

SEQ ID NO: 410365 - protein, 11 aa, Influenza virus
TAADYKSTPSA

SEQ ID NO: 410366 - protein, 11 aa, Influenza virus
AADYKSTPSAI

SEQ ID NO: 410367 - protein, 11 aa, Influenza virus
ADYKSTQSAVD

SEQ ID NO: 410368 - protein, 11 aa, Influenza virus
DYKSTQSAVDQ

SEQ ID NO: 410369 - protein, 11 aa, Influenza virus
YKSTQSAVDQI

SEQ ID NO: 410370 - protein, 11 aa, Influenza virus
KSTQSAVDQIT

SEQ ID NO: 410371 - protein, 11 aa, Influenza virus
STQSAVDQITG

SEQ ID NO: 410372 - protein, 11 aa, Influenza virus
TQSAVDQITGK

SEQ ID NO: 410373 - protein, 11 aa, Influenza virus
QSAVDQITGKL

SEQ ID NO: 410374 - protein, 11 aa, Influenza virus
SAVDQITGKLN

SEQ ID NO: 410375 - protein, 11 aa, Influenza virus
AVDQITGKLNR

SEQ ID NO: 410376 - protein, 11 aa, Influenza virus
INQITGKLNRI

SEQ ID NO: 410377 - protein, 11 aa, Influenza virus
NQITGKLNRII

SEQ ID NO: 410378 - protein, 11 aa, Influenza virus
QITGKLNRIIE

SEQ ID NO: 410379 - protein, 11 aa, Influenza virus
ITGKLNRIIEK

SEQ ID NO: 410380 - protein, 11 aa, Influenza virus
TGKLNRIIEKT

SEQ ID NO: 410381 - protein, 11 aa, Influenza virus
GKLNRIIEKTN

SEQ ID NO: 410382 - protein, 11 aa, Influenza virus
KLNRIIEKTNQ

SEQ ID NO: 410383 - protein, 11 aa, Influenza virus
LNRIIEKTNQQ

SEQ ID NO: 410384 - protein, 11 aa, Influenza virus
NRIIEKTNQQF

SEQ ID NO: 410385 - protein, 11 aa, Influenza virus
IDKTNQQFEMI

SEQ ID NO: 410386 - protein, 11 aa, Influenza virus
DKTNQQFEMID

SEQ ID NO: 410387 - protein, 11 aa, Influenza virus
KTNQQFKLIDN

SEQ ID NO: 410388 - protein, 11 aa, Influenza virus
TNQQFKLIDNE

SEQ ID NO: 410389 - protein, 11 aa, Influenza virus
NQQFKLIDNEF

SEQ ID NO: 410390 - protein, 11 aa, Influenza virus
EVERQIGNVIN

SEQ ID NO: 410391 - protein, 11 aa, Influenza virus
VERQIGNVINW

SEQ ID NO: 410392 - protein, 11 aa, Influenza virus
ERQIGNVINWT

SEQ ID NO: 410393 - protein, 11 aa, Influenza virus
RQIGNVINWTR

SEQ ID NO: 410394 - protein, 11 aa, Influenza virus
GNVINWTRDSV

SEQ ID NO: 410395 - protein, 11 aa, Influenza virus
NVINWTRDSVT

SEQ ID NO: 410396 - protein, 11 aa, Influenza virus
VINWTRDSVTE

SEQ ID NO: 410397 - protein, 11 aa, Influenza virus
INWTRDSITEV

SEQ ID NO: 410398 - protein, 11 aa, Influenza virus
WTRDSITEVWS

SEQ ID NO: 410399 - protein, 11 aa, Influenza virus
TRDSITEVWSY

SEQ ID NO: 410400 - protein, 11 aa, Influenza virus
RDSITEVWSYN

SEQ ID NO: 410401 - protein, 11 aa, Influenza virus
DSITEVWSYNA

SEQ ID NO: 410402 - protein, 11 aa, Influenza virus
SITEVWSYNAE

SEQ ID NO: 410403 - protein, 11 aa, Influenza virus
ITEVWSYNAEL

SEQ ID NO: 410404 - protein, 11 aa, Influenza virus
TELWSYNAELL

SEQ ID NO: 410405 - protein, 11 aa, Influenza virus
ELWSYNAELLV

SEQ ID NO: 410406 - protein, 11 aa, Influenza virus
LWSYNAELLVA

SEQ ID NO: 410407 - protein, 11 aa, Influenza virus
HTIDLADSEMS

SEQ ID NO: 410408 - protein, 11 aa, Influenza virus
TIDLADSEMNN

SEQ ID NO: 410409 - protein, 11 aa, Influenza virus
IDLANSEMNKL

SEQ ID NO: 410410 - protein, 11 aa, Influenza virus
DLADSEMSKLY

SEQ ID NO: 410411 - protein, 11 aa, Influenza virus
ADSEMSKLYER

SEQ ID NO: 410412 - protein, 11 aa, Influenza virus
NSEMNKLYERV

SEQ ID NO: 410413 - protein, 11 aa, Influenza virus
KLYERVKRQLR

SEQ ID NO: 410414 - protein, 11 aa, Influenza virus
LYERVKRQLRE

SEQ ID NO: 410415 - protein, 11 aa, Influenza virus
YERVKRQLREN

SEQ ID NO: 410416 - protein, 11 aa, Influenza virus
ERVKRQLRENA

SEQ ID NO: 410417 - protein, 11 aa, Influenza virus
RVKRQLRENAE

SEQ ID NO: 410418 - protein, 11 aa, Influenza virus
VKRQLRENAEE

SEQ ID NO: 410419 - protein, 11 aa, Influenza virus
KRQLRENAEED

SEQ ID NO: 410420 - protein, 11 aa, Influenza virus
CMASIRNSTYD

SEQ ID NO: 410421 - protein, 11 aa, Influenza virus
MASIRNSTYDH

SEQ ID NO: 410422 - protein, 11 aa, Influenza virus
ASIRNSTYDHS

SEQ ID NO: 410423 - protein, 11 aa, Influenza virus
QNRIRIDPVKL

SEQ ID NO: 410424 - protein, 11 aa, Influenza virus
SSGYKEVILWF

SEQ ID NO: 410425 - protein, 11 aa, Influenza virus
SGYKEVILWFS

SEQ ID NO: 410426 - protein, 11 aa, Influenza virus
GYKEVILWFSF

SEQ ID NO: 410427 - protein, 11 aa, Influenza virus
YKEVILWFSFG

SEQ ID NO: 410428 - protein, 11 aa, Influenza virus
KEVILWFSFGA

SEQ ID NO: 410429 - protein, 11 aa, Influenza virus
EVILWFSFGAS

SEQ ID NO: 410430 - protein, 11 aa, Influenza virus
WFSFGASCFLF

SEQ ID NO: 410431 - protein, 11 aa, Influenza virus
FSFGASCFLLI

SEQ ID NO: 410432 - protein, 11 aa, Influenza virus
SFGASCFLLIA

SEQ ID NO: 410433 - protein, 11 aa, Influenza virus
FGASCFLLIAI

SEQ ID NO: 410434 - protein, 11 aa, Influenza virus
FMCVKNGNMRC

SEQ ID NO: 410435 - protein, 11 aa, Influenza virus
MCVKNGNMRCT

SEQ ID NO: 410436 - protein, 11 aa, Influenza virus
CIKNGNMQCTI

SEQ ID NO: 410437 - protein, 11 aa, Influenza virus
VKNGNHAVHYC

SEQ ID NO: 410438 - protein, 11 aa, Influenza virus
GAVNTTLSTIA

SEQ ID NO: 410439 - protein, 11 aa, Influenza virus
AVNTTLSTIAL

SEQ ID NO: 410440 - protein, 11 aa, Influenza virus
VNTTLSTIALF

SEQ ID NO: 410441 - protein, 11 aa, Influenza virus
NTTLSTIALFI

SEQ ID NO: 410442 - protein, 11 aa, Influenza virus
TTLSTIALFIG

SEQ ID NO: 410443 - protein, 11 aa, Influenza virus
LSTIALIIGVG

SEQ ID NO: 410444 - protein, 11 aa, Influenza virus
STIALIIGVGN

SEQ ID NO: 410445 - protein, 11 aa, Influenza virus
TIALIIGVGNL

SEQ ID NO: 410446 - protein, 11 aa, Influenza virus
IGIGNLVFNTV

SEQ ID NO: 410447 - protein, 11 aa, Influenza virus
GIGNLVFNTVI

SEQ ID NO: 410448 - protein, 11 aa, Influenza virus
IGNLVFNTVIH

SEQ ID NO: 410449 - protein, 11 aa, Influenza virus
GNLIFNTVIHE

SEQ ID NO: 410450 - protein, 11 aa, Influenza virus
TYNNTVVNNIT

SEQ ID NO: 410451 - protein, 11 aa, Influenza virus
YNNTVVNNITT

SEQ ID NO: 410452 - protein, 11 aa, Influenza virus
NNTVVNNITTT

SEQ ID NO: 410453 - protein, 11 aa, Influenza virus
NTVVNNITTTI

SEQ ID NO: 410454 - protein, 11 aa, Influenza virus
TVVNNITTTII

SEQ ID NO: 410455 - protein, 11 aa, Influenza virus
SLPLCPFQGFF

SEQ ID NO: 410456 - protein, 11 aa, Influenza virus
LPLCPFKGFFP

SEQ ID NO: 410457 - protein, 11 aa, Influenza virus
PLCPFKGFFPF

SEQ ID NO: 410458 - protein, 11 aa, Influenza virus
LCPFKGFFPFH

SEQ ID NO: 410459 - protein, 11 aa, Influenza virus
CPFKGFFPFHK

SEQ ID NO: 410460 - protein, 11 aa, Influenza virus
PFKGFFPFHKD

SEQ ID NO: 410461 - protein, 11 aa, Influenza virus
FKGFFPFHKDN

SEQ ID NO: 410462 - protein, 11 aa, Influenza virus
KGFFPFHKDNA

SEQ ID NO: 410463 - protein, 11 aa, Influenza virus
FPFHKGNSARL

SEQ ID NO: 410464 - protein, 11 aa, Influenza virus
PFHKDNALRLA

SEQ ID NO: 410465 - protein, 11 aa, Influenza virus
FHKGNSARLIH

SEQ ID NO: 410466 - protein, 11 aa, Influenza virus
HKDNAIRPGEN

SEQ ID NO: 410467 - protein, 11 aa, Influenza virus
KDNAIRPGENK

SEQ ID NO: 410468 - protein, 11 aa, Influenza virus
VIITREPYVSC

SEQ ID NO: 410469 - protein, 11 aa, Influenza virus
IITREPYVSCD

SEQ ID NO: 410470 - protein, 11 aa, Influenza virus
VTREPYISCDN

SEQ ID NO: 410471 - protein, 11 aa, Influenza virus
HCWSFALAQGA

SEQ ID NO: 410472 - protein, 11 aa, Influenza virus
WSFALAQGVLL

SEQ ID NO: 410473 - protein, 11 aa, Influenza virus
SFALAQGVLLG

SEQ ID NO: 410474 - protein, 11 aa, Influenza virus
FALAQGVLLGT

SEQ ID NO: 410475 - protein, 11 aa, Influenza virus
ALAQGALLGTN

SEQ ID NO: 410476 - protein, 11 aa, Influenza virus
LAQGALLGTNH

SEQ ID NO: 410477 - protein, 11 aa, Influenza virus
AQGALVGTKHS

SEQ ID NO: 410478 - protein, 11 aa, Influenza virus
QGALLGTNHSN

SEQ ID NO: 410479 - protein, 11 aa, Influenza virus
GALLGTNHSNG

SEQ ID NO: 410480 - protein, 11 aa, Influenza virus
ALVGTKHSNGT

SEQ ID NO: 410481 - protein, 11 aa, Influenza virus
DRTSYRSLIRF

SEQ ID NO: 410482 - protein, 11 aa, Influenza virus
RTSYRSLIRFP

SEQ ID NO: 410483 - protein, 11 aa, Influenza virus
TPYRSLIQFPI

SEQ ID NO: 410484 - protein, 11 aa, Influenza virus
PYRSLIQFPIG

SEQ ID NO: 410485 - protein, 11 aa, Influenza virus
YRSLIQFPMGT

SEQ ID NO: 410486 - protein, 11 aa, Influenza virus
RSLIQFPMGTA

SEQ ID NO: 410487 - protein, 11 aa, Influenza virus
SLIQFPMGTAP

SEQ ID NO: 410488 - protein, 11 aa, Influenza virus
FPMGTAPVLGN

SEQ ID NO: 410489 - protein, 11 aa, Influenza virus
PMGTAPVLGNY

SEQ ID NO: 410490 - protein, 11 aa, Influenza virus
GTAPVLGNYRE

SEQ ID NO: 410491 - protein, 11 aa, Influenza virus
APILGNYKEIC

SEQ ID NO: 410492 - protein, 11 aa, Influenza virus
LGNYREICIAW

SEQ ID NO: 410493 - protein, 11 aa, Influenza virus
GNYREICIAWS

SEQ ID NO: 410494 - protein, 11 aa, Influenza virus
NYREICIAWSS

SEQ ID NO: 410495 - protein, 11 aa, Influenza virus
EICVAWSSTSC

SEQ ID NO: 410496 - protein, 11 aa, Influenza virus
ICVAWSSTSCF

SEQ ID NO: 410497 - protein, 11 aa, Influenza virus
CVAWSSTSCFD

SEQ ID NO: 410498 - protein, 11 aa, Influenza virus
VAWSSTSCFDG

SEQ ID NO: 410499 - protein, 11 aa, Influenza virus
CFDGKEWMHVS

SEQ ID NO: 410500 - protein, 11 aa, Influenza virus
FDGKEWLHVCI

SEQ ID NO: 410501 - protein, 11 aa, Influenza virus
DGKEWMHVCMA

SEQ ID NO: 410502 - protein, 11 aa, Influenza virus
GKEWLHVCITG

SEQ ID NO: 410503 - protein, 11 aa, Influenza virus
GKMRDSIKSWR

SEQ ID NO: 410504 - protein, 11 aa, Influenza virus
MRDSIKSWRNN

SEQ ID NO: 410505 - protein, 11 aa, Influenza virus
RDSIKSWRNNI

SEQ ID NO: 410506 - protein, 11 aa, Influenza virus
LRTQESECLCI

SEQ ID NO: 410507 - protein, 11 aa, Influenza virus
RTQESECQCIS

SEQ ID NO: 410508 - protein, 11 aa, Influenza virus
TQESECQCISG

SEQ ID NO: 410509 - protein, 11 aa, Influenza virus
GICVVAVTDGP

SEQ ID NO: 410510 - protein, 11 aa, Influenza virus
ICVVAVTDGPA

SEQ ID NO: 410511 - protein, 11 aa, Influenza virus
CIVAVTDGPAA

SEQ ID NO: 410512 - protein, 11 aa, Influenza virus
IVAVTDGPAAN

SEQ ID NO: 410513 - protein, 11 aa, Influenza virus
VTVTDGPAANS

SEQ ID NO: 410514 - protein, 11 aa, Influenza virus
TVTDGPAANSA

SEQ ID NO: 410515 - protein, 11 aa, Influenza virus
VTDGPADNKAD

SEQ ID NO: 410516 - protein, 11 aa, Influenza virus
TDGPADNKADH

SEQ ID NO: 410517 - protein, 11 aa, Influenza virus
DGPAANSAHHR

SEQ ID NO: 410518 - protein, 11 aa, Influenza virus
GPAANNADHRI

SEQ ID NO: 410519 - protein, 11 aa, Influenza virus
PAANNADHRIY

SEQ ID NO: 410520 - protein, 11 aa, Influenza virus
AANNADHRIYW

SEQ ID NO: 410521 - protein, 11 aa, Influenza virus
ANNADHRIYWI

SEQ ID NO: 410522 - protein, 11 aa, Influenza virus
NNADHRIYWIR

SEQ ID NO: 410523 - protein, 11 aa, Influenza virus
NADHRIYWIRK

SEQ ID NO: 410524 - protein, 11 aa, Influenza virus
ADHRIYWIRKG

SEQ ID NO: 410525 - protein, 11 aa, Influenza virus
RIQHLEECSCY

SEQ ID NO: 410526 - protein, 11 aa, Influenza virus
IQHLEECSCYM

SEQ ID NO: 410527 - protein, 11 aa, Influenza virus
QHLEECSCYMD

SEQ ID NO: 410528 - protein, 11 aa, Influenza virus
HLEECSCYVDV

SEQ ID NO: 410529 - protein, 11 aa, Influenza virus
LEECSCYVDTD

SEQ ID NO: 410530 - protein, 11 aa, Influenza virus
EECSCYMDIDV

SEQ ID NO: 410531 - protein, 11 aa, Influenza virus
ECSCYMDIDVY

SEQ ID NO: 410532 - protein, 11 aa, Influenza virus
CSCYMDIDVYC

SEQ ID NO: 410533 - protein, 11 aa, Influenza virus
DIDVYCVCRDN

SEQ ID NO: 410534 - protein, 11 aa, Influenza virus
IDVYCVCRDNW

SEQ ID NO: 410535 - protein, 11 aa, Influenza virus
DVYCVCRDNWK

SEQ ID NO: 410536 - protein, 11 aa, Influenza virus
VYCVCRDNWKG

SEQ ID NO: 410537 - protein, 11 aa, Influenza virus
DNWKGSNRPWV

SEQ ID NO: 410538 - protein, 11 aa, Influenza virus
NWKGSNRPWVR

SEQ ID NO: 410539 - protein, 11 aa, Influenza virus
WKGSNRPWVRM

SEQ ID NO: 410540 - protein, 11 aa, Influenza virus
KGSNRPWMRIS

SEQ ID NO: 410541 - protein, 11 aa, Influenza virus
GSNRPWMRISN

SEQ ID NO: 410542 - protein, 11 aa, Influenza virus
SNRPWMRISNE

SEQ ID NO: 410543 - protein, 11 aa, Influenza virus
NRPWMRISNET

SEQ ID NO: 410544 - protein, 11 aa, Influenza virus
RPWMRISNETI

SEQ ID NO: 410545 - protein, 11 aa, Influenza virus
PWMRISNETIL

SEQ ID NO: 410546 - protein, 11 aa, Influenza virus
WMRISNETILE

SEQ ID NO: 410547 - protein, 11 aa, Influenza virus
MRISNETILET

SEQ ID NO: 410548 - protein, 11 aa, Influenza virus
RINNETILETR

SEQ ID NO: 410549 - protein, 11 aa, Influenza virus
INNETIVETGY

SEQ ID NO: 410550 - protein, 11 aa, Influenza virus
NNETILETRYV

SEQ ID NO: 410551 - protein, 11 aa, Influenza virus
NETIVETGYVC

SEQ ID NO: 410552 - protein, 11 aa, Influenza virus
ETIVETGYVCS

SEQ ID NO: 410553 - protein, 11 aa, Influenza virus
TILETGYICSK

SEQ ID NO: 410554 - protein, 11 aa, Influenza virus
ILETRYVCSKF

SEQ ID NO: 410555 - protein, 11 aa, Influenza virus
VETGYVCSKFH

SEQ ID NO: 410556 - protein, 11 aa, Influenza virus
SKFHSDTPRPV

SEQ ID NO: 410557 - protein, 11 aa, Influenza virus
KFHSDTPRPTD

SEQ ID NO: 410558 - protein, 11 aa, Influenza virus
FHSDTPRPTDP

SEQ ID NO: 410559 - protein, 11 aa, Influenza virus
HSDTPRPTDPS

SEQ ID NO: 410560 - protein, 11 aa, Influenza virus
DPSTISCDSPS

SEQ ID NO: 410561 - protein, 11 aa, Influenza virus
PSTISCDSPSN

SEQ ID NO: 410562 - protein, 11 aa, Influenza virus
SCDSPSNINGE

SEQ ID NO: 410563 - protein, 11 aa, Influenza virus
NGEPGVKGFGF

SEQ ID NO: 410564 - protein, 11 aa, Influenza virus
GEPGVKGFGFK

SEQ ID NO: 410565 - protein, 11 aa, Influenza virus
GSDVWLGRTVS

SEQ ID NO: 410566 - protein, 11 aa, Influenza virus
DDVWLGRTVST

SEQ ID NO: 410567 - protein, 11 aa, Influenza virus
DVWLGRTVSIN

SEQ ID NO: 410568 - protein, 11 aa, Influenza virus
VWLGRTVSING

SEQ ID NO: 410569 - protein, 11 aa, Influenza virus
WLGRTVSINGR

SEQ ID NO: 410570 - protein, 11 aa, Influenza virus
LGRTVSINGRS

SEQ ID NO: 410571 - protein, 11 aa, Influenza virus
EGWINSPSQAK

SEQ ID NO: 410572 - protein, 11 aa, Influenza virus
GWINSPSQAKS

SEQ ID NO: 410573 - protein, 11 aa, Influenza virus
VKSITQTLVSN

SEQ ID NO: 410574 - protein, 11 aa, Influenza virus
KSITQTLVSND

SEQ ID NO: 410575 - protein, 11 aa, Influenza virus
AATQTLVSNND

SEQ ID NO: 410576 - protein, 11 aa, Influenza virus
ITQTLVSNSDW

SEQ ID NO: 410577 - protein, 11 aa, Influenza virus
SDWSGYSGSFI

SEQ ID NO: 410578 - protein, 11 aa, Influenza virus
DWSGYSGSFTV

SEQ ID NO: 410579 - protein, 11 aa, Influenza virus
GCFQPCFYVEL

SEQ ID NO: 410580 - protein, 11 aa, Influenza virus
CFQSCFYVELI

SEQ ID NO: 410581 - protein, 11 aa, Influenza virus
FQSCFYVELIR

SEQ ID NO: 410582 - protein, 11 aa, Influenza virus
QPCFYVELTRG

SEQ ID NO: 410583 - protein, 11 aa, Influenza virus
PCFYIELIRGK

SEQ ID NO: 410584 - protein, 11 aa, Influenza virus
CFYIELIRGKP

SEQ ID NO: 410585 - protein, 11 aa, Influenza virus
FYIELIRGKPN

SEQ ID NO: 410586 - protein, 11 aa, Influenza virus
DEVSWTSNSIV

SEQ ID NO: 410587 - protein, 11 aa, Influenza virus
EVSWTSNSIVT

SEQ ID NO: 410588 - protein, 11 aa, Influenza virus
CGLDNEPGSGH

SEQ ID NO: 410589 - protein, 11 aa, Influenza virus
GLDNEPGSGHW

SEQ ID NO: 410590 - protein, 11 aa, Influenza virus
PGSGHWPDGSN

SEQ ID NO: 410591 - protein, 11 aa, Influenza virus
GSGNWPDGANI

SEQ ID NO: 410592 - protein, 11 aa, Influenza virus
SGHWPDGSNIG

SEQ ID NO: 410593 - protein, 11 aa, Influenza virus
GHWPDGSNIGF

SEQ ID NO: 410594 - protein, 11 aa, Influenza virus
HWPDGSNIGFM

SEQ ID NO: 410595 - protein, 11 aa, Influenza virus
SKSRGYKMNIQ

SEQ ID NO: 410596 - protein, 11 aa, Influenza virus
KSRGYKMNTKI

SEQ ID NO: 410597 - protein, 11 aa, Influenza virus
SRGYKMNIQIL

SEQ ID NO: 410598 - protein, 11 aa, Influenza virus
RGYKMNIQILI

SEQ ID NO: 410599 - protein, 11 aa, Influenza virus
GYKMNTQILIF

SEQ ID NO: 410600 - protein, 11 aa, Influenza virus
YKMNTQILIFA

SEQ ID NO: 410601 - protein, 11 aa, Influenza virus
KMNTQILIFAL

SEQ ID NO: 410602 - protein, 11 aa, Influenza virus
ADKICLGRHAV

SEQ ID NO: 410603 - protein, 11 aa, Influenza virus
NGTKVNTLTEK

SEQ ID NO: 410604 - protein, 11 aa, Influenza virus
KVNTLTERGIE

SEQ ID NO: 410605 - protein, 11 aa, Influenza virus
VNTLTERGIEV

SEQ ID NO: 410606 - protein, 11 aa, Influenza virus
NTLTERGIEVV

SEQ ID NO: 410607 - protein, 11 aa, Influenza virus
TLTERGIEVVN

SEQ ID NO: 410608 - protein, 11 aa, Influenza virus
LTERGIEVVNA

SEQ ID NO: 410609 - protein, 11 aa, Influenza virus
TERGIEVVNAT

SEQ ID NO: 410610 - protein, 11 aa, Influenza virus
ERGIEVVNATE

SEQ ID NO: 410611 - protein, 11 aa, Influenza virus
RGIEVVNATET

SEQ ID NO: 410612 - protein, 11 aa, Influenza virus
EVEVVNATETV

SEQ ID NO: 410613 - protein, 11 aa, Influenza virus
EVVNATETVET

SEQ ID NO: 410614 - protein, 11 aa, Influenza virus
TGPPQCDLFLE

SEQ ID NO: 410615 - protein, 11 aa, Influenza virus
GFTYSGIRTDG

SEQ ID NO: 410616 - protein, 11 aa, Influenza virus
RSESSFYAEME

SEQ ID NO: 410617 - protein, 11 aa, Influenza virus
SGPSFYAEMKW

SEQ ID NO: 410618 - protein, 11 aa, Influenza virus
GPSFYAEMKWL

SEQ ID NO: 410619 - protein, 11 aa, Influenza virus
PSFYAEMKWLL

SEQ ID NO: 410620 - protein, 11 aa, Influenza virus
FYAEMEWLLSN

SEQ ID NO: 410621 - protein, 11 aa, Influenza virus
RPQMNGQSGRI

SEQ ID NO: 410622 - protein, 11 aa, Influenza virus
PQMNGQSGRID

SEQ ID NO: 410623 - protein, 11 aa, Influenza virus
QMNGQSGRIDF

SEQ ID NO: 410624 - protein, 11 aa, Influenza virus
MNGQSGRIDFH

SEQ ID NO: 410625 - protein, 11 aa, Influenza virus
GQSGRIDFHWM

SEQ ID NO: 410626 - protein, 11 aa, Influenza virus
NDTITFSFNGA

SEQ ID NO: 410627 - protein, 11 aa, Influenza virus
DTITFSFNGAF

SEQ ID NO: 410628 - protein, 11 aa, Influenza virus
TFSFNGAFVAP

SEQ ID NO: 410629 - protein, 11 aa, Influenza virus
FNGAFIAPNRA

SEQ ID NO: 410630 - protein, 11 aa, Influenza virus
NGAFIAPNRAS

SEQ ID NO: 410631 - protein, 11 aa, Influenza virus
GAFIAPNRASF

SEQ ID NO: 410632 - protein, 11 aa, Influenza virus
SLLLATGMRNV

SEQ ID NO: 410633 - protein, 11 aa, Influenza virus
LLLATGMRNVP

SEQ ID NO: 410634 - protein, 11 aa, Influenza virus
LLATGMRNVPE

SEQ ID NO: 410635 - protein, 11 aa, Influenza virus
IHKQLTHHMRK

SEQ ID NO: 410636 - protein, 11 aa, Influenza virus
KKKKKRGLFGA

SEQ ID NO: 410637 - protein, 11 aa, Influenza virus
KRKKRGLFGAI

SEQ ID NO: 410638 - protein, 11 aa, Influenza virus
RKRGLFGAIAG

SEQ ID NO: 410639 - protein, 11 aa, Influenza virus
WEGLIDGWYGY

SEQ ID NO: 410640 - protein, 11 aa, Influenza virus
EGLIDGWYGYR

SEQ ID NO: 410641 - protein, 11 aa, Influenza virus
GLIDGWYGYRH

SEQ ID NO: 410642 - protein, 11 aa, Influenza virus
LIDGWYGYRHQ

SEQ ID NO: 410643 - protein, 11 aa, Influenza virus
IDGWYGYRHQN

SEQ ID NO: 410644 - protein, 11 aa, Influenza virus
DGWYGFRHQNS

SEQ ID NO: 410645 - protein, 11 aa, Influenza virus
GWYGYKHQNAQ

SEQ ID NO: 410646 - protein, 11 aa, Influenza virus
WYGFRHQNSQG

SEQ ID NO: 410647 - protein, 11 aa, Influenza virus
YGYKHQNAQGE

SEQ ID NO: 410648 - protein, 11 aa, Influenza virus
GYKHQNAQGEG

SEQ ID NO: 410649 - protein, 11 aa, Influenza virus
RHQNSQGEGTA

SEQ ID NO: 410650 - protein, 11 aa, Influenza virus
HQNAQGEGIAA

SEQ ID NO: 410651 - protein, 11 aa, Influenza virus
QNAQGEGIAAD

SEQ ID NO: 410652 - protein, 11 aa, Influenza virus
KAQGEGTAADY

SEQ ID NO: 410653 - protein, 11 aa, Influenza virus
ADYKSTQSAVN

SEQ ID NO: 410654 - protein, 11 aa, Influenza virus
DYKSTQAAIDQ

SEQ ID NO: 410655 - protein, 11 aa, Influenza virus
YKSTQSAVNQI

SEQ ID NO: 410656 - protein, 11 aa, Influenza virus
KSTQSAVNQIT

SEQ ID NO: 410657 - protein, 11 aa, Influenza virus
STQSAIDQITR

SEQ ID NO: 410658 - protein, 11 aa, Influenza virus
TQSAIDQITGT

SEQ ID NO: 410659 - protein, 11 aa, Influenza virus
QAAIDQITGKL

SEQ ID NO: 410660 - protein, 11 aa, Influenza virus
SAIDQITRKLN

SEQ ID NO: 410661 - protein, 11 aa, Influenza virus
AIDQITRKLNR

SEQ ID NO: 410662 - protein, 11 aa, Influenza virus
IDQITRKLNRL

SEQ ID NO: 410663 - protein, 11 aa, Influenza virus
DQITRKLNRLI

SEQ ID NO: 410664 - protein, 11 aa, Influenza virus
QITGTLNRLID

SEQ ID NO: 410665 - protein, 11 aa, Influenza virus
ITGKLNRLIER

SEQ ID NO: 410666 - protein, 11 aa, Influenza virus
TGKLNRLIERT

SEQ ID NO: 410667 - protein, 11 aa, Influenza virus
GKLNRLIERTN

SEQ ID NO: 410668 - protein, 11 aa, Influenza virus
KLNRLIERTNQ

SEQ ID NO: 410669 - protein, 11 aa, Influenza virus
LNRLIERTNQQ

SEQ ID NO: 410670 - protein, 11 aa, Influenza virus
NRLIERTNQQF

SEQ ID NO: 410671 - protein, 11 aa, Influenza virus
RLIERTNQQFE

SEQ ID NO: 410672 - protein, 11 aa, Influenza virus
LIERTNQQFEL

SEQ ID NO: 410673 - protein, 11 aa, Influenza virus
IERTNQQFELI

SEQ ID NO: 410674 - protein, 11 aa, Influenza virus
ERTNQQFELID

SEQ ID NO: 410675 - protein, 11 aa, Influenza virus
KTNQQFEMIDN

SEQ ID NO: 410676 - protein, 11 aa, Influenza virus
TNQQFELIDNK

SEQ ID NO: 410677 - protein, 11 aa, Influenza virus
NQQFELIDNKF

SEQ ID NO: 410678 - protein, 11 aa, Influenza virus
QQFELIDNEFS

SEQ ID NO: 410679 - protein, 11 aa, Influenza virus
QFELIDNEFSE

SEQ ID NO: 410680 - protein, 11 aa, Influenza virus
EIEQQIGNVIN

SEQ ID NO: 410681 - protein, 11 aa, Influenza virus
IEQQIGNVINW

SEQ ID NO: 410682 - protein, 11 aa, Influenza virus
ERQIGNVINWT

SEQ ID NO: 410683 - protein, 11 aa, Influenza virus
RQIGNVINWTR

SEQ ID NO: 410684 - protein, 11 aa, Influenza virus
GNVINWTRDSL

SEQ ID NO: 410685 - protein, 11 aa, Influenza virus
NVINWTRDSII

SEQ ID NO: 410686 - protein, 11 aa, Influenza virus
VINWTRDSIIE

SEQ ID NO: 410687 - protein, 11 aa, Influenza virus
IEIWSYNAEFL

SEQ ID NO: 410688 - protein, 11 aa, Influenza virus
WSYNAELLIAM

SEQ ID NO: 410689 - protein, 11 aa, Influenza virus
SYNAELLIAME

SEQ ID NO: 410690 - protein, 11 aa, Influenza virus
YNADLLVAMEN

SEQ ID NO: 410691 - protein, 11 aa, Influenza virus
NAELLIAMENQ

SEQ ID NO: 410692 - protein, 11 aa, Influenza virus
AELLIAMENQH

SEQ ID NO: 410693 - protein, 11 aa, Influenza virus
DLLVAMENQHT

SEQ ID NO: 410694 - protein, 11 aa, Influenza virus
LLIAMENQHTI

SEQ ID NO: 410695 - protein, 11 aa, Influenza virus
LIAMENQHTID

SEQ ID NO: 410696 - protein, 11 aa, Influenza virus
IAMENQHTIDL

SEQ ID NO: 410697 - protein, 11 aa, Influenza virus
AMENQHTIDLT

SEQ ID NO: 410698 - protein, 11 aa, Influenza virus
ENQHTIDSTDS

SEQ ID NO: 410699 - protein, 11 aa, Influenza virus
NQHTIDLAESE

SEQ ID NO: 410700 - protein, 11 aa, Influenza virus
QHTIDLAESEM

SEQ ID NO: 410701 - protein, 11 aa, Influenza virus
HTIDLTNSEMN

SEQ ID NO: 410702 - protein, 11 aa, Influenza virus
TIDLAESEMNK

SEQ ID NO: 410703 - protein, 11 aa, Influenza virus
IDLTNSEMNKL

SEQ ID NO: 410704 - protein, 11 aa, Influenza virus
DLTNSEMNKLY

SEQ ID NO: 410705 - protein, 11 aa, Influenza virus
LTNSEMNKLYE

SEQ ID NO: 410706 - protein, 11 aa, Influenza virus
TDSEMNKLYER

SEQ ID NO: 410707 - protein, 11 aa, Influenza virus
ESEMNKLYERV

SEQ ID NO: 410708 - protein, 11 aa, Influenza virus
SEMNKLYEKVR

SEQ ID NO: 410709 - protein, 11 aa, Influenza virus
EMNKLYEKVRR

SEQ ID NO: 410710 - protein, 11 aa, Influenza virus
MNKLYEKVRRQ

SEQ ID NO: 410711 - protein, 11 aa, Influenza virus
NKLYEKVRRQL

SEQ ID NO: 410712 - protein, 11 aa, Influenza virus
KLYEKVRRQLR

SEQ ID NO: 410713 - protein, 11 aa, Influenza virus
LYEKVRRQLRE

SEQ ID NO: 410714 - protein, 11 aa, Influenza virus
YEKVRRQLREN

SEQ ID NO: 410715 - protein, 11 aa, Influenza virus
EKVRRQLRENA

SEQ ID NO: 410716 - protein, 11 aa, Influenza virus
KVRRQLRENAE

SEQ ID NO: 410717 - protein, 11 aa, Influenza virus
VRKQLRENAEE

SEQ ID NO: 410718 - protein, 11 aa, Influenza virus
RKQLRENAEED

SEQ ID NO: 410719 - protein, 11 aa, Influenza virus
RQLRENAEEDC

SEQ ID NO: 410720 - protein, 11 aa, Influenza virus
QLRENAEEDCT

SEQ ID NO: 410721 - protein, 11 aa, Influenza virus
LRENAEEDCTG

SEQ ID NO: 410722 - protein, 11 aa, Influenza virus
RENAEEDCTGC

SEQ ID NO: 410723 - protein, 11 aa, Influenza virus
ENAEEDCTGCF

SEQ ID NO: 410724 - protein, 11 aa, Influenza virus
NAEEDCTGCFE

SEQ ID NO: 410725 - protein, 11 aa, Influenza virus
AEEDCTGCFEI

SEQ ID NO: 410726 - protein, 11 aa, Influenza virus
EEDCTGCFEIF

SEQ ID NO: 410727 - protein, 11 aa, Influenza virus
EDCTGCFEIFH

SEQ ID NO: 410728 - protein, 11 aa, Influenza virus
DCTGCFEIFHK

SEQ ID NO: 410729 - protein, 11 aa, Influenza virus
CTGCFEIFHKC

SEQ ID NO: 410730 - protein, 11 aa, Influenza virus
TGCFELFHKCD

SEQ ID NO: 410731 - protein, 11 aa, Influenza virus
GCFELFHKCDD

SEQ ID NO: 410732 - protein, 11 aa, Influenza virus
CFEIFHKCDDQ

SEQ ID NO: 410733 - protein, 11 aa, Influenza virus
FEIFHKCDDQC

SEQ ID NO: 410734 - protein, 11 aa, Influenza virus
EIFHKCDDQCM

SEQ ID NO: 410735 - protein, 11 aa, Influenza virus
CMANIRNNTYD

SEQ ID NO: 410736 - protein, 11 aa, Influenza virus
MASIRNNSYDH

SEQ ID NO: 410737 - protein, 11 aa, Influenza virus
IRNNTYDHTQY

SEQ ID NO: 410738 - protein, 11 aa, Influenza virus
RNNTYDHTQYR

SEQ ID NO: 410739 - protein, 11 aa, Influenza virus
INPVKLSSGYK

SEQ ID NO: 410740 - protein, 11 aa, Influenza virus
VKLSGGYKDVI

SEQ ID NO: 410741 - protein, 11 aa, Influenza virus
LSSGYKEVILW

SEQ ID NO: 410742 - protein, 11 aa, Influenza virus
SGGYKDVILWF

SEQ ID NO: 410743 - protein, 11 aa, Influenza virus
SGYKEVILWFS

SEQ ID NO: 410744 - protein, 11 aa, Influenza virus
GYKEVILWFSF

SEQ ID NO: 410745 - protein, 11 aa, Influenza virus
YKEVILWFSFG

SEQ ID NO: 410746 - protein, 11 aa, Influenza virus
KDVILWFSLGA

SEQ ID NO: 410747 - protein, 11 aa, Influenza virus
DVILWFSLGAS

SEQ ID NO: 410748 - protein, 11 aa, Influenza virus
VILWFSLGASC

SEQ ID NO: 410749 - protein, 11 aa, Influenza virus
LWFSLGASCFL

SEQ ID NO: 410750 - protein, 11 aa, Influenza virus
WFSFGASCFLF

SEQ ID NO: 410751 - protein, 11 aa, Influenza virus
LVFICIKNGNM

SEQ ID NO: 410752 - protein, 11 aa, Influenza virus
FICIKNGNMRC

SEQ ID NO: 410753 - protein, 11 aa, Influenza virus
ICIKNGNMRCT

SEQ ID NO: 410754 - protein, 11 aa, Influenza virus
CVKNGNMQCTI

SEQ ID NO: 410755 - protein, 11 aa, Influenza virus
VKNGNMQCTIC

SEQ ID NO: 410756 - protein, 11 aa, Influenza virus
KNGNMRGTNWI

SEQ ID NO: 410757 - protein, 11 aa, Influenza virus
MNPSQKLFALS

SEQ ID NO: 410758 - protein, 11 aa, Influenza virus
NPSQKLFALSG

SEQ ID NO: 410759 - protein, 11 aa, Influenza virus
PSQKLFALSGV

SEQ ID NO: 410760 - protein, 11 aa, Influenza virus
SQKLFALSGVA

SEQ ID NO: 410761 - protein, 11 aa, Influenza virus
QKLFTLSGVAI

SEQ ID NO: 410762 - protein, 11 aa, Influenza virus
KLFASSGIAIA

SEQ ID NO: 410763 - protein, 11 aa, Influenza virus
LFASSGIAIAL

SEQ ID NO: 410764 - protein, 11 aa, Influenza virus
FASSGIAIALG

SEQ ID NO: 410765 - protein, 11 aa, Influenza virus
ASSGIAIVLGI

SEQ ID NO: 410766 - protein, 11 aa, Influenza virus
SSGIAIVLGII

SEQ ID NO: 410767 - protein, 11 aa, Influenza virus
SGIAIVLGIIN

SEQ ID NO: 410768 - protein, 11 aa, Influenza virus
GIAIVLGIINL

SEQ ID NO: 410769 - protein, 11 aa, Influenza virus
IAIVLGIINLL

SEQ ID NO: 410770 - protein, 11 aa, Influenza virus
AIVLGIINLLI

SEQ ID NO: 410771 - protein, 11 aa, Influenza virus
IVLGIINLLIG

SEQ ID NO: 410772 - protein, 11 aa, Influenza virus
VLGIINLLIGI

SEQ ID NO: 410773 - protein, 11 aa, Influenza virus
LGIINLLIGIS

SEQ ID NO: 410774 - protein, 11 aa, Influenza virus
GIINLLIGISN

SEQ ID NO: 410775 - protein, 11 aa, Influenza virus
IINLLIGISNM

SEQ ID NO: 410776 - protein, 11 aa, Influenza virus
LNLLIGVSNVG

SEQ ID NO: 410777 - protein, 11 aa, Influenza virus
NLLIGVSNVGL

SEQ ID NO: 410778 - protein, 11 aa, Influenza virus
LLIGVSNVGLN

SEQ ID NO: 410779 - protein, 11 aa, Influenza virus
SNVVLNVSLHL

SEQ ID NO: 410780 - protein, 11 aa, Influenza virus
KNTYVNNTTII

SEQ ID NO: 410781 - protein, 11 aa, Influenza virus
GYLLLNKSLCN

SEQ ID NO: 410782 - protein, 11 aa, Influenza virus
YLLLNKSLCSV

SEQ ID NO: 410783 - protein, 11 aa, Influenza virus
LLLNKSLCSVE

SEQ ID NO: 410784 - protein, 11 aa, Influenza virus
LLNKSLCSVEG

SEQ ID NO: 410785 - protein, 11 aa, Influenza virus
LNKSLCSVEGW

SEQ ID NO: 410786 - protein, 11 aa, Influenza virus
NKSLCSVEGWV

SEQ ID NO: 410787 - protein, 11 aa, Influenza virus
KSLCSVEGWVV

SEQ ID NO: 410788 - protein, 11 aa, Influenza virus
SLCNVEGWVVV

SEQ ID NO: 410789 - protein, 11 aa, Influenza virus
VEGWVVIEKDN

SEQ ID NO: 410790 - protein, 11 aa, Influenza virus
EGWVVIAQDNA

SEQ ID NO: 410791 - protein, 11 aa, Influenza virus
GWVVIAKDNAI

SEQ ID NO: 410792 - protein, 11 aa, Influenza virus
WVVIAKDNAIR

SEQ ID NO: 410793 - protein, 11 aa, Influenza virus
VVIAKDNAIRF

SEQ ID NO: 410794 - protein, 11 aa, Influenza virus
VIAKDNAIRFG

SEQ ID NO: 410795 - protein, 11 aa, Influenza virus
IAKDNAIRFGE

SEQ ID NO: 410796 - protein, 11 aa, Influenza virus
EKDNAVRFGES

SEQ ID NO: 410797 - protein, 11 aa, Influenza virus
QDNAIRFGESE

SEQ ID NO: 410798 - protein, 11 aa, Influenza virus
NAIRFGESEQV

SEQ ID NO: 410799 - protein, 11 aa, Influenza virus
AIRFGESEQVI

SEQ ID NO: 410800 - protein, 11 aa, Influenza virus
IRFGESEQVIV

SEQ ID NO: 410801 - protein, 11 aa, Influenza virus
RFGESEQIVVT

SEQ ID NO: 410802 - protein, 11 aa, Influenza virus
FGESEQIVVTR

SEQ ID NO: 410803 - protein, 11 aa, Influenza virus
GESEQIVVTRE

SEQ ID NO: 410804 - protein, 11 aa, Influenza virus
ESEQIVVTREP

SEQ ID NO: 410805 - protein, 11 aa, Influenza virus
SEQIVVTREPY

SEQ ID NO: 410806 - protein, 11 aa, Influenza virus
EQIVVTREPYV

SEQ ID NO: 410807 - protein, 11 aa, Influenza virus
QIVVTREPYVS

SEQ ID NO: 410808 - protein, 11 aa, Influenza virus
IVVTREPYVSC

SEQ ID NO: 410809 - protein, 11 aa, Influenza virus
TREPYVSCDPS

SEQ ID NO: 410810 - protein, 11 aa, Influenza virus
GCRMYALHQGT

SEQ ID NO: 410811 - protein, 11 aa, Influenza virus
TIRNKHSNGTT

SEQ ID NO: 410812 - protein, 11 aa, Influenza virus
IRNKHSNGTTH

SEQ ID NO: 410813 - protein, 11 aa, Influenza virus
RNKHSNGTTHD

SEQ ID NO: 410814 - protein, 11 aa, Influenza virus
NKHSNGTTHDR

SEQ ID NO: 410815 - protein, 11 aa, Influenza virus
KHSNGTTHDRT

SEQ ID NO: 410816 - protein, 11 aa, Influenza virus
HSNGTTHDRTA

SEQ ID NO: 410817 - protein, 11 aa, Influenza virus
SNGTTHDRTAF

SEQ ID NO: 410818 - protein, 11 aa, Influenza virus
NGTTHDRTAFR

SEQ ID NO: 410819 - protein, 11 aa, Influenza virus
GTTHDRTAFRG

SEQ ID NO: 410820 - protein, 11 aa, Influenza virus
TIHDRTTFRGL

SEQ ID NO: 410821 - protein, 11 aa, Influenza virus
HDRTTFRGLLS

SEQ ID NO: 410822 - protein, 11 aa, Influenza virus
DRTAFRGLMST

SEQ ID NO: 410823 - protein, 11 aa, Influenza virus
SNSDFLCVGWS

SEQ ID NO: 410824 - protein, 11 aa, Influenza virus
NSDFICVGWSS

SEQ ID NO: 410825 - protein, 11 aa, Influenza virus
SDFICVGWSST

SEQ ID NO: 410826 - protein, 11 aa, Influenza virus
EFICVGWSSTS

SEQ ID NO: 410827 - protein, 11 aa, Influenza virus
FLCVGWSSTSC

SEQ ID NO: 410828 - protein, 11 aa, Influenza virus
LCVGWSSTSCH

SEQ ID NO: 410829 - protein, 11 aa, Influenza virus
GWSSTSCHDGV

SEQ ID NO: 410830 - protein, 11 aa, Influenza virus
CHDGVNRMTIC

SEQ ID NO: 410831 - protein, 11 aa, Influenza virus
QGNNNNATATV

SEQ ID NO: 410832 - protein, 11 aa, Influenza virus
GNNNNATATVY

SEQ ID NO: 410833 - protein, 11 aa, Influenza virus
NNNNATATVYY

SEQ ID NO: 410834 - protein, 11 aa, Influenza virus
NDNATATVYYD

SEQ ID NO: 410835 - protein, 11 aa, Influenza virus
NATATVYYNKR

SEQ ID NO: 410836 - protein, 11 aa, Influenza virus
ATATVYYNKRL

SEQ ID NO: 410837 - protein, 11 aa, Influenza virus
TATVYYNKRLT

SEQ ID NO: 410838 - protein, 11 aa, Influenza virus
ATVYYNKRLTT

SEQ ID NO: 410839 - protein, 11 aa, Influenza virus
TVYYNKRLTTT

SEQ ID NO: 410840 - protein, 11 aa, Influenza virus
VYYNKRLTTTI

SEQ ID NO: 410841 - protein, 11 aa, Influenza virus
GRLTTTIKTWA

SEQ ID NO: 410842 - protein, 11 aa, Influenza virus
RLTTTIKTWAG

SEQ ID NO: 410843 - protein, 11 aa, Influenza virus
LTTTIKTWAGN

SEQ ID NO: 410844 - protein, 11 aa, Influenza virus
TTTIKTWAGNI

SEQ ID NO: 410845 - protein, 11 aa, Influenza virus
TTIKTWAGNIL

SEQ ID NO: 410846 - protein, 11 aa, Influenza virus
TIKTWAGNILR

SEQ ID NO: 410847 - protein, 11 aa, Influenza virus
IKTWAGNILRT

SEQ ID NO: 410848 - protein, 11 aa, Influenza virus
KTWAGNILRTQ

SEQ ID NO: 410849 - protein, 11 aa, Influenza virus
TWAGNILRTQE

SEQ ID NO: 410850 - protein, 11 aa, Influenza virus
WAGNILRTQES

SEQ ID NO: 410851 - protein, 11 aa, Influenza virus
AGNILRTQESE

SEQ ID NO: 410852 - protein, 11 aa, Influenza virus
GNILRTQESEC

SEQ ID NO: 410853 - protein, 11 aa, Influenza virus
ILRTQESECVR

SEQ ID NO: 410854 - protein, 11 aa, Influenza virus
LRTQDSECVSH

SEQ ID NO: 410855 - protein, 11 aa, Influenza virus
RTQDSECVSHN

SEQ ID NO: 410856 - protein, 11 aa, Influenza virus
TQDSECVSHNG

SEQ ID NO: 410857 - protein, 11 aa, Influenza virus
QESECVRHNGT

SEQ ID NO: 410858 - protein, 11 aa, Influenza virus
ESECVRHNGTC

SEQ ID NO: 410859 - protein, 11 aa, Influenza virus
SECVCHNSTCV

SEQ ID NO: 410860 - protein, 11 aa, Influenza virus
ECVCHNSTCVV

SEQ ID NO: 410861 - protein, 11 aa, Influenza virus
HNGTCVVIMTD

SEQ ID NO: 410862 - protein, 11 aa, Influenza virus
NGTCVVIMTDG

SEQ ID NO: 410863 - protein, 11 aa, Influenza virus
LRGSARHIEEC

SEQ ID NO: 410864 - protein, 11 aa, Influenza virus
RGSARHIEECS

SEQ ID NO: 410865 - protein, 11 aa, Influenza virus
GSARHIEEWSC

SEQ ID NO: 410866 - protein, 11 aa, Influenza virus
SARHIEEWSCY

SEQ ID NO: 410867 - protein, 11 aa, Influenza virus
ARHIEEWSCYG

SEQ ID NO: 410868 - protein, 11 aa, Influenza virus
RHIEEWSCYGH

SEQ ID NO: 410869 - protein, 11 aa, Influenza virus
HIEECSCYGHD

SEQ ID NO: 410870 - protein, 11 aa, Influenza virus
ITCVCRDNWQG

SEQ ID NO: 410871 - protein, 11 aa, Influenza virus
TCGCRDNWQGA

SEQ ID NO: 410872 - protein, 11 aa, Influenza virus
ANRPIIEIDMT

SEQ ID NO: 410873 - protein, 11 aa, Influenza virus
MEHTSQYLCTG

SEQ ID NO: 410874 - protein, 11 aa, Influenza virus
YICTGVLTDTS

SEQ ID NO: 410875 - protein, 11 aa, Influenza virus
ICTGVLTDTSR

SEQ ID NO: 410876 - protein, 11 aa, Influenza virus
TGVLTDTSRPK

SEQ ID NO: 410877 - protein, 11 aa, Influenza virus
GVLTDTSRPKD

SEQ ID NO: 410878 - protein, 11 aa, Influenza virus
VLTDTSRPKDK

SEQ ID NO: 410879 - protein, 11 aa, Influenza virus
GECFNPITGSP

SEQ ID NO: 410880 - protein, 11 aa, Influenza virus
ECFNPITGSPG

SEQ ID NO: 410881 - protein, 11 aa, Influenza virus
NPITGSPCAPG

SEQ ID NO: 410882 - protein, 11 aa, Influenza virus
PGIKGFGFLNE

SEQ ID NO: 410883 - protein, 11 aa, Influenza virus
SNTWLGRTISP

SEQ ID NO: 410884 - protein, 11 aa, Influenza virus
STWLGRTISPR

SEQ ID NO: 410885 - protein, 11 aa, Influenza virus
TWLGRTISPKL

SEQ ID NO: 410886 - protein, 11 aa, Influenza virus
WLGRTISPKLR

SEQ ID NO: 410887 - protein, 11 aa, Influenza virus
LGRTISPKLRS

SEQ ID NO: 410888 - protein, 11 aa, Influenza virus
GRTISPKLRSG

SEQ ID NO: 410889 - protein, 11 aa, Influenza virus
RTISPKLRSGF

SEQ ID NO: 410890 - protein, 11 aa, Influenza virus
TISPKLRSGFE

SEQ ID NO: 410891 - protein, 11 aa, Influenza virus
ISPKLRSGFEM

SEQ ID NO: 410892 - protein, 11 aa, Influenza virus
SPKLRSGFEML

SEQ ID NO: 410893 - protein, 11 aa, Influenza virus
PKLRSGFEMLK

SEQ ID NO: 410894 - protein, 11 aa, Influenza virus
KLRSGFEMLKI

SEQ ID NO: 410895 - protein, 11 aa, Influenza virus
SRSGFEMLRIP

SEQ ID NO: 410896 - protein, 11 aa, Influenza virus
RNGFEMLKIPN

SEQ ID NO: 410897 - protein, 11 aa, Influenza virus
SGFEMLKIHNA

SEQ ID NO: 410898 - protein, 11 aa, Influenza virus
GFEMLRIPNAG

SEQ ID NO: 410899 - protein, 11 aa, Influenza virus
FEMLKIPNAGI

SEQ ID NO: 410900 - protein, 11 aa, Influenza virus
EMLKIPNAGID

SEQ ID NO: 410901 - protein, 11 aa, Influenza virus
MLKIPNAGIDP

SEQ ID NO: 410902 - protein, 11 aa, Influenza virus
RQEIVGNDNWS

SEQ ID NO: 410903 - protein, 11 aa, Influenza virus
QEIVGNDNWSG

SEQ ID NO: 410904 - protein, 11 aa, Influenza virus
EIVGNDNWSGY

SEQ ID NO: 410905 - protein, 11 aa, Influenza virus
IVGNDNWSGYS

SEQ ID NO: 410906 - protein, 11 aa, Influenza virus
VGNDNWSGYSG

SEQ ID NO: 410907 - protein, 11 aa, Influenza virus
GNDNWSGYSGS

SEQ ID NO: 410908 - protein, 11 aa, Influenza virus
NKNWSGYSGSF

SEQ ID NO: 410909 - protein, 11 aa, Influenza virus
SNRSGYSGSFI

SEQ ID NO: 410910 - protein, 11 aa, Influenza virus
YSGSFIDYWDD

SEQ ID NO: 410911 - protein, 11 aa, Influenza virus
RPEEAKYVWWA

SEQ ID NO: 410912 - protein, 11 aa, Influenza virus
PEEAKYVWWAS

SEQ ID NO: 410913 - protein, 11 aa, Influenza virus
EEAKYVWWASN

SEQ ID NO: 410914 - protein, 11 aa, Influenza virus
EAKYVWWASNS

SEQ ID NO: 410915 - protein, 11 aa, Influenza virus
AKYVWWASNSL

SEQ ID NO: 410916 - protein, 11 aa, Influenza virus
KYVEWTSNSLI

SEQ ID NO: 410917 - protein, 11 aa, Influenza virus
YVEWTSNSLIA

SEQ ID NO: 410918 - protein, 11 aa, Influenza virus
VEWTSNSLIAL

SEQ ID NO: 410919 - protein, 11 aa, Influenza virus
EWTSNSLIALC

SEQ ID NO: 410920 - protein, 11 aa, Influenza virus
WASNSLIALCG

SEQ ID NO: 410921 - protein, 11 aa, Influenza virus
ASNSLIALCGS

SEQ ID NO: 410922 - protein, 11 aa, Influenza virus
PVGPGSFPDGA

SEQ ID NO: 410923 - protein, 11 aa, Influenza virus
IGSGFFPDGPQ

SEQ ID NO: 410924 - protein, 11 aa, Influenza virus
GSGFFPDGPQI

SEQ ID NO: 410925 - protein, 11 aa, Influenza virus
PGSFPDGAQIQ

SEQ ID NO: 410926 - protein, 11 aa, Influenza virus
GFFPDGPQIQY

SEQ ID NO: 410927 - protein, 11 aa, Influenza virus
FFPDGPQIQYF

SEQ ID NO: 410928 - protein, 11 aa, Influenza virus
FPDGPQIQYFS

SEQ ID NO: 410929 - protein, 11 aa, Influenza virus
LLMSTNAYDRI

SEQ ID NO: 410930 - protein, 11 aa, Influenza virus
LMSTNAYDRIC

SEQ ID NO: 410931 - protein, 11 aa, Influenza virus
MSTNAYDRICI

SEQ ID NO: 410932 - protein, 11 aa, Influenza virus
YQSNNSTNTVN

SEQ ID NO: 410933 - protein, 11 aa, Influenza virus
QSNNSTNTVNT

SEQ ID NO: 410934 - protein, 11 aa, Influenza virus
SNNSTDTVDTL

SEQ ID NO: 410935 - protein, 11 aa, Influenza virus
NNSTDTVNTLT

SEQ ID NO: 410936 - protein, 11 aa, Influenza virus
NSTDTVNTLME

SEQ ID NO: 410937 - protein, 11 aa, Influenza virus
STNTVNTLIEQ

SEQ ID NO: 410938 - protein, 11 aa, Influenza virus
TLIEQKVPVTQ

SEQ ID NO: 410939 - protein, 11 aa, Influenza virus
EQKVPVTQTME

SEQ ID NO: 410940 - protein, 11 aa, Influenza virus
QNIPVTQTMEL

SEQ ID NO: 410941 - protein, 11 aa, Influenza virus
KVPVTQTMELV

SEQ ID NO: 410942 - protein, 11 aa, Influenza virus
IPVTQTMELVE

SEQ ID NO: 410943 - protein, 11 aa, Influenza virus
PVTQAMELVEA

SEQ ID NO: 410944 - protein, 11 aa, Influenza virus
VTQTMELVETK

SEQ ID NO: 410945 - protein, 11 aa, Influenza virus
TQTMELVETKK

SEQ ID NO: 410946 - protein, 11 aa, Influenza virus
QTMELVETKKH

SEQ ID NO: 410947 - protein, 11 aa, Influenza virus
KKHPAYCNTDL

SEQ ID NO: 410948 - protein, 11 aa, Influenza virus
KHLAYCNTDLG

SEQ ID NO: 410949 - protein, 11 aa, Influenza virus
PAYCNTDLGSP

SEQ ID NO: 410950 - protein, 11 aa, Influenza virus
AYCNTDLGSPL

SEQ ID NO: 410951 - protein, 11 aa, Influenza virus
YCNTDLGSPLE

SEQ ID NO: 410952 - protein, 11 aa, Influenza virus
CNTDLGSPLEL

SEQ ID NO: 410953 - protein, 11 aa, Influenza virus
NTDLGSPLELR

SEQ ID NO: 410954 - protein, 11 aa, Influenza virus
TDLGSPLELRD

SEQ ID NO: 410955 - protein, 11 aa, Influenza virus
DLGSPLELRDC

SEQ ID NO: 410956 - protein, 11 aa, Influenza virus
LGSPLELRDCK

SEQ ID NO: 410957 - protein, 11 aa, Influenza virus
GSPLELRDCKI

SEQ ID NO: 410958 - protein, 11 aa, Influenza virus
SPLELRDCKIE

SEQ ID NO: 410959 - protein, 11 aa, Influenza virus
AVIYGNPKCDT

SEQ ID NO: 410960 - protein, 11 aa, Influenza virus
VIYGNPKCDTH

SEQ ID NO: 410961 - protein, 11 aa, Influenza virus
IYGNPKCDTHL

SEQ ID NO: 410962 - protein, 11 aa, Influenza virus
YGNPKCDTHLK

SEQ ID NO: 410963 - protein, 11 aa, Influenza virus
GNPKCDTHLKD

SEQ ID NO: 410964 - protein, 11 aa, Influenza virus
NPKCDTHLKDQ

SEQ ID NO: 410965 - protein, 11 aa, Influenza virus
HLKDQDWSYIV

SEQ ID NO: 410966 - protein, 11 aa, Influenza virus
LKDQDWSYIVE

SEQ ID NO: 410967 - protein, 11 aa, Influenza virus
KDQSWSYIVER

SEQ ID NO: 410968 - protein, 11 aa, Influenza virus
DQSWSYIVERP

SEQ ID NO: 410969 - protein, 11 aa, Influenza virus
QSWSYIVERPS

SEQ ID NO: 410970 - protein, 11 aa, Influenza virus
DWSYIVERPSA

SEQ ID NO: 410971 - protein, 11 aa, Influenza virus
APEGMCYPGFV

SEQ ID NO: 410972 - protein, 11 aa, Influenza virus
PEGMCYPGFVE

SEQ ID NO: 410973 - protein, 11 aa, Influenza virus
EGMCYPGFVEN

SEQ ID NO: 410974 - protein, 11 aa, Influenza virus
GMCYPGFVENL

SEQ ID NO: 410975 - protein, 11 aa, Influenza virus
MCYPGFVENLE

SEQ ID NO: 410976 - protein, 11 aa, Influenza virus
CYPGFVENLEE

SEQ ID NO: 410977 - protein, 11 aa, Influenza virus
YPGFVENLEEL

SEQ ID NO: 410978 - protein, 11 aa, Influenza virus
PGFVENLEELR

SEQ ID NO: 410979 - protein, 11 aa, Influenza virus
GFVENLEELRF

SEQ ID NO: 410980 - protein, 11 aa, Influenza virus
FVENLEELRFV

SEQ ID NO: 410981 - protein, 11 aa, Influenza virus
NLEELRFVFSI

SEQ ID NO: 410982 - protein, 11 aa, Influenza virus
LEELRFVFSIA

SEQ ID NO: 410983 - protein, 11 aa, Influenza virus
EELRFVFSIAA

SEQ ID NO: 410984 - protein, 11 aa, Influenza virus
ELRFVFSIAAS

SEQ ID NO: 410985 - protein, 11 aa, Influenza virus
LRFVFSIAASY

SEQ ID NO: 410986 - protein, 11 aa, Influenza virus
RFVFSIAASYK

SEQ ID NO: 410987 - protein, 11 aa, Influenza virus
FVFSIAASYKR

SEQ ID NO: 410988 - protein, 11 aa, Influenza virus
VFSSAASYKRV

SEQ ID NO: 410989 - protein, 11 aa, Influenza virus
FSSAASYKRVR

SEQ ID NO: 410990 - protein, 11 aa, Influenza virus
SSAASYKRVRL

SEQ ID NO: 410991 - protein, 11 aa, Influenza virus
IAASYKRIRLF

SEQ ID NO: 410992 - protein, 11 aa, Influenza virus
YKRIRLFDYSG

SEQ ID NO: 410993 - protein, 11 aa, Influenza virus
KRIRLFDYSGW

SEQ ID NO: 410994 - protein, 11 aa, Influenza virus
RIRLFDYSGWN

SEQ ID NO: 410995 - protein, 11 aa, Influenza virus
VRLFDYSRWNV

SEQ ID NO: 410996 - protein, 11 aa, Influenza virus
RLFDYSKWNVS

SEQ ID NO: 410997 - protein, 11 aa, Influenza virus
WNVSSSGTSKA

SEQ ID NO: 410998 - protein, 11 aa, Influenza virus
NVSSSGTSKAC

SEQ ID NO: 410999 - protein, 11 aa, Influenza virus
VTSSGTSKACS

SEQ ID NO: 411000 - protein, 11 aa, Influenza virus
TSSGTSKACSA

SEQ ID NO: 411001 - protein, 11 aa, Influenza virus
SSGTSKACSAS

SEQ ID NO: 411002 - protein, 11 aa, Influenza virus
SGTSKACNALT

SEQ ID NO: 411003 - protein, 11 aa, Influenza virus
GTSKACNALTG

SEQ ID NO: 411004 - protein, 11 aa, Influenza virus
TSKACNALTGG

SEQ ID NO: 411005 - protein, 11 aa, Influenza virus
SKACNALTGGQ

SEQ ID NO: 411006 - protein, 11 aa, Influenza virus
KACSASTGGQS

SEQ ID NO: 411007 - protein, 11 aa, Influenza virus
ACSASTGGQSF

SEQ ID NO: 411008 - protein, 11 aa, Influenza virus
CSASTGGQSFY

SEQ ID NO: 411009 - protein, 11 aa, Influenza virus
SASTGGQSFYR

SEQ ID NO: 411010 - protein, 11 aa, Influenza virus
ALTGGQSFYRS

SEQ ID NO: 411011 - protein, 11 aa, Influenza virus
LTGGQSFYRSI

SEQ ID NO: 411012 - protein, 11 aa, Influenza virus
TGAQSFYRSIN

SEQ ID NO: 411013 - protein, 11 aa, Influenza virus
GAQSFYRSINW

SEQ ID NO: 411014 - protein, 11 aa, Influenza virus
AQSFYRSINWL

SEQ ID NO: 411015 - protein, 11 aa, Influenza virus
RSINWLTKKEP

SEQ ID NO: 411016 - protein, 11 aa, Influenza virus
SINWLTKKEPD

SEQ ID NO: 411017 - protein, 11 aa, Influenza virus
INWLTKKEPDT

SEQ ID NO: 411018 - protein, 11 aa, Influenza virus
NWLTKKKPDIY

SEQ ID NO: 411019 - protein, 11 aa, Influenza virus
WLTKKKPDIYD

SEQ ID NO: 411020 - protein, 11 aa, Influenza virus
LTKKKPDIYDF

SEQ ID NO: 411021 - protein, 11 aa, Influenza virus
TKKKPDIYDFN

SEQ ID NO: 411022 - protein, 11 aa, Influenza virus
KKEPDTYDFNE

SEQ ID NO: 411023 - protein, 11 aa, Influenza virus
KEPDTYDFNEG

SEQ ID NO: 411024 - protein, 11 aa, Influenza virus
PDTYDFNEGAY

SEQ ID NO: 411025 - protein, 11 aa, Influenza virus
NNEEGDIIFLW

SEQ ID NO: 411026 - protein, 11 aa, Influenza virus
NEEGDIIFLWG

SEQ ID NO: 411027 - protein, 11 aa, Influenza virus
ENGDIIFLWGI

SEQ ID NO: 411028 - protein, 11 aa, Influenza virus
NGDIIFLWGIH

SEQ ID NO: 411029 - protein, 11 aa, Influenza virus
FLWGIHHPPNT

SEQ ID NO: 411030 - protein, 11 aa, Influenza virus
LWGIHHPPNTK

SEQ ID NO: 411031 - protein, 11 aa, Influenza virus
WGIHHPPNTKE

SEQ ID NO: 411032 - protein, 11 aa, Influenza virus
GIHHPPNTKEQ

SEQ ID NO: 411033 - protein, 11 aa, Influenza virus
IHHPPNTKEQT

SEQ ID NO: 411034 - protein, 11 aa, Influenza virus
AKEQTALYKNA

SEQ ID NO: 411035 - protein, 11 aa, Influenza virus
TEQTKLYKNTN

SEQ ID NO: 411036 - protein, 11 aa, Influenza virus
EQTKLYKNTNT

SEQ ID NO: 411037 - protein, 11 aa, Influenza virus
QTKLYKNTNTL

SEQ ID NO: 411038 - protein, 11 aa, Influenza virus
TKLYKNTNTLS

SEQ ID NO: 411039 - protein, 11 aa, Influenza virus
KLYKNTNTLSS

SEQ ID NO: 411040 - protein, 11 aa, Influenza virus
LYKNANTLTSV

SEQ ID NO: 411041 - protein, 11 aa, Influenza virus
YKNANTLSSVN

SEQ ID NO: 411042 - protein, 11 aa, Influenza virus
KNTNTLSSVTT

SEQ ID NO: 411043 - protein, 11 aa, Influenza virus
NTNTLSSVTTN

SEQ ID NO: 411044 - protein, 11 aa, Influenza virus
ANTLSSVNTNT

SEQ ID NO: 411045 - protein, 11 aa, Influenza virus
NTLTSVTTNTI

SEQ ID NO: 411046 - protein, 11 aa, Influenza virus
TLTSVTTNTIN

SEQ ID NO: 411047 - protein, 11 aa, Influenza virus
LTSVTTNTINR

SEQ ID NO: 411048 - protein, 11 aa, Influenza virus
SSVNTNTINRS

SEQ ID NO: 411049 - protein, 11 aa, Influenza virus
SVNTNTINRSF

SEQ ID NO: 411050 - protein, 11 aa, Influenza virus
VTTNTINRIFQ

SEQ ID NO: 411051 - protein, 11 aa, Influenza virus
TTNTINRIFQP

SEQ ID NO: 411052 - protein, 11 aa, Influenza virus
TNTINRSFRPN

SEQ ID NO: 411053 - protein, 11 aa, Influenza virus
NTINRIFQPNI

SEQ ID NO: 411054 - protein, 11 aa, Influenza virus
TINRIFQPNIG

SEQ ID NO: 411055 - protein, 11 aa, Influenza virus
INRIFQPNIGP

SEQ ID NO: 411056 - protein, 11 aa, Influenza virus
NRIFQPNIGPR

SEQ ID NO: 411057 - protein, 11 aa, Influenza virus
RIFQPNIGPRP

SEQ ID NO: 411058 - protein, 11 aa, Influenza virus
IFQPNIGPRPL

SEQ ID NO: 411059 - protein, 11 aa, Influenza virus
FQPNIGPRALV

SEQ ID NO: 411060 - protein, 11 aa, Influenza virus
QPNIGPRALVR

SEQ ID NO: 411061 - protein, 11 aa, Influenza virus
PNIGPRPLVRE

SEQ ID NO: 411062 - protein, 11 aa, Influenza virus
NIGPRALVRGQ

SEQ ID NO: 411063 - protein, 11 aa, Influenza virus
IGPRPLVREQQ

SEQ ID NO: 411064 - protein, 11 aa, Influenza virus
GPRPLVREQQG

SEQ ID NO: 411065 - protein, 11 aa, Influenza virus
PRPLVREQQGR

SEQ ID NO: 411066 - protein, 11 aa, Influenza virus
RPLVRGQQGWM

SEQ ID NO: 411067 - protein, 11 aa, Influenza virus
PLVREQQGRMD

SEQ ID NO: 411068 - protein, 11 aa, Influenza virus
LVRGQQGWMDY

SEQ ID NO: 411069 - protein, 11 aa, Influenza virus
VRGQQGTMDYY

SEQ ID NO: 411070 - protein, 11 aa, Influenza virus
RGQQGWMDYYW

SEQ ID NO: 411071 - protein, 11 aa, Influenza virus
GQQGWMDYYWG

SEQ ID NO: 411072 - protein, 11 aa, Influenza virus
QQGTMDYYWGI

SEQ ID NO: 411073 - protein, 11 aa, Influenza virus
QGWMDYYWGIL

SEQ ID NO: 411074 - protein, 11 aa, Influenza virus
GWMDYYWGILK

SEQ ID NO: 411075 - protein, 11 aa, Influenza virus
WMDYYWGILKR

SEQ ID NO: 411076 - protein, 11 aa, Influenza virus
EFGYLLRGESH

SEQ ID NO: 411077 - protein, 11 aa, Influenza virus
FGYLLRGESHG

SEQ ID NO: 411078 - protein, 11 aa, Influenza virus
GYLLRGESHGR

SEQ ID NO: 411079 - protein, 11 aa, Influenza virus
GESHGRTIQNE

SEQ ID NO: 411080 - protein, 11 aa, Influenza virus
ESHCRIIQNED

SEQ ID NO: 411081 - protein, 11 aa, Influenza virus
SHCRIIQNEDI

SEQ ID NO: 411082 - protein, 11 aa, Influenza virus
HCRIIQNEDIP

SEQ ID NO: 411083 - protein, 11 aa, Influenza virus
GKIIQNEDIPI

SEQ ID NO: 411084 - protein, 11 aa, Influenza virus
KIIQNEDIPIG

SEQ ID NO: 411085 - protein, 11 aa, Influenza virus
IIQNEDIPIEN

SEQ ID NO: 411086 - protein, 11 aa, Influenza virus
IQNEDIPIENC

SEQ ID NO: 411087 - protein, 11 aa, Influenza virus
CHTKCQTYTGA

SEQ ID NO: 411088 - protein, 11 aa, Influenza virus
TKCQTYAGAVN

SEQ ID NO: 411089 - protein, 11 aa, Influenza virus
KCQTYAGAVNS

SEQ ID NO: 411090 - protein, 11 aa, Influenza virus
CQTYAGAVNSS

SEQ ID NO: 411091 - protein, 11 aa, Influenza virus
QTYAGAINSSR

SEQ ID NO: 411092 - protein, 11 aa, Influenza virus
TYAGAINSSRP

SEQ ID NO: 411093 - protein, 11 aa, Influenza virus
GAINSSKPLQN

SEQ ID NO: 411094 - protein, 11 aa, Influenza virus
AVNSSKPFQNA

SEQ ID NO: 411095 - protein, 11 aa, Influenza virus
INSSKPFQNTS

SEQ ID NO: 411096 - protein, 11 aa, Influenza virus
NSSKPLQNASR

SEQ ID NO: 411097 - protein, 11 aa, Influenza virus
SSKPFQNASRY

SEQ ID NO: 411098 - protein, 11 aa, Influenza virus
PFQNASRHHMG

SEQ ID NO: 411099 - protein, 11 aa, Influenza virus
FQNASRYYMGE

SEQ ID NO: 411100 - protein, 11 aa, Influenza virus
QNASRHHMGEC

SEQ ID NO: 411101 - protein, 11 aa, Influenza virus
NASRHHMGECP

SEQ ID NO: 411102 - protein, 11 aa, Influenza virus
SRHHMGECPKY

SEQ ID NO: 411103 - protein, 11 aa, Influenza virus
RKASLRLAVGL

SEQ ID NO: 411104 - protein, 11 aa, Influenza virus
KESLRLALGLR

SEQ ID NO: 411105 - protein, 11 aa, Influenza virus
ESLRLALGLRN

SEQ ID NO: 411106 - protein, 11 aa, Influenza virus
SLRLAIGLRNT

SEQ ID NO: 411107 - protein, 11 aa, Influenza virus
LRLAIGLRNTP

SEQ ID NO: 411108 - protein, 11 aa, Influenza virus
RLAIGLRNTPS

SEQ ID NO: 411109 - protein, 11 aa, Influenza virus
LALGLRNTPSI

SEQ ID NO: 411110 - protein, 11 aa, Influenza virus
ALGLRNTPSIE

SEQ ID NO: 411111 - protein, 11 aa, Influenza virus
VGLRNTPSIDP

SEQ ID NO: 411112 - protein, 11 aa, Influenza virus
GLRNTPSVEPR

SEQ ID NO: 411113 - protein, 11 aa, Influenza virus
LRNTPSVEPKG

SEQ ID NO: 411114 - protein, 11 aa, Influenza virus
RNTPSVEPRGL

SEQ ID NO: 411115 - protein, 11 aa, Influenza virus
NTPSVEPRGLF

SEQ ID NO: 411116 - protein, 11 aa, Influenza virus
TPSVEPKGLFG

SEQ ID NO: 411117 - protein, 11 aa, Influenza virus
PSVEPKGLFGA

SEQ ID NO: 411118 - protein, 11 aa, Influenza virus
SVEPRGLFGAI

SEQ ID NO: 411119 - protein, 11 aa, Influenza virus
VEPKGLFGAIA

SEQ ID NO: 411120 - protein, 11 aa, Influenza virus
DPKGLFGAIAG

SEQ ID NO: 411121 - protein, 11 aa, Influenza virus
ADQKSTQEAIG

SEQ ID NO: 411122 - protein, 11 aa, Influenza virus
DQKSTQEAIEK

SEQ ID NO: 411123 - protein, 11 aa, Influenza virus
QKSTQEAINKI

SEQ ID NO: 411124 - protein, 11 aa, Influenza virus
KSTQEAINKIT

SEQ ID NO: 411125 - protein, 11 aa, Influenza virus
STQEAINKITN

SEQ ID NO: 411126 - protein, 11 aa, Influenza virus
TQEAIGKITNK

SEQ ID NO: 411127 - protein, 11 aa, Influenza virus
QEAINKITNKV

SEQ ID NO: 411128 - protein, 11 aa, Influenza virus
EAIEKITNKVN

SEQ ID NO: 411129 - protein, 11 aa, Influenza virus
AIEKITNKVNN

SEQ ID NO: 411130 - protein, 11 aa, Influenza virus
INKITNKVNNI

SEQ ID NO: 411131 - protein, 11 aa, Influenza virus
GKITNKVNNIV

SEQ ID NO: 411132 - protein, 11 aa, Influenza virus
VDKMNREFEVM

SEQ ID NO: 411133 - protein, 11 aa, Influenza virus
DKMNREFEVMN

SEQ ID NO: 411134 - protein, 11 aa, Influenza virus
KMNREFEVMNH

SEQ ID NO: 411135 - protein, 11 aa, Influenza virus
MNREFEVMNHE

SEQ ID NO: 411136 - protein, 11 aa, Influenza virus
NREFEVMNHEF

SEQ ID NO: 411137 - protein, 11 aa, Influenza virus
REFEVMNHEFS

SEQ ID NO: 411138 - protein, 11 aa, Influenza virus
EKRTNMINDKI

SEQ ID NO: 411139 - protein, 11 aa, Influenza virus
TNMINDKIDDQ

SEQ ID NO: 411140 - protein, 11 aa, Influenza virus
NMISDKIDDQI

SEQ ID NO: 411141 - protein, 11 aa, Influenza virus
VINDKIDDQIE

SEQ ID NO: 411142 - protein, 11 aa, Influenza virus
DKIDDQIENLW

SEQ ID NO: 411143 - protein, 11 aa, Influenza virus
KIDDQIEGLWA

SEQ ID NO: 411144 - protein, 11 aa, Influenza virus
IDDQIENLWAY

SEQ ID NO: 411145 - protein, 11 aa, Influenza virus
DDQIEGLWAYN

SEQ ID NO: 411146 - protein, 11 aa, Influenza virus
DQIEGLWAYNA

SEQ ID NO: 411147 - protein, 11 aa, Influenza virus
QIENLWAYNAE

SEQ ID NO: 411148 - protein, 11 aa, Influenza virus
IENLWAYNAEL

SEQ ID NO: 411149 - protein, 11 aa, Influenza virus
ENLWAYNAELL

SEQ ID NO: 411150 - protein, 11 aa, Influenza virus
NLWAYNAELLV

SEQ ID NO: 411151 - protein, 11 aa, Influenza virus
VLLENQKTLDK

SEQ ID NO: 411152 - protein, 11 aa, Influenza virus
LLENQKTLDKH

SEQ ID NO: 411153 - protein, 11 aa, Influenza virus
LENQKTLDKHD

SEQ ID NO: 411154 - protein, 11 aa, Influenza virus
ENQKTLDKHDS

SEQ ID NO: 411155 - protein, 11 aa, Influenza virus
NQKTLDKHDSN

SEQ ID NO: 411156 - protein, 11 aa, Influenza virus
QKTLDKHDSNV

SEQ ID NO: 411157 - protein, 11 aa, Influenza virus
KTLDKHDSNVK

SEQ ID NO: 411158 - protein, 11 aa, Influenza virus
TLDEHDSNVEN

SEQ ID NO: 411159 - protein, 11 aa, Influenza virus
LDKHDSNVKNL

SEQ ID NO: 411160 - protein, 11 aa, Influenza virus
DEHDSNVENLF

SEQ ID NO: 411161 - protein, 11 aa, Influenza virus
KHDSNVKNLFD

SEQ ID NO: 411162 - protein, 11 aa, Influenza virus
SNVENLFDEVR

SEQ ID NO: 411163 - protein, 11 aa, Influenza virus
NVENLFDEVRR

SEQ ID NO: 411164 - protein, 11 aa, Influenza virus
VENLFDEVRRR

SEQ ID NO: 411165 - protein, 11 aa, Influenza virus
ENLFDEVRRRL

SEQ ID NO: 411166 - protein, 11 aa, Influenza virus
LFDEVRRRLSA

SEQ ID NO: 411167 - protein, 11 aa, Influenza virus
FDEVRRRLSAN

SEQ ID NO: 411168 - protein, 11 aa, Influenza virus
DEVRRRLSANA

SEQ ID NO: 411169 - protein, 11 aa, Influenza virus
NAMDAGNGCFD

SEQ ID NO: 411170 - protein, 11 aa, Influenza virus
AMDAGNGCFDI

SEQ ID NO: 411171 - protein, 11 aa, Influenza virus
MDAGNGCFDIL

SEQ ID NO: 411172 - protein, 11 aa, Influenza virus
DTGKGCFDILH

SEQ ID NO: 411173 - protein, 11 aa, Influenza virus
TGKGCFDILHK

SEQ ID NO: 411174 - protein, 11 aa, Influenza virus
KGCFDILHKCD

SEQ ID NO: 411175 - protein, 11 aa, Influenza virus
CFDILHKCDNK

SEQ ID NO: 411176 - protein, 11 aa, Influenza virus
FDILHKCDNKC

SEQ ID NO: 411177 - protein, 11 aa, Influenza virus
DILHKCDNKCM

SEQ ID NO: 411178 - protein, 11 aa, Influenza virus
ILHKCDNKCME

SEQ ID NO: 411179 - protein, 11 aa, Influenza virus
LHKCDNKCMET

SEQ ID NO: 411180 - protein, 11 aa, Influenza virus
HKCDNKCMETI

SEQ ID NO: 411181 - protein, 11 aa, Influenza virus
KCDNKCMETIK

SEQ ID NO: 411182 - protein, 11 aa, Influenza virus
CDNKCMETIKN

SEQ ID NO: 411183 - protein, 11 aa, Influenza virus
DNKCMETIKNG

SEQ ID NO: 411184 - protein, 11 aa, Influenza virus
METIKNGTYNR

SEQ ID NO: 411185 - protein, 11 aa, Influenza virus
ETIKNGTYNRK

SEQ ID NO: 411186 - protein, 11 aa, Influenza virus
TIKNGTYDHKD

SEQ ID NO: 411187 - protein, 11 aa, Influenza virus
IKNGTYNHKDY

SEQ ID NO: 411188 - protein, 11 aa, Influenza virus
KNGTYNHKDYE

SEQ ID NO: 411189 - protein, 11 aa, Influenza virus
NGTYNHKDYEE

SEQ ID NO: 411190 - protein, 11 aa, Influenza virus
GTYNRKEYEEE

SEQ ID NO: 411191 - protein, 11 aa, Influenza virus
TYNHKDYEEEA

SEQ ID NO: 411192 - protein, 11 aa, Influenza virus
YNRKEYEEEAK

SEQ ID NO: 411193 - protein, 11 aa, Influenza virus
NRKEYEEEAKL

SEQ ID NO: 411194 - protein, 11 aa, Influenza virus
RKEYEEEAKLE

SEQ ID NO: 411195 - protein, 11 aa, Influenza virus
KEYEEEAKLEK

SEQ ID NO: 411196 - protein, 11 aa, Influenza virus
EYEEEAKLEKS

SEQ ID NO: 411197 - protein, 11 aa, Influenza virus
EAKLEKSRING

SEQ ID NO: 411198 - protein, 11 aa, Influenza virus
AKLEKSRINGV

SEQ ID NO: 411199 - protein, 11 aa, Influenza virus
KLERSKINEVK

SEQ ID NO: 411200 - protein, 11 aa, Influenza virus
LERSKINGVIL

SEQ ID NO: 411201 - protein, 11 aa, Influenza virus
ERSKINGVRLE

SEQ ID NO: 411202 - protein, 11 aa, Influenza virus
RSKINEVKLEE

SEQ ID NO: 411203 - protein, 11 aa, Influenza virus
SKINGVILEEN

SEQ ID NO: 411204 - protein, 11 aa, Influenza virus
KINEVKLEENT

SEQ ID NO: 411205 - protein, 11 aa, Influenza virus
INGVKLEENTS

SEQ ID NO: 411206 - protein, 11 aa, Influenza virus
NGVKLEENTSY

SEQ ID NO: 411207 - protein, 11 aa, Influenza virus
VKLEENTSYKI

SEQ ID NO: 411208 - protein, 11 aa, Influenza virus
KLEENTSYKIL

SEQ ID NO: 411209 - protein, 11 aa, Influenza virus
LEENTSYKILS

SEQ ID NO: 411210 - protein, 11 aa, Influenza virus
EENTSYKILSI

SEQ ID NO: 411211 - protein, 11 aa, Influenza virus
ENTSYKILSIY

SEQ ID NO: 411212 - protein, 11 aa, Influenza virus
NTTYRILSIYS

SEQ ID NO: 411213 - protein, 11 aa, Influenza virus
TTYRILSIYST

SEQ ID NO: 411214 - protein, 11 aa, Influenza virus
SYKILSIYSTV

SEQ ID NO: 411215 - protein, 11 aa, Influenza virus
VAASLCLAILV

SEQ ID NO: 411216 - protein, 11 aa, Influenza virus
AASLCLAVLIA

SEQ ID NO: 411217 - protein, 11 aa, Influenza virus
ASLCLAILVAG

SEQ ID NO: 411218 - protein, 11 aa, Influenza virus
SLCLAVLIAGG

SEQ ID NO: 411219 - protein, 11 aa, Influenza virus
LCLAVLIAGGL

SEQ ID NO: 411220 - protein, 11 aa, Influenza virus
CLAILVAGGLI

SEQ ID NO: 411221 - protein, 11 aa, Influenza virus
LAILVAGGLIL

SEQ ID NO: 411222 - protein, 11 aa, Influenza virus
AVLIAGGLILG

SEQ ID NO: 411223 - protein, 11 aa, Influenza virus
VLIAGGLILGM

SEQ ID NO: 411224 - protein, 11 aa, Influenza virus
EGLVYGNPACD

SEQ ID NO: 411225 - protein, 11 aa, Influenza virus
LKPGQTLRVKS

SEQ ID NO: 411226 - protein, 11 aa, Influenza virus
ISGFIEGGWPG

SEQ ID NO: 411227 - protein, 11 aa, Influenza virus
GFIEGGWSGLI

SEQ ID NO: 411228 - protein, 11 aa, Influenza virus
FIEGGWSGLIA

SEQ ID NO: 411229 - protein, 11 aa, Influenza virus
IEGGWSGLIAG

SEQ ID NO: 411230 - protein, 11 aa, Influenza virus
EGGWSGLIAGW

SEQ ID NO: 411231 - protein, 11 aa, Influenza virus
GGWSGLIAGWY

SEQ ID NO: 411232 - protein, 11 aa, Influenza virus
GWSGLIAGWYG

SEQ ID NO: 411233 - protein, 11 aa, Influenza virus
WSGLIAGWYGF

SEQ ID NO: 411234 - protein, 11 aa, Influenza virus
SGLIAGWYGFQ

SEQ ID NO: 411235 - protein, 11 aa, Influenza virus
LVAGWYGFQHT

SEQ ID NO: 411236 - protein, 11 aa, Influenza virus
VAGWYGFQHTN

SEQ ID NO: 411237 - protein, 11 aa, Influenza virus
GWYGFQHSNEQ

SEQ ID NO: 411238 - protein, 11 aa, Influenza virus
WYGFQHSNEQG

SEQ ID NO: 411239 - protein, 11 aa, Influenza virus
DQIQNIWAYNA

SEQ ID NO: 411240 - protein, 11 aa, Influenza virus
QIQNIWAYNAE

SEQ ID NO: 411241 - protein, 11 aa, Influenza virus
IQNIWAYNAEL

SEQ ID NO: 411242 - protein, 11 aa, Influenza virus
QNIWAYNAELL

SEQ ID NO: 411243 - protein, 11 aa, Influenza virus
NIWAYNAELLV

SEQ ID NO: 411244 - protein, 11 aa, Influenza virus
LWAYNAELLVL

SEQ ID NO: 411245 - protein, 11 aa, Influenza virus
AYNAELLVLIE

SEQ ID NO: 411246 - protein, 11 aa, Influenza virus
YNAELLVLIEN

SEQ ID NO: 411247 - protein, 11 aa, Influenza virus
NAELLVLIENQ

SEQ ID NO: 411248 - protein, 11 aa, Influenza virus
AELLVLIENQK

SEQ ID NO: 411249 - protein, 11 aa, Influenza virus
ELLVLIENQKT

SEQ ID NO: 411250 - protein, 11 aa, Influenza virus
LIENQKTLDEH

SEQ ID NO: 411251 - protein, 11 aa, Influenza virus
EDGKGCFDLYH

SEQ ID NO: 411252 - protein, 11 aa, Influenza virus
GKGCFDLYHKC

SEQ ID NO: 411253 - protein, 11 aa, Influenza virus
ETYKILTIYST

SEQ ID NO: 411254 - protein, 11 aa, Influenza virus
TYKILTIYSTA

SEQ ID NO: 411255 - protein, 11 aa, Influenza virus
YKILSIYSTVA

SEQ ID NO: 411256 - protein, 11 aa, Influenza virus
KILSIYSTVAS

SEQ ID NO: 411257 - protein, 11 aa, Influenza virus
ILSIYSTVASS

SEQ ID NO: 411258 - protein, 11 aa, Influenza virus
LTIYSTVASSI

SEQ ID NO: 411259 - protein, 11 aa, Influenza virus
EGLVYGNPACD

SEQ ID NO: 411260 - protein, 11 aa, Influenza virus
LKPGQTLRVKS

SEQ ID NO: 411261 - protein, 11 aa, Influenza virus
ISGFIEGGWPG

SEQ ID NO: 411262 - protein, 11 aa, Influenza virus
GFIEGGWSGLI

SEQ ID NO: 411263 - protein, 11 aa, Influenza virus
FIEGGWSGLIA

SEQ ID NO: 411264 - protein, 11 aa, Influenza virus
IEGGWSGLIAG

SEQ ID NO: 411265 - protein, 11 aa, Influenza virus
EGGWSGLIAGW

SEQ ID NO: 411266 - protein, 11 aa, Influenza virus
GGWSGLIAGWY

SEQ ID NO: 411267 - protein, 11 aa, Influenza virus
GWSGLIAGWYG

SEQ ID NO: 411268 - protein, 11 aa, Influenza virus
WSGLIAGWYGF

SEQ ID NO: 411269 - protein, 11 aa, Influenza virus
SGLIAGWYGFQ

SEQ ID NO: 411270 - protein, 11 aa, Influenza virus
LVAGWYGFQHT

SEQ ID NO: 411271 - protein, 11 aa, Influenza virus
VAGWYGFQHTN

SEQ ID NO: 411272 - protein, 11 aa, Influenza virus
GWYGFQHSNEQ

SEQ ID NO: 411273 - protein, 11 aa, Influenza virus
WYGFQHSNEQG

SEQ ID NO: 411274 - protein, 11 aa, Influenza virus
DQIQNIWAYNA

SEQ ID NO: 411275 - protein, 11 aa, Influenza virus
QIQNIWAYNAE

SEQ ID NO: 411276 - protein, 11 aa, Influenza virus
IQNIWAYNAEL

SEQ ID NO: 411277 - protein, 11 aa, Influenza virus
QNIWAYNAELL

SEQ ID NO: 411278 - protein, 11 aa, Influenza virus
NIWAYNAELLV

SEQ ID NO: 411279 - protein, 11 aa, Influenza virus
LWAYNAELLVL

SEQ ID NO: 411280 - protein, 11 aa, Influenza virus
AYNAELLVLIE

SEQ ID NO: 411281 - protein, 11 aa, Influenza virus
NAELLVLIENQ

SEQ ID NO: 411282 - protein, 11 aa, Influenza virus
AELLVLIENQK

SEQ ID NO: 411283 - protein, 11 aa, Influenza virus
ELLVLIENQKT

SEQ ID NO: 411284 - protein, 11 aa, Influenza virus
LLVLIENQKTL

SEQ ID NO: 411285 - protein, 11 aa, Influenza virus
LVLIENQKTLD

SEQ ID NO: 411286 - protein, 11 aa, Influenza virus
VLIENQKTLDE

SEQ ID NO: 411287 - protein, 11 aa, Influenza virus
LIENQKTLDEH

SEQ ID NO: 411288 - protein, 11 aa, Influenza virus
EDGKGCFDLYH

SEQ ID NO: 411289 - protein, 11 aa, Influenza virus
GKGCFDLYHKC

SEQ ID NO: 411290 - protein, 11 aa, Influenza virus
ETYKILTIYST

SEQ ID NO: 411291 - protein, 11 aa, Influenza virus
TYKILTIYSTA

SEQ ID NO: 411292 - protein, 11 aa, Influenza virus
YKILSIYSTVA

SEQ ID NO: 411293 - protein, 11 aa, Influenza virus
KILSIYSTVAS

SEQ ID NO: 411294 - protein, 11 aa, Influenza virus
ILSIYSTVASS

SEQ ID NO: 411295 - protein, 11 aa, Influenza virus
LTIYSTVASSI

SEQ ID NO: 411296 - protein, 11 aa, Influenza virus
CYQFALGQGAT

SEQ ID NO: 411297 - protein, 11 aa, Influenza virus
YQFALGQGATL

SEQ ID NO: 411298 - protein, 11 aa, Influenza virus
PHRTLLMSELG

SEQ ID NO: 411299 - protein, 11 aa, Influenza virus
HRTLLMSELGV

SEQ ID NO: 411300 - protein, 11 aa, Influenza virus
TLLMNELGVPL

SEQ ID NO: 411301 - protein, 11 aa, Influenza virus
LLMNELGVPLH

SEQ ID NO: 411302 - protein, 11 aa, Influenza virus
QVCIAWSSASC

SEQ ID NO: 411303 - protein, 11 aa, Influenza virus
VCIAWSSASCH

SEQ ID NO: 411304 - protein, 11 aa, Influenza virus
CIAWSSSSCYD

SEQ ID NO: 411305 - protein, 11 aa, Influenza virus
IAWSSSSCYDG

SEQ ID NO: 411306 - protein, 11 aa, Influenza virus
AWSSSSCYDGK

SEQ ID NO: 411307 - protein, 11 aa, Influenza virus
WSSSSCYDGKA

SEQ ID NO: 411308 - protein, 11 aa, Influenza virus
SSSSCYDGKAW

SEQ ID NO: 411309 - protein, 11 aa, Influenza virus
SSSCYDGKAWL

SEQ ID NO: 411310 - protein, 11 aa, Influenza virus
ILITQESECVC

SEQ ID NO: 411311 - protein, 11 aa, Influenza virus
GGAQHVEECSC

SEQ ID NO: 411312 - protein, 11 aa, Influenza virus
NAQHVEECSCY

SEQ ID NO: 411313 - protein, 11 aa, Influenza virus
AKHVEECSCYP

SEQ ID NO: 411314 - protein, 11 aa, Influenza virus
VYRDNWKGSNR

SEQ ID NO: 411315 - protein, 11 aa, Influenza virus
YRDNWKGSNRP

SEQ ID NO: 411316 - protein, 11 aa, Influenza virus
YLCSGLVADTP

SEQ ID NO: 411317 - protein, 11 aa, Influenza virus
CSGLVGDTPRD

SEQ ID NO: 411318 - protein, 11 aa, Influenza virus
CINRCFYVELV

SEQ ID NO: 411319 - protein, 11 aa, Influenza virus
INRCFYVELVR

SEQ ID NO: 411320 - protein, 11 aa, Influenza virus
RCFYVELIRGK

SEQ ID NO: 411321 - protein, 11 aa, Influenza virus
CFYVELIRGKP

SEQ ID NO: 411322 - protein, 11 aa, Influenza virus
YGAGSWPDGAN

SEQ ID NO: 411323 - protein, 11 aa, Influenza virus
TEVETYVLSVI

SEQ ID NO: 411324 - protein, 11 aa, Influenza virus
EVETYVLSVIP

SEQ ID NO: 411325 - protein, 11 aa, Influenza virus
VETYVLSVIPS

SEQ ID NO: 411326 - protein, 11 aa, Influenza virus
ETYVLSVIPSG

SEQ ID NO: 411327 - protein, 11 aa, Influenza virus
TYVLSVIPSGP

SEQ ID NO: 411328 - protein, 11 aa, Influenza virus
YVLSVIPSGPL

SEQ ID NO: 411329 - protein, 11 aa, Influenza virus
VLSVIPSGPLK

SEQ ID NO: 411330 - protein, 11 aa, Influenza virus
LSVIPSGPLKA

SEQ ID NO: 411331 - protein, 11 aa, Influenza virus
SVIPSGPLKAE

SEQ ID NO: 411332 - protein, 11 aa, Influenza virus
VIPSGPLKAEI

SEQ ID NO: 411333 - protein, 11 aa, Influenza virus
LKAEIAQKLED

SEQ ID NO: 411334 - protein, 11 aa, Influenza virus
KAEIAQKLEDV

SEQ ID NO: 411335 - protein, 11 aa, Influenza virus
AEIAQKLEDVF

SEQ ID NO: 411336 - protein, 11 aa, Influenza virus
EIAQKLEDVFA

SEQ ID NO: 411337 - protein, 11 aa, Influenza virus
IAQKLEDVFAG

SEQ ID NO: 411338 - protein, 11 aa, Influenza virus
AQKLEDVFAGK

SEQ ID NO: 411339 - protein, 11 aa, Influenza virus
VFAGKNSDLEA

SEQ ID NO: 411340 - protein, 11 aa, Influenza virus
FAGKNSDLEAL

SEQ ID NO: 411341 - protein, 11 aa, Influenza virus
AGKNSDLEALM

SEQ ID NO: 411342 - protein, 11 aa, Influenza virus
GKNSDLEALME

SEQ ID NO: 411343 - protein, 11 aa, Influenza virus
KNSDLEALMEW

SEQ ID NO: 411344 - protein, 11 aa, Influenza virus
NADLEALMEWL

SEQ ID NO: 411345 - protein, 11 aa, Influenza virus
ADLEALMEWLK

SEQ ID NO: 411346 - protein, 11 aa, Influenza virus
SSLTKGVLGFV

SEQ ID NO: 411347 - protein, 11 aa, Influenza virus
SLTKGVLGFVF

SEQ ID NO: 411348 - protein, 11 aa, Influenza virus
LTKGVLGFVFT

SEQ ID NO: 411349 - protein, 11 aa, Influenza virus
TKGVLGFVFTL

SEQ ID NO: 411350 - protein, 11 aa, Influenza virus
QRRRFIQNALN

SEQ ID NO: 411351 - protein, 11 aa, Influenza virus
RRRFIQNALNG

SEQ ID NO: 411352 - protein, 11 aa, Influenza virus
RRFIQNALNGN

SEQ ID NO: 411353 - protein, 11 aa, Influenza virus
RFIQNALNGNG

SEQ ID NO: 411354 - protein, 11 aa, Influenza virus
FIQNALNGNGD

SEQ ID NO: 411355 - protein, 11 aa, Influenza virus
IQNALNGNGDP

SEQ ID NO: 411356 - protein, 11 aa, Influenza virus
LNGNGDPSNMD

SEQ ID NO: 411357 - protein, 11 aa, Influenza virus
SGNGDPNNMDR

SEQ ID NO: 411358 - protein, 11 aa, Influenza virus
GNGDPSNMDRA

SEQ ID NO: 411359 - protein, 11 aa, Influenza virus
NGDPSNMDRAV

SEQ ID NO: 411360 - protein, 11 aa, Influenza virus
GDPSNMDRAVK

SEQ ID NO: 411361 - protein, 11 aa, Influenza virus
DPSNMDRAVKL

SEQ ID NO: 411362 - protein, 11 aa, Influenza virus
PSNMDRAVKLY

SEQ ID NO: 411363 - protein, 11 aa, Influenza virus
NMDKAVKLYRK

SEQ ID NO: 411364 - protein, 11 aa, Influenza virus
MDKAVKLYRKL

SEQ ID NO: 411365 - protein, 11 aa, Influenza virus
DKAVKLYRKLK

SEQ ID NO: 411366 - protein, 11 aa, Influenza virus
KAVKLYRKLKR

SEQ ID NO: 411367 - protein, 11 aa, Influenza virus
VKLYKKLKREM

SEQ ID NO: 411368 - protein, 11 aa, Influenza virus
KLYKKLKREMT

SEQ ID NO: 411369 - protein, 11 aa, Influenza virus
LYKKLKREMTF

SEQ ID NO: 411370 - protein, 11 aa, Influenza virus
YKKLKREMTFH

SEQ ID NO: 411371 - protein, 11 aa, Influenza virus
KKLKREMTFHG

SEQ ID NO: 411372 - protein, 11 aa, Influenza virus
LKREITFYGAK

SEQ ID NO: 411373 - protein, 11 aa, Influenza virus
KREITFYGAKE

SEQ ID NO: 411374 - protein, 11 aa, Influenza virus
REMTFHGAKEV

SEQ ID NO: 411375 - protein, 11 aa, Influenza virus
SLSYSTGALAS

SEQ ID NO: 411376 - protein, 11 aa, Influenza virus
LGYSTGALASC

SEQ ID NO: 411377 - protein, 11 aa, Influenza virus
GYSTGALASCM

SEQ ID NO: 411378 - protein, 11 aa, Influenza virus
MGLIYNRMGTI

SEQ ID NO: 411379 - protein, 11 aa, Influenza virus
GLIYNRMGTVA

SEQ ID NO: 411380 - protein, 11 aa, Influenza virus
ALGLVCATCEQ

SEQ ID NO: 411381 - protein, 11 aa, Influenza virus
LGLVCATCEQI

SEQ ID NO: 411382 - protein, 11 aa, Influenza virus
VCATCEQIADA

SEQ ID NO: 411383 - protein, 11 aa, Influenza virus
CATCEQIADSH

SEQ ID NO: 411384 - protein, 11 aa, Influenza virus
ATCEQIADSHH

SEQ ID NO: 411385 - protein, 11 aa, Influenza virus
TCEQIADAQHR

SEQ ID NO: 411386 - protein, 11 aa, Influenza virus
CEQIADAQHRS

SEQ ID NO: 411387 - protein, 11 aa, Influenza virus
EQIADAQHRSH

SEQ ID NO: 411388 - protein, 11 aa, Influenza virus
QIADAQHRSHR

SEQ ID NO: 411389 - protein, 11 aa, Influenza virus
IADAQHRSHRQ

SEQ ID NO: 411390 - protein, 11 aa, Influenza virus
ADAQHRSHRQM

SEQ ID NO: 411391 - protein, 11 aa, Influenza virus
TITNPLIRHEN

SEQ ID NO: 411392 - protein, 11 aa, Influenza virus
ITNPLIRHENR

SEQ ID NO: 411393 - protein, 11 aa, Influenza virus
PLIRHENRMVI

SEQ ID NO: 411394 - protein, 11 aa, Influenza virus
LIRHENRMVIA

SEQ ID NO: 411395 - protein, 11 aa, Influenza virus
IRHENRMVIAS

SEQ ID NO: 411396 - protein, 11 aa, Influenza virus
RHENRMVIAST

SEQ ID NO: 411397 - protein, 11 aa, Influenza virus
AMEQIAGSSEQ

SEQ ID NO: 411398 - protein, 11 aa, Influenza virus
EQIAGSSEQAA

SEQ ID NO: 411399 - protein, 11 aa, Influenza virus
QIAGSSEQAAE

SEQ ID NO: 411400 - protein, 11 aa, Influenza virus
IAGSSEQAAEA

SEQ ID NO: 411401 - protein, 11 aa, Influenza virus
AGSNEQAAEAM

SEQ ID NO: 411402 - protein, 11 aa, Influenza virus
GSSEQAAEAIE

SEQ ID NO: 411403 - protein, 11 aa, Influenza virus
SEQAAEAIEVA

SEQ ID NO: 411404 - protein, 11 aa, Influenza virus
LIENLQAYQKR

SEQ ID NO: 411405 - protein, 11 aa, Influenza virus
IENLQAYQKRM

SEQ ID NO: 411406 - protein, 11 aa, Influenza virus
DNLQAYQKRMG

SEQ ID NO: 411407 - protein, 11 aa, Influenza virus
NLQAYQKRMGL

SEQ ID NO: 411408 - protein, 11 aa, Influenza virus
LQAYQKRMGLQ

SEQ ID NO: 411409 - protein, 11 aa, Influenza virus
QAYQKRMGVQL

SEQ ID NO: 411410 - protein, 11 aa, Influenza virus
YQKRMGVQIQR

SEQ ID NO: 411411 - protein, 11 aa, Influenza virus
MSDIGAMASQG

SEQ ID NO: 411412 - protein, 11 aa, Influenza virus
SDIGAMASQGT

SEQ ID NO: 411413 - protein, 11 aa, Influenza virus
DIEAMATQGTK

SEQ ID NO: 411414 - protein, 11 aa, Influenza virus
IEIMASQGTKR

SEQ ID NO: 411415 - protein, 11 aa, Influenza virus
EAMATQGTKRS

SEQ ID NO: 411416 - protein, 11 aa, Influenza virus
AMASQGTKRSF

SEQ ID NO: 411417 - protein, 11 aa, Influenza virus
MALQGTKRSYE

SEQ ID NO: 411418 - protein, 11 aa, Influenza virus
ALQGTKRSYEQ

SEQ ID NO: 411419 - protein, 11 aa, Influenza virus
LQGTKRSYEQM

SEQ ID NO: 411420 - protein, 11 aa, Influenza virus
TKRSYEQMETS

SEQ ID NO: 411421 - protein, 11 aa, Influenza virus
KRSYEQMETSG

SEQ ID NO: 411422 - protein, 11 aa, Influenza virus
GIGKFYIQMCT

SEQ ID NO: 411423 - protein, 11 aa, Influenza virus
IGKFYIQMCTE

SEQ ID NO: 411424 - protein, 11 aa, Influenza virus
GKFYIQMCTEL

SEQ ID NO: 411425 - protein, 11 aa, Influenza virus
KFYIQMCTELK

SEQ ID NO: 411426 - protein, 11 aa, Influenza virus
FYIQMCTELQL

SEQ ID NO: 411427 - protein, 11 aa, Influenza virus
YVQMCTELKLN

SEQ ID NO: 411428 - protein, 11 aa, Influenza virus
GRLIQNSMTIE

SEQ ID NO: 411429 - protein, 11 aa, Influenza virus
TVERMVLSAFD

SEQ ID NO: 411430 - protein, 11 aa, Influenza virus
VERMVLSAFDE

SEQ ID NO: 411431 - protein, 11 aa, Influenza virus
RRNKYLEEHPN

SEQ ID NO: 411432 - protein, 11 aa, Influenza virus
RNKYLEEHPNA

SEQ ID NO: 411433 - protein, 11 aa, Influenza virus
NKYLEEHPNAG

SEQ ID NO: 411434 - protein, 11 aa, Influenza virus
YLEEHPSTGKD

SEQ ID NO: 411435 - protein, 11 aa, Influenza virus
LEEHPSTGKDP

SEQ ID NO: 411436 - protein, 11 aa, Influenza virus
EEHPSTGKDPK

SEQ ID NO: 411437 - protein, 11 aa, Influenza virus
EHPSTGKDPKK

SEQ ID NO: 411438 - protein, 11 aa, Influenza virus
HPSTGKDPKKT

SEQ ID NO: 411439 - protein, 11 aa, Influenza virus
PSTGKDPKKTG

SEQ ID NO: 411440 - protein, 11 aa, Influenza virus
STGKDPKKTGG

SEQ ID NO: 411441 - protein, 11 aa, Influenza virus
PKKTGGPIYKK

SEQ ID NO: 411442 - protein, 11 aa, Influenza virus
AGLTHMMIWHS

SEQ ID NO: 411443 - protein, 11 aa, Influenza virus
GLTHMMIWHSN

SEQ ID NO: 411444 - protein, 11 aa, Influenza virus
LTHMMIWHSNL

SEQ ID NO: 411445 - protein, 11 aa, Influenza virus
THMMIWHSNLN

SEQ ID NO: 411446 - protein, 11 aa, Influenza virus
HMMIWHSNLND

SEQ ID NO: 411447 - protein, 11 aa, Influenza virus
MMIWHSNLNDT

SEQ ID NO: 411448 - protein, 11 aa, Influenza virus
SGAAGAAIKGV

SEQ ID NO: 411449 - protein, 11 aa, Influenza virus
GAAGAAIKGVG

SEQ ID NO: 411450 - protein, 11 aa, Influenza virus
AAGAAIKGVGT

SEQ ID NO: 411451 - protein, 11 aa, Influenza virus
AGAAVKGIGTM

SEQ ID NO: 411452 - protein, 11 aa, Influenza virus
VMELIRMVKRG

SEQ ID NO: 411453 - protein, 11 aa, Influenza virus
LELIRMIKRGI

SEQ ID NO: 411454 - protein, 11 aa, Influenza virus
ELVRMIKRGIN

SEQ ID NO: 411455 - protein, 11 aa, Influenza virus
LVRMIKRGIND

SEQ ID NO: 411456 - protein, 11 aa, Influenza virus
VRMIKRGINDR

SEQ ID NO: 411457 - protein, 11 aa, Influenza virus
RMIKRGVNDRN

SEQ ID NO: 411458 - protein, 11 aa, Influenza virus
MIKRGVNDRNF

SEQ ID NO: 411459 - protein, 11 aa, Influenza virus
IKRGVNDRNFW

SEQ ID NO: 411460 - protein, 11 aa, Influenza virus
GINDRNFWRGD

SEQ ID NO: 411461 - protein, 11 aa, Influenza virus
INDRNFWRGDN

SEQ ID NO: 411462 - protein, 11 aa, Influenza virus
RNFWRGDNGRR

SEQ ID NO: 411463 - protein, 11 aa, Influenza virus
NFWRGDNGRRT

SEQ ID NO: 411464 - protein, 11 aa, Influenza virus
FWRGDNGRRTR

SEQ ID NO: 411465 - protein, 11 aa, Influenza virus
TRSAYERMCNI

SEQ ID NO: 411466 - protein, 11 aa, Influenza virus
RSAYERMCNIL

SEQ ID NO: 411467 - protein, 11 aa, Influenza virus
SAYERMCNILK

SEQ ID NO: 411468 - protein, 11 aa, Influenza virus
KFQTAAQKAMM

SEQ ID NO: 411469 - protein, 11 aa, Influenza virus
FQTAAQKAMMD

SEQ ID NO: 411470 - protein, 11 aa, Influenza virus
QTAAQKAMMDQ

SEQ ID NO: 411471 - protein, 11 aa, Influenza virus
TAAQKAMMDQV

SEQ ID NO: 411472 - protein, 11 aa, Influenza virus
AAQKAMMDQVR

SEQ ID NO: 411473 - protein, 11 aa, Influenza virus
AQKAMMDQVRE

SEQ ID NO: 411474 - protein, 11 aa, Influenza virus
QKAMMDQVRES

SEQ ID NO: 411475 - protein, 11 aa, Influenza virus
KAMMDQVRESR

SEQ ID NO: 411476 - protein, 11 aa, Influenza virus
AMMDQVREGRN

SEQ ID NO: 411477 - protein, 11 aa, Influenza virus
MMDQVREGRNP

SEQ ID NO: 411478 - protein, 11 aa, Influenza virus
MDQVREGRNPG

SEQ ID NO: 411479 - protein, 11 aa, Influenza virus
RESRSPGNAEI

SEQ ID NO: 411480 - protein, 11 aa, Influenza virus
ESRSPGNAEIE

SEQ ID NO: 411481 - protein, 11 aa, Influenza virus
SRSPGNAEIED

SEQ ID NO: 411482 - protein, 11 aa, Influenza virus
SPGNAEIEDLI

SEQ ID NO: 411483 - protein, 11 aa, Influenza virus
GNAEIEDLIFS

SEQ ID NO: 411484 - protein, 11 aa, Influenza virus
NAEIEDLIFSA

SEQ ID NO: 411485 - protein, 11 aa, Influenza virus
AEIEDLIFSAR

SEQ ID NO: 411486 - protein, 11 aa, Influenza virus
EIEDLIFSARS

SEQ ID NO: 411487 - protein, 11 aa, Influenza virus
IEDLIFSARSA

SEQ ID NO: 411488 - protein, 11 aa, Influenza virus
EDLIFSARSAL

SEQ ID NO: 411489 - protein, 11 aa, Influenza virus
DLIFSARSALI

SEQ ID NO: 411490 - protein, 11 aa, Influenza virus
LIFSARSALIL

SEQ ID NO: 411491 - protein, 11 aa, Influenza virus
IFSARSALILR

SEQ ID NO: 411492 - protein, 11 aa, Influenza virus
FMARSALILRG

SEQ ID NO: 411493 - protein, 11 aa, Influenza virus
MARSALILRGS

SEQ ID NO: 411494 - protein, 11 aa, Influenza virus
ARSALILRGAV

SEQ ID NO: 411495 - protein, 11 aa, Influenza virus
RSALILRGAVA

SEQ ID NO: 411496 - protein, 11 aa, Influenza virus
SALILRGAVAH

SEQ ID NO: 411497 - protein, 11 aa, Influenza virus
ALILRGAVAHK

SEQ ID NO: 411498 - protein, 11 aa, Influenza virus
LILRGAVAHKS

SEQ ID NO: 411499 - protein, 11 aa, Influenza virus
ILRGAVAHKSC

SEQ ID NO: 411500 - protein, 11 aa, Influenza virus
IAHKSCLPACV

SEQ ID NO: 411501 - protein, 11 aa, Influenza virus
AHKSCLPACIY

SEQ ID NO: 411502 - protein, 11 aa, Influenza virus
HKSCLPACIYG

SEQ ID NO: 411503 - protein, 11 aa, Influenza virus
KSCLPACAYGP

SEQ ID NO: 411504 - protein, 11 aa, Influenza virus
SCLPACAYGPA

SEQ ID NO: 411505 - protein, 11 aa, Influenza virus
GYDFEKEGYSL

SEQ ID NO: 411506 - protein, 11 aa, Influenza virus
YDFEKEGYSLV

SEQ ID NO: 411507 - protein, 11 aa, Influenza virus
NFEKEGYSLVG

SEQ ID NO: 411508 - protein, 11 aa, Influenza virus
FEKEGYSLVGV

SEQ ID NO: 411509 - protein, 11 aa, Influenza virus
EKEGYSLVGVD

SEQ ID NO: 411510 - protein, 11 aa, Influenza virus
KEGYSLVGVDP

SEQ ID NO: 411511 - protein, 11 aa, Influenza virus
GYSLVGVDPFK

SEQ ID NO: 411512 - protein, 11 aa, Influenza virus
YSLVGVDPFKL

SEQ ID NO: 411513 - protein, 11 aa, Influenza virus
SLVGVDPFKLL

SEQ ID NO: 411514 - protein, 11 aa, Influenza virus
LVGVDPFKLLQ

SEQ ID NO: 411515 - protein, 11 aa, Influenza virus
DPFKLLQNSQI

SEQ ID NO: 411516 - protein, 11 aa, Influenza virus
RPKENPAHKSQ

SEQ ID NO: 411517 - protein, 11 aa, Influenza virus
PKENPAHKSQL

SEQ ID NO: 411518 - protein, 11 aa, Influenza virus
NENPVHKSQLI

SEQ ID NO: 411519 - protein, 11 aa, Influenza virus
ENPAHKSQLIW

SEQ ID NO: 411520 - protein, 11 aa, Influenza virus
NPAHKSQLIWM

SEQ ID NO: 411521 - protein, 11 aa, Influenza virus
PAHKSQLIWMA

SEQ ID NO: 411522 - protein, 11 aa, Influenza virus
AHKSQLIWMAC

SEQ ID NO: 411523 - protein, 11 aa, Influenza virus
HKSQLIWMACH

SEQ ID NO: 411524 - protein, 11 aa, Influenza virus
KSQLIWMACHS

SEQ ID NO: 411525 - protein, 11 aa, Influenza virus
SQLIWMACHSA

SEQ ID NO: 411526 - protein, 11 aa, Influenza virus
QLIWMACHSAA

SEQ ID NO: 411527 - protein, 11 aa, Influenza virus
LIWMACHSAAF

SEQ ID NO: 411528 - protein, 11 aa, Influenza virus
IWMACHSAAFE

SEQ ID NO: 411529 - protein, 11 aa, Influenza virus
CNSAAFEDLRV

SEQ ID NO: 411530 - protein, 11 aa, Influenza virus
LSTRGIQIASN

SEQ ID NO: 411531 - protein, 11 aa, Influenza virus
STRGIQIASNE

SEQ ID NO: 411532 - protein, 11 aa, Influenza virus
TRGIQIASNEN

SEQ ID NO: 411533 - protein, 11 aa, Influenza virus
TLELRSKYWAI

SEQ ID NO: 411534 - protein, 11 aa, Influenza virus
LELRSKYWAIR

SEQ ID NO: 411535 - protein, 11 aa, Influenza virus
ELRSKYWAIRT

SEQ ID NO: 411536 - protein, 11 aa, Influenza virus
LRSKYWAIRTR

SEQ ID NO: 411537 - protein, 11 aa, Influenza virus
RSKYWAIRTRS

SEQ ID NO: 411538 - protein, 11 aa, Influenza virus
SKYWAIRTRSG

SEQ ID NO: 411539 - protein, 11 aa, Influenza virus
KYWAIRTRSGG

SEQ ID NO: 411540 - protein, 11 aa, Influenza virus
AIRTRSGGNNN

SEQ ID NO: 411541 - protein, 11 aa, Influenza virus
IRTRSGGNNNQ

SEQ ID NO: 411542 - protein, 11 aa, Influenza virus
SIQPTFSVQRN

SEQ ID NO: 411543 - protein, 11 aa, Influenza virus
IQPTFSVQRNL

SEQ ID NO: 411544 - protein, 11 aa, Influenza virus
QPTFSVQRSLP

SEQ ID NO: 411545 - protein, 11 aa, Influenza virus
PTFSVQRSLPF

SEQ ID NO: 411546 - protein, 11 aa, Influenza virus
TFSVQRSLPFE

SEQ ID NO: 411547 - protein, 11 aa, Influenza virus
FSVQRNLPFDK

SEQ ID NO: 411548 - protein, 11 aa, Influenza virus
EGRTSDMRTEV

SEQ ID NO: 411549 - protein, 11 aa, Influenza virus
GRTSDMRTEVI

SEQ ID NO: 411550 - protein, 11 aa, Influenza virus
EVSFRGRGVFE

SEQ ID NO: 411551 - protein, 11 aa, Influenza virus
VSFRGRGVFEL

SEQ ID NO: 411552 - protein, 11 aa, Influenza virus
SFQGRGVFEFS

SEQ ID NO: 411553 - protein, 11 aa, Influenza virus
FQGRGVFEFSD

SEQ ID NO: 411554 - protein, 11 aa, Influenza virus
QGRGVFEFSDE

SEQ ID NO: 411555 - protein, 11 aa, Influenza virus
GRGVFEFSDER

SEQ ID NO: 411556 - protein, 11 aa, Influenza virus
RGVFEFSDERA

SEQ ID NO: 411557 - protein, 11 aa, Influenza virus
GVFELSDEKAA

SEQ ID NO: 411558 - protein, 11 aa, Influenza virus
MSKEGSYFFGD

SEQ ID NO: 411559 - protein, 11 aa, Influenza virus
SKEGSYFFGDN

SEQ ID NO: 411560 - protein, 11 aa, Influenza virus
NEGSYFFGDSA

SEQ ID NO: 411561 - protein, 11 aa, Influenza virus
EGSYFFGDNAK

SEQ ID NO: 411562 - protein, 11 aa, Influenza virus
GSYFFGDSAEE

SEQ ID NO: 411563 - protein, 11 aa, Influenza virus
SYFFGDSAEEY

SEQ ID NO: 411564 - protein, 11 aa, Influenza virus
FQVDCYLWHIR

SEQ ID NO: 411565 - protein, 11 aa, Influenza virus
CDAPFDDRLRR

SEQ ID NO: 411566 - protein, 11 aa, Influenza virus
DAPFLDRIRRD

SEQ ID NO: 411567 - protein, 11 aa, Influenza virus
APFLDRIRRDQ

SEQ ID NO: 411568 - protein, 11 aa, Influenza virus
LKMPASRYLTD

SEQ ID NO: 411569 - protein, 11 aa, Influenza virus
SVPASRYLTDM

SEQ ID NO: 411570 - protein, 11 aa, Influenza virus
VPASRYLTDMT

SEQ ID NO: 411571 - protein, 11 aa, Influenza virus
PASRYLIDMTL

SEQ ID NO: 411572 - protein, 11 aa, Influenza virus
EEVRHRLKITE

SEQ ID NO: 411573 - protein, 11 aa, Influenza virus
TESSFEQITFM

SEQ ID NO: 411574 - protein, 11 aa, Influenza virus
ESSFEQITFMQ

SEQ ID NO: 411575 - protein, 11 aa, Influenza virus
SSFEQITFMQA

SEQ ID NO: 411576 - protein, 11 aa, Influenza virus
SFEQITFIQAL

SEQ ID NO: 411577 - protein, 11 aa, Influenza virus
FEQITFIQALQ

SEQ ID NO: 411578 - protein, 11 aa, Influenza virus
EQITFIQALQL

SEQ ID NO: 411579 - protein, 11 aa, Influenza virus
QITFIQALQLL

SEQ ID NO: 411580 - protein, 11 aa, Influenza virus
ITFLQALQLLL

SEQ ID NO: 411581 - protein, 11 aa, Influenza virus
TFLQALQLLLE

SEQ ID NO: 411582 - protein, 11 aa, Influenza virus
FLQALQLLLEV

SEQ ID NO: 411583 - protein, 11 aa, Influenza virus
LQALQLLLEVE

SEQ ID NO: 411584 - protein, 11 aa, Influenza virus
QALQLLLEVES

SEQ ID NO: 411585 - protein, 11 aa, Influenza virus
ALQLLLEVESE

SEQ ID NO: 411586 - protein, 11 aa, Influenza virus
IRTFSFQLINN

SEQ ID NO: 411587 - protein, 11 aa, Influenza virus
MEGFVRQCFNP

SEQ ID NO: 411588 - protein, 11 aa, Influenza virus
RQCFNPMVVEL

SEQ ID NO: 411589 - protein, 11 aa, Influenza virus
QCFNPMVVELA

SEQ ID NO: 411590 - protein, 11 aa, Influenza virus
CFNPMVVELAE

SEQ ID NO: 411591 - protein, 11 aa, Influenza virus
ELAEKAMKEHG

SEQ ID NO: 411592 - protein, 11 aa, Influenza virus
LAEKAMKEHGE

SEQ ID NO: 411593 - protein, 11 aa, Influenza virus
ETNKFASICTH

SEQ ID NO: 411594 - protein, 11 aa, Influenza virus
TNKLAAICTHL

SEQ ID NO: 411595 - protein, 11 aa, Influenza virus
NKLAAICTHLE

SEQ ID NO: 411596 - protein, 11 aa, Influenza virus
AAICTHLEICF

SEQ ID NO: 411597 - protein, 11 aa, Influenza virus
AICTHLEICFM

SEQ ID NO: 411598 - protein, 11 aa, Influenza virus
ICTHLEICFMY

SEQ ID NO: 411599 - protein, 11 aa, Influenza virus
CTHLEICFMYS

SEQ ID NO: 411600 - protein, 11 aa, Influenza virus
THLEICFMYSD

SEQ ID NO: 411601 - protein, 11 aa, Influenza virus
HLEICFMYSDF

SEQ ID NO: 411602 - protein, 11 aa, Influenza virus
LEICFMYSDFH

SEQ ID NO: 411603 - protein, 11 aa, Influenza virus
MYSDFHFINER

SEQ ID NO: 411604 - protein, 11 aa, Influenza virus
DPNVLLKHRFE

SEQ ID NO: 411605 - protein, 11 aa, Influenza virus
PNVLLKHRFEI

SEQ ID NO: 411606 - protein, 11 aa, Influenza virus
NTLLKHRFEII

SEQ ID NO: 411607 - protein, 11 aa, Influenza virus
TLLKHRFEIIE

SEQ ID NO: 411608 - protein, 11 aa, Influenza virus
RFEIIEGRDRN

SEQ ID NO: 411609 - protein, 11 aa, Influenza virus
KPRYLPDLYDY

SEQ ID NO: 411610 - protein, 11 aa, Influenza virus
PRYLPDLYDYK

SEQ ID NO: 411611 - protein, 11 aa, Influenza virus
LPDLYDYKESR

SEQ ID NO: 411612 - protein, 11 aa, Influenza virus
PDLYDYKESRF

SEQ ID NO: 411613 - protein, 11 aa, Influenza virus
RFLEIGVTRRE

SEQ ID NO: 411614 - protein, 11 aa, Influenza virus
IGVTRREVHVY

SEQ ID NO: 411615 - protein, 11 aa, Influenza virus
GVTRREVHVYY

SEQ ID NO: 411616 - protein, 11 aa, Influenza virus
VTRREVHVYYL

SEQ ID NO: 411617 - protein, 11 aa, Influenza virus
TRREVHVYYLE

SEQ ID NO: 411618 - protein, 11 aa, Influenza virus
RREVHVYYLEK

SEQ ID NO: 411619 - protein, 11 aa, Influenza virus
YYLEKASKIKS

SEQ ID NO: 411620 - protein, 11 aa, Influenza virus
IFSFTGEEMAS

SEQ ID NO: 411621 - protein, 11 aa, Influenza virus
FSFNGEEMATK

SEQ ID NO: 411622 - protein, 11 aa, Influenza virus
EYTLDEESRAR

SEQ ID NO: 411623 - protein, 11 aa, Influenza virus
YILDEESRARI

SEQ ID NO: 411624 - protein, 11 aa, Influenza virus
RLFTIRQEMAI

SEQ ID NO: 411625 - protein, 11 aa, Influenza virus
KGLWDSFRQSE

SEQ ID NO: 411626 - protein, 11 aa, Influenza virus
GLWDPFRQSER

SEQ ID NO: 411627 - protein, 11 aa, Influenza virus
FRQSERGEETV

SEQ ID NO: 411628 - protein, 11 aa, Influenza virus
RQSERGEETVE

SEQ ID NO: 411629 - protein, 11 aa, Influenza virus
QSERGEETVEE

SEQ ID NO: 411630 - protein, 11 aa, Influenza virus
SERGEDTIEER

SEQ ID NO: 411631 - protein, 11 aa, Influenza virus
ERGEDTIEERF

SEQ ID NO: 411632 - protein, 11 aa, Influenza virus
RGEDTIEERFE

SEQ ID NO: 411633 - protein, 11 aa, Influenza virus
GEDTIEERFEI

SEQ ID NO: 411634 - protein, 11 aa, Influenza virus
LANYSLPPNFS

SEQ ID NO: 411635 - protein, 11 aa, Influenza virus
FRVYVDGFEPN

SEQ ID NO: 411636 - protein, 11 aa, Influenza virus
YVDGFKPNGCI

SEQ ID NO: 411637 - protein, 11 aa, Influenza virus
VDGFKPNGCIE

SEQ ID NO: 411638 - protein, 11 aa, Influenza virus
FKPNGCIEGKL

SEQ ID NO: 411639 - protein, 11 aa, Influenza virus
PNGCIESKLSQ

SEQ ID NO: 411640 - protein, 11 aa, Influenza virus
NGCIESKLSQM

SEQ ID NO: 411641 - protein, 11 aa, Influenza virus
GCIESKLSQMS

SEQ ID NO: 411642 - protein, 11 aa, Influenza virus
YIEGKLSQMSR

SEQ ID NO: 411643 - protein, 11 aa, Influenza virus
CYQRSKFLLMD

SEQ ID NO: 411644 - protein, 11 aa, Influenza virus
LMDALKLSIEN

SEQ ID NO: 411645 - protein, 11 aa, Influenza virus
KLSIEDPDHEG

SEQ ID NO: 411646 - protein, 11 aa, Influenza virus
LSIEDPDHEGE

SEQ ID NO: 411647 - protein, 11 aa, Influenza virus
SIEDPDHEGEG

SEQ ID NO: 411648 - protein, 11 aa, Influenza virus
IEDPDHEGEGI

SEQ ID NO: 411649 - protein, 11 aa, Influenza virus
EDPDHEGEGIP

SEQ ID NO: 411650 - protein, 11 aa, Influenza virus
DPDHEGEGIPL

SEQ ID NO: 411651 - protein, 11 aa, Influenza virus
PDHEGEGIPLY

SEQ ID NO: 411652 - protein, 11 aa, Influenza virus
DHEGEGIPLYD

SEQ ID NO: 411653 - protein, 11 aa, Influenza virus
EGEGIPLHDAI

SEQ ID NO: 411654 - protein, 11 aa, Influenza virus
GEGIPLHDAIK

SEQ ID NO: 411655 - protein, 11 aa, Influenza virus
EGIPLHDAIKC

SEQ ID NO: 411656 - protein, 11 aa, Influenza virus
LKWVLGENMAP

SEQ ID NO: 411657 - protein, 11 aa, Influenza virus
KWVLGENMAPE

SEQ ID NO: 411658 - protein, 11 aa, Influenza virus
WTLGENMAPEK

SEQ ID NO: 411659 - protein, 11 aa, Influenza virus
LGENMAPEKID

SEQ ID NO: 411660 - protein, 11 aa, Influenza virus
GENMAPEKIDF

SEQ ID NO: 411661 - protein, 11 aa, Influenza virus
WVQNEFNKACE

SEQ ID NO: 411662 - protein, 11 aa, Influenza virus
VQNEFNKACEL

SEQ ID NO: 411663 - protein, 11 aa, Influenza virus
SEFNKACELTG

SEQ ID NO: 411664 - protein, 11 aa, Influenza virus
FNKACELTDSV

SEQ ID NO: 411665 - protein, 11 aa, Influenza virus
NKACELTDSVW

SEQ ID NO: 411666 - protein, 11 aa, Influenza virus
ELDEIGEDLAP

SEQ ID NO: 411667 - protein, 11 aa, Influenza virus
LDEIGEDLAPI

SEQ ID NO: 411668 - protein, 11 aa, Influenza virus
DEIGEDLAPIE

SEQ ID NO: 411669 - protein, 11 aa, Influenza virus
EIGEDIAPIEH

SEQ ID NO: 411670 - protein, 11 aa, Influenza virus
APIEYVASMRR

SEQ ID NO: 411671 - protein, 11 aa, Influenza virus
YFTAEVSYCRA

SEQ ID NO: 411672 - protein, 11 aa, Influenza virus
FTAEVSYCRAT

SEQ ID NO: 411673 - protein, 11 aa, Influenza virus
TAEVSYCRATE

SEQ ID NO: 411674 - protein, 11 aa, Influenza virus
AEVSYCRATEY

SEQ ID NO: 411675 - protein, 11 aa, Influenza virus
EVSYCRATEYI

SEQ ID NO: 411676 - protein, 11 aa, Influenza virus
VSYCRATEYIM

SEQ ID NO: 411677 - protein, 11 aa, Influenza virus
SHCRATEYMMK

SEQ ID NO: 411678 - protein, 11 aa, Influenza virus
HCRATEYMMKG

SEQ ID NO: 411679 - protein, 11 aa, Influenza virus
RATEYIIKGVY

SEQ ID NO: 411680 - protein, 11 aa, Influenza virus
KGVYMNTALLN

SEQ ID NO: 411681 - protein, 11 aa, Influenza virus
GVYMNTALLNA

SEQ ID NO: 411682 - protein, 11 aa, Influenza virus
VYMNTALLNAS

SEQ ID NO: 411683 - protein, 11 aa, Influenza virus
YMNTALLNASC

SEQ ID NO: 411684 - protein, 11 aa, Influenza virus
MNTALLNASCA

SEQ ID NO: 411685 - protein, 11 aa, Influenza virus
ALLNASCAAME

SEQ ID NO: 411686 - protein, 11 aa, Influenza virus
MLNASCAAMDD

SEQ ID NO: 411687 - protein, 11 aa, Influenza virus
LNASCAAMEDF

SEQ ID NO: 411688 - protein, 11 aa, Influenza virus
NASCAAMEDFQ

SEQ ID NO: 411689 - protein, 11 aa, Influenza virus
ASCAAMEDFQL

SEQ ID NO: 411690 - protein, 11 aa, Influenza virus
SCAAMEDFQLI

SEQ ID NO: 411691 - protein, 11 aa, Influenza virus
CAAMEDFQLIP

SEQ ID NO: 411692 - protein, 11 aa, Influenza virus
AAMEDFQLIPM

SEQ ID NO: 411693 - protein, 11 aa, Influenza virus
AMEDFQLIPMI

SEQ ID NO: 411694 - protein, 11 aa, Influenza virus
MEDFQLIPMIS

SEQ ID NO: 411695 - protein, 11 aa, Influenza virus
EDFQLIPMISK

SEQ ID NO: 411696 - protein, 11 aa, Influenza virus
DFQLIPMISKS

SEQ ID NO: 411697 - protein, 11 aa, Influenza virus
FQLIPMISKSR

SEQ ID NO: 411698 - protein, 11 aa, Influenza virus
QLIPMISKSRT

SEQ ID NO: 411699 - protein, 11 aa, Influenza virus
LIPMISKCKTK

SEQ ID NO: 411700 - protein, 11 aa, Influenza virus
IPMISKCKTKE

SEQ ID NO: 411701 - protein, 11 aa, Influenza virus
PMISKCKTKEG

SEQ ID NO: 411702 - protein, 11 aa, Influenza virus
MISKCKTKEGR

SEQ ID NO: 411703 - protein, 11 aa, Influenza virus
ISKCKTKEGRR

SEQ ID NO: 411704 - protein, 11 aa, Influenza virus
SKCRTKEGRRR

SEQ ID NO: 411705 - protein, 11 aa, Influenza virus
KCRTKEGRRRT

SEQ ID NO: 411706 - protein, 11 aa, Influenza virus
CRTKEGRRRTN

SEQ ID NO: 411707 - protein, 11 aa, Influenza virus
RTKEGRRRTNL

SEQ ID NO: 411708 - protein, 11 aa, Influenza virus
TKEGRRRTNLY

SEQ ID NO: 411709 - protein, 11 aa, Influenza virus
KEGRRRTNLYG

SEQ ID NO: 411710 - protein, 11 aa, Influenza virus
RRRTNLYGFII

SEQ ID NO: 411711 - protein, 11 aa, Influenza virus
RRTNLYGFIIK

SEQ ID NO: 411712 - protein, 11 aa, Influenza virus
RTNLYGFIIKG

SEQ ID NO: 411713 - protein, 11 aa, Influenza virus
LRNDTDVVNFL

SEQ ID NO: 411714 - protein, 11 aa, Influenza virus
RNDTDVVNFLS

SEQ ID NO: 411715 - protein, 11 aa, Influenza virus
NDTDVVNFLSM

SEQ ID NO: 411716 - protein, 11 aa, Influenza virus
DTDVVNFLSME

SEQ ID NO: 411717 - protein, 11 aa, Influenza virus
TDVVNFLSMEF

SEQ ID NO: 411718 - protein, 11 aa, Influenza virus
DVVNFLSMEFS

SEQ ID NO: 411719 - protein, 11 aa, Influenza virus
VVNFLSMEFSL

SEQ ID NO: 411720 - protein, 11 aa, Influenza virus
VNFLSMEFSLT

SEQ ID NO: 411721 - protein, 11 aa, Influenza virus
NFLSMEFSLTD

SEQ ID NO: 411722 - protein, 11 aa, Influenza virus
FLSMEFSLTDP

SEQ ID NO: 411723 - protein, 11 aa, Influenza virus
VSMEFSLTDPK

SEQ ID NO: 411724 - protein, 11 aa, Influenza virus
SMEFSLTDPKL

SEQ ID NO: 411725 - protein, 11 aa, Influenza virus
MEFSLTDPKLE

SEQ ID NO: 411726 - protein, 11 aa, Influenza virus
IFLYVRTNGTS

SEQ ID NO: 411727 - protein, 11 aa, Influenza virus
LYIRTNGTSKI

SEQ ID NO: 411728 - protein, 11 aa, Influenza virus
YIRTNGTSKIK

SEQ ID NO: 411729 - protein, 11 aa, Influenza virus
IRTNGTSKIKM

SEQ ID NO: 411730 - protein, 11 aa, Influenza virus
SKIKMKWGMEL

SEQ ID NO: 411731 - protein, 11 aa, Influenza virus
KIKMKWGMELR

SEQ ID NO: 411732 - protein, 11 aa, Influenza virus
IKMKWGMELRR

SEQ ID NO: 411733 - protein, 11 aa, Influenza virus
LQSLQQIESII

SEQ ID NO: 411734 - protein, 11 aa, Influenza virus
QSLQQIESIIE

SEQ ID NO: 411735 - protein, 11 aa, Influenza virus
SLQQIESIIEA

SEQ ID NO: 411736 - protein, 11 aa, Influenza virus
LQQIESIIEAE

SEQ ID NO: 411737 - protein, 11 aa, Influenza virus
QQIESIIEAES

SEQ ID NO: 411738 - protein, 11 aa, Influenza virus
QIESIIEAESS

SEQ ID NO: 411739 - protein, 11 aa, Influenza virus
IESMVEAESSV

SEQ ID NO: 411740 - protein, 11 aa, Influenza virus
ESMVEAESSVK

SEQ ID NO: 411741 - protein, 11 aa, Influenza virus
MVEAESSVKEK

SEQ ID NO: 411742 - protein, 11 aa, Influenza virus
VEAESSVKEKD

SEQ ID NO: 411743 - protein, 11 aa, Influenza virus
EAESSVREKDM

SEQ ID NO: 411744 - protein, 11 aa, Influenza virus
AESSVREKDMT

SEQ ID NO: 411745 - protein, 11 aa, Influenza virus
ESSVKEKDMTR

SEQ ID NO: 411746 - protein, 11 aa, Influenza virus
VEDGSIGKVCR

SEQ ID NO: 411747 - protein, 11 aa, Influenza virus
EDGSIGKVCRT

SEQ ID NO: 411748 - protein, 11 aa, Influenza virus
DGSIGKVCRTL

SEQ ID NO: 411749 - protein, 11 aa, Influenza virus
GSIGKVCRALL

SEQ ID NO: 411750 - protein, 11 aa, Influenza virus
RTLLAKSVFNN

SEQ ID NO: 411751 - protein, 11 aa, Influenza virus
TLLAKSVFNNL

SEQ ID NO: 411752 - protein, 11 aa, Influenza virus
LLAKSVFNNLY

SEQ ID NO: 411753 - protein, 11 aa, Influenza virus
LAKSVFNNLYA

SEQ ID NO: 411754 - protein, 11 aa, Influenza virus
AKSVFNNLYAS

SEQ ID NO: 411755 - protein, 11 aa, Influenza virus
FNCLYASPQLE

SEQ ID NO: 411756 - protein, 11 aa, Influenza virus
NCLYASPQLEG

SEQ ID NO: 411757 - protein, 11 aa, Influenza virus
CLYASPQLEGF

SEQ ID NO: 411758 - protein, 11 aa, Influenza virus
LYSSPQLEGFS

SEQ ID NO: 411759 - protein, 11 aa, Influenza virus
YSSPQLEGFSA

SEQ ID NO: 411760 - protein, 11 aa, Influenza virus
FSAESRKMLLI

SEQ ID NO: 411761 - protein, 11 aa, Influenza virus
AESRKLLLIAQ

SEQ ID NO: 411762 - protein, 11 aa, Influenza virus
ESRKLLLIAQA

SEQ ID NO: 411763 - protein, 11 aa, Influenza virus
QAFRDNLEPGT

SEQ ID NO: 411764 - protein, 11 aa, Influenza virus
AFRDNLEPGTF

SEQ ID NO: 411765 - protein, 11 aa, Influenza virus
FRDNLEPGTFD

SEQ ID NO: 411766 - protein, 11 aa, Influenza virus
RDSLEPGTFDL

SEQ ID NO: 411767 - protein, 11 aa, Influenza virus
LEPGTFDIGGL

SEQ ID NO: 411768 - protein, 11 aa, Influenza virus
EPGTFDIGGLY

SEQ ID NO: 411769 - protein, 11 aa, Influenza virus
GLYDAIEECLI

SEQ ID NO: 411770 - protein, 11 aa, Influenza virus
LYDAIEECLIN

SEQ ID NO: 411771 - protein, 11 aa, Influenza virus
YDAIEECLIND

SEQ ID NO: 411772 - protein, 11 aa, Influenza virus
DAIEECLINDP

SEQ ID NO: 411773 - protein, 11 aa, Influenza virus
AVEECLINDPW

SEQ ID NO: 411774 - protein, 11 aa, Influenza virus
LNASWFNSFLV

SEQ ID NO: 411775 - protein, 11 aa, Influenza virus
NASWFNSFLVH

SEQ ID NO: 411776 - protein, 11 aa, Influenza virus
FNSFLVHALKS

SEQ ID NO: 411777 - protein, 11 aa, Influenza virus
NSFLTHALRFL

SEQ ID NO: 411778 - protein, 11 aa, Influenza virus
PAQNAISITFP

SEQ ID NO: 411779 - protein, 11 aa, Influenza virus
AQNAISITFPY

SEQ ID NO: 411780 - protein, 11 aa, Influenza virus
TVSRTHQYSEK

SEQ ID NO: 411781 - protein, 11 aa, Influenza virus
VSRTHQYSEKG

SEQ ID NO: 411782 - protein, 11 aa, Influenza virus
NRTHQYSERGK

SEQ ID NO: 411783 - protein, 11 aa, Influenza virus
RTHQYSERGKW

SEQ ID NO: 411784 - protein, 11 aa, Influenza virus
ETKAPQLNPID

SEQ ID NO: 411785 - protein, 11 aa, Influenza virus
TKAPQLNPIDG

SEQ ID NO: 411786 - protein, 11 aa, Influenza virus
GALQLNPIDGP

SEQ ID NO: 411787 - protein, 11 aa, Influenza virus
QLNPIDGPLPD

SEQ ID NO: 411788 - protein, 11 aa, Influenza virus
NDPSGYAQTDC

SEQ ID NO: 411789 - protein, 11 aa, Influenza virus
DPSGYAQTDCV

SEQ ID NO: 411790 - protein, 11 aa, Influenza virus
CVLEAMAFLEN

SEQ ID NO: 411791 - protein, 11 aa, Influenza virus
VLEAMAFLENS

SEQ ID NO: 411792 - protein, 11 aa, Influenza virus
EAMAFLENSHP

SEQ ID NO: 411793 - protein, 11 aa, Influenza virus
SHPGLFENSCL

SEQ ID NO: 411794 - protein, 11 aa, Influenza virus
HPGLFENSCLE

SEQ ID NO: 411795 - protein, 11 aa, Influenza virus
VQQTRVDRLTQ

SEQ ID NO: 411796 - protein, 11 aa, Influenza virus
VDRLTQGRQTY

SEQ ID NO: 411797 - protein, 11 aa, Influenza virus
DRLTQGRQTYD

SEQ ID NO: 411798 - protein, 11 aa, Influenza virus
RLTQGRQTYDW

SEQ ID NO: 411799 - protein, 11 aa, Influenza virus
ALANTIEVFRL

SEQ ID NO: 411800 - protein, 11 aa, Influenza virus
LANTIEVFRLN

SEQ ID NO: 411801 - protein, 11 aa, Influenza virus
NESGRLMDFLK

SEQ ID NO: 411802 - protein, 11 aa, Influenza virus
GRLIDFLKDVV

SEQ ID NO: 411803 - protein, 11 aa, Influenza virus
THFHRKRRVRD

SEQ ID NO: 411804 - protein, 11 aa, Influenza virus
HFHRKRRVRDN

SEQ ID NO: 411805 - protein, 11 aa, Influenza virus
NYLIRALTLNT

SEQ ID NO: 411806 - protein, 11 aa, Influenza virus
YIIRALTLNTM

SEQ ID NO: 411807 - protein, 11 aa, Influenza virus
IIRALTLNTMT

SEQ ID NO: 411808 - protein, 11 aa, Influenza virus
QIRGFVHFVEA

SEQ ID NO: 411809 - protein, 11 aa, Influenza virus
IRGFVHFVEAL

SEQ ID NO: 411810 - protein, 11 aa, Influenza virus
RGFVHFVEALA

SEQ ID NO: 411811 - protein, 11 aa, Influenza virus
LARCICEKLEQ

SEQ ID NO: 411812 - protein, 11 aa, Influenza virus
ARCICEKLEQS

SEQ ID NO: 411813 - protein, 11 aa, Influenza virus
RCICEKLEQSG

SEQ ID NO: 411814 - protein, 11 aa, Influenza virus
CICEKLEQSGL

SEQ ID NO: 411815 - protein, 11 aa, Influenza virus
NVVRKMMTNSH

SEQ ID NO: 411816 - protein, 11 aa, Influenza virus
VVRKMMTNSRD

SEQ ID NO: 411817 - protein, 11 aa, Influenza virus
VRKMMTNSRDT

SEQ ID NO: 411818 - protein, 11 aa, Influenza virus
RKMMTNSRDTE

SEQ ID NO: 411819 - protein, 11 aa, Influenza virus
SQDTELSFTVT

SEQ ID NO: 411820 - protein, 11 aa, Influenza virus
QDTELSFTVTG

SEQ ID NO: 411821 - protein, 11 aa, Influenza virus
DTELSFTVTGD

SEQ ID NO: 411822 - protein, 11 aa, Influenza virus
TELSFTVTGDN

SEQ ID NO: 411823 - protein, 11 aa, Influenza virus
ELSFTVTGDNT

SEQ ID NO: 411824 - protein, 11 aa, Influenza virus
LSFTVTGDNTK

SEQ ID NO: 411825 - protein, 11 aa, Influenza virus
TKWNENQNPRI

SEQ ID NO: 411826 - protein, 11 aa, Influenza virus
KWNENQNPRIF

SEQ ID NO: 411827 - protein, 11 aa, Influenza virus
WNENQNPRIFL

SEQ ID NO: 411828 - protein, 11 aa, Influenza virus
NENQNPRVFLA

SEQ ID NO: 411829 - protein, 11 aa, Influenza virus
ENQNPRVFLAM

SEQ ID NO: 411830 - protein, 11 aa, Influenza virus
NQNPRVFLAMI

SEQ ID NO: 411831 - protein, 11 aa, Influenza virus
QNPRVFLAMIT

SEQ ID NO: 411832 - protein, 11 aa, Influenza virus
NPRVFLAMITY

SEQ ID NO: 411833 - protein, 11 aa, Influenza virus
PRVFLAMITYI

SEQ ID NO: 411834 - protein, 11 aa, Influenza virus
RVFLAMITYIT

SEQ ID NO: 411835 - protein, 11 aa, Influenza virus
WFRNILSIAPI

SEQ ID NO: 411836 - protein, 11 aa, Influenza virus
FRNILSIAPIM

SEQ ID NO: 411837 - protein, 11 aa, Influenza virus
RNILSIAPIMF

SEQ ID NO: 411838 - protein, 11 aa, Influenza virus
NILSIAPIMFS

SEQ ID NO: 411839 - protein, 11 aa, Influenza virus
ILSIAPIMFSN

SEQ ID NO: 411840 - protein, 11 aa, Influenza virus
LSVAPIMFSNK

SEQ ID NO: 411841 - protein, 11 aa, Influenza virus
SVAPIMFSNKM

SEQ ID NO: 411842 - protein, 11 aa, Influenza virus
VAPIMFSNKMA

SEQ ID NO: 411843 - protein, 11 aa, Influenza virus
APIMFSNKMAK

SEQ ID NO: 411844 - protein, 11 aa, Influenza virus
PIMFSNKMAKL

SEQ ID NO: 411845 - protein, 11 aa, Influenza virus
IMFSNKMAKLG

SEQ ID NO: 411846 - protein, 11 aa, Influenza virus
MFSNKVARLGK

SEQ ID NO: 411847 - protein, 11 aa, Influenza virus
FSNKVARLGKG

SEQ ID NO: 411848 - protein, 11 aa, Influenza virus
SNKVARLGKGY

SEQ ID NO: 411849 - protein, 11 aa, Influenza virus
NKVARLGKGYM

SEQ ID NO: 411850 - protein, 11 aa, Influenza virus
KVARLGKGYMF

SEQ ID NO: 411851 - protein, 11 aa, Influenza virus
VARLGKGYMFE

SEQ ID NO: 411852 - protein, 11 aa, Influenza virus
GTVSLSPGMMM

SEQ ID NO: 411853 - protein, 11 aa, Influenza virus
TVSLSPGMMMG

SEQ ID NO: 411854 - protein, 11 aa, Influenza virus
LGVSVLNLGQK

SEQ ID NO: 411855 - protein, 11 aa, Influenza virus
TSYWWDGLQSS

SEQ ID NO: 411856 - protein, 11 aa, Influenza virus
SYWWDGLQSSD

SEQ ID NO: 411857 - protein, 11 aa, Influenza virus
SDDFALIVNAL

SEQ ID NO: 411858 - protein, 11 aa, Influenza virus
GVQAGVDRFYR

SEQ ID NO: 411859 - protein, 11 aa, Influenza virus
IQAGVNRFYRT

SEQ ID NO: 411860 - protein, 11 aa, Influenza virus
QAGVNRFYRTC

SEQ ID NO: 411861 - protein, 11 aa, Influenza virus
AGVNRFYRTCK

SEQ ID NO: 411862 - protein, 11 aa, Influenza virus
GVNRFYRTCKL

SEQ ID NO: 411863 - protein, 11 aa, Influenza virus
DRFYRICKLVG

SEQ ID NO: 411864 - protein, 11 aa, Influenza virus
RFYRICKLVGI

SEQ ID NO: 411865 - protein, 11 aa, Influenza virus
FYRICKLVGIN

SEQ ID NO: 411866 - protein, 11 aa, Influenza virus
YRICKLVGINM

SEQ ID NO: 411867 - protein, 11 aa, Influenza virus
RICKLVGINMS

SEQ ID NO: 411868 - protein, 11 aa, Influenza virus
ICKLVGINMSK

SEQ ID NO: 411869 - protein, 11 aa, Influenza virus
CKLVGINMSKR

SEQ ID NO: 411870 - protein, 11 aa, Influenza virus
KLVGINMSKRK

SEQ ID NO: 411871 - protein, 11 aa, Influenza virus
LVGINMSKRKS

SEQ ID NO: 411872 - protein, 11 aa, Influenza virus
VGINMSKRKSY

SEQ ID NO: 411873 - protein, 11 aa, Influenza virus
NMSKRKSYINK

SEQ ID NO: 411874 - protein, 11 aa, Influenza virus
MSKRKSYINKT

SEQ ID NO: 411875 - protein, 11 aa, Influenza virus
SKRKSYINKTG

SEQ ID NO: 411876 - protein, 11 aa, Influenza virus
INESADMSIGI

SEQ ID NO: 411877 - protein, 11 aa, Influenza virus
ESADMSIGVAV

SEQ ID NO: 411878 - protein, 11 aa, Influenza virus
SADMSIGVAVI

SEQ ID NO: 411879 - protein, 11 aa, Influenza virus
ADMSIGVTVIR

SEQ ID NO: 411880 - protein, 11 aa, Influenza virus
DMSIGVTVIRN

SEQ ID NO: 411881 - protein, 11 aa, Influenza virus
MSIGVTVIRNN

SEQ ID NO: 411882 - protein, 11 aa, Influenza virus
SIGVTVIRNNM

SEQ ID NO: 411883 - protein, 11 aa, Influenza virus
IGVTVIRNNMI

SEQ ID NO: 411884 - protein, 11 aa, Influenza virus
GVTVIRNNMIN

SEQ ID NO: 411885 - protein, 11 aa, Influenza virus
TVIKNNMVNND

SEQ ID NO: 411886 - protein, 11 aa, Influenza virus
VIKNNMVNNDL

SEQ ID NO: 411887 - protein, 11 aa, Influenza virus
IKNNMVNNDLG

SEQ ID NO: 411888 - protein, 11 aa, Influenza virus
RYTYRCHRGDM

SEQ ID NO: 411889 - protein, 11 aa, Influenza virus
YTYRCHRGDMQ

SEQ ID NO: 411890 - protein, 11 aa, Influenza virus
GLLVADGGPNL

SEQ ID NO: 411891 - protein, 11 aa, Influenza virus
LLVADGGPNLY

SEQ ID NO: 411892 - protein, 11 aa, Influenza virus
LVADGGPNLYN

SEQ ID NO: 411893 - protein, 11 aa, Influenza virus
VADGGPNLYNI

SEQ ID NO: 411894 - protein, 11 aa, Influenza virus
LHIPEAGLKWE

SEQ ID NO: 411895 - protein, 11 aa, Influenza virus
HIPEAGLKWEL

SEQ ID NO: 411896 - protein, 11 aa, Influenza virus
IPEAGLKWELM

SEQ ID NO: 411897 - protein, 11 aa, Influenza virus
PEAGLKWELMD

SEQ ID NO: 411898 - protein, 11 aa, Influenza virus
YKGRLCNPLNP

SEQ ID NO: 411899 - protein, 11 aa, Influenza virus
KGRLCNPLNPF

SEQ ID NO: 411900 - protein, 11 aa, Influenza virus
RLCNPLNPFVT

SEQ ID NO: 411901 - protein, 11 aa, Influenza virus
LCNPLNPFVTH

SEQ ID NO: 411902 - protein, 11 aa, Influenza virus
VEYDAVATTHS

SEQ ID NO: 411903 - protein, 11 aa, Influenza virus
YDAVATTHSWT

SEQ ID NO: 411904 - protein, 11 aa, Influenza virus
DAVATTHSWTP

SEQ ID NO: 411905 - protein, 11 aa, Influenza virus
AVATTHSWTPK

SEQ ID NO: 411906 - protein, 11 aa, Influenza virus
VATTHSWTPKR

SEQ ID NO: 411907 - protein, 11 aa, Influenza virus
ATTHSWTPKRN

SEQ ID NO: 411908 - protein, 11 aa, Influenza virus
TTHSWTPKRNR

SEQ ID NO: 411909 - protein, 11 aa, Influenza virus
THSWTPKRNRS

SEQ ID NO: 411910 - protein, 11 aa, Influenza virus
HSWTPKRNRSI

SEQ ID NO: 411911 - protein, 11 aa, Influenza virus
SWTPKRNRSIL

SEQ ID NO: 411912 - protein, 11 aa, Influenza virus
WTPKRNRSILN

SEQ ID NO: 411913 - protein, 11 aa, Influenza virus
TPKRNRSILNT

SEQ ID NO: 411914 - protein, 11 aa, Influenza virus
TNQRGILEDEQ

SEQ ID NO: 411915 - protein, 11 aa, Influenza virus
NQRGILEDEQM

SEQ ID NO: 411916 - protein, 11 aa, Influenza virus
QKGILEDEQMY

SEQ ID NO: 411917 - protein, 11 aa, Influenza virus
KGILEDEQMYQ

SEQ ID NO: 411918 - protein, 11 aa, Influenza virus
GVLEDEQMYQK

SEQ ID NO: 411919 - protein, 11 aa, Influenza virus
VLEDEQMYQKC

SEQ ID NO: 411920 - protein, 11 aa, Influenza virus
EDEQMYQKCCS

SEQ ID NO: 411921 - protein, 11 aa, Influenza virus
DEQMYQKCCSL

SEQ ID NO: 411922 - protein, 11 aa, Influenza virus
EQMYQKCCSLF

SEQ ID NO: 411923 - protein, 11 aa, Influenza virus
MYQKCCSLFEK

SEQ ID NO: 411924 - protein, 11 aa, Influenza virus
YQKCCSLFEKF

SEQ ID NO: 411925 - protein, 11 aa, Influenza virus
QKCCSLFEKFF

SEQ ID NO: 411926 - protein, 11 aa, Influenza virus
KCCSLFEKFFP

SEQ ID NO: 411927 - protein, 11 aa, Influenza virus
CCTLFEKFFPS

SEQ ID NO: 411928 - protein, 11 aa, Influenza virus
CTLFEKFFPSS

SEQ ID NO: 411929 - protein, 11 aa, Influenza virus
TLFEKFFPSSS

SEQ ID NO: 411930 - protein, 11 aa, Influenza virus
YRRPVGISSMG

SEQ ID NO: 411931 - protein, 11 aa, Influenza virus
RRPVGISSMGE

SEQ ID NO: 411932 - protein, 11 aa, Influenza virus
RPVGISSMGEA

SEQ ID NO: 411933 - protein, 11 aa, Influenza virus
PVGISSMGEAM

SEQ ID NO: 411934 - protein, 11 aa, Influenza virus
GISSMGEAMVS

SEQ ID NO: 411935 - protein, 11 aa, Influenza virus
ISSMGEAMVSR

SEQ ID NO: 411936 - protein, 11 aa, Influenza virus
SSMGEAMVSRA

SEQ ID NO: 411937 - protein, 11 aa, Influenza virus
SMGEAMVSRAR

SEQ ID NO: 411938 - protein, 11 aa, Influenza virus
MGEAMVSRARI

SEQ ID NO: 411939 - protein, 11 aa, Influenza virus
GEAMVSRARID

SEQ ID NO: 411940 - protein, 11 aa, Influenza virus
EAMMSRARIDA

SEQ ID NO: 411941 - protein, 11 aa, Influenza virus
AMMSRARIDAR

SEQ ID NO: 411942 - protein, 11 aa, Influenza virus
MISRARIDARI

SEQ ID NO: 411943 - protein, 11 aa, Influenza virus
ISRARIDARID

SEQ ID NO: 411944 - protein, 11 aa, Influenza virus
SRARIDARVDS

SEQ ID NO: 411945 - protein, 11 aa, Influenza virus
RARIDARVDSE

SEQ ID NO: 411946 - protein, 11 aa, Influenza virus
ARIDARVDSES

SEQ ID NO: 411947 - protein, 11 aa, Influenza virus
RIDARVDSESG

SEQ ID NO: 411948 - protein, 11 aa, Influenza virus
GKKEFSEIMKI

SEQ ID NO: 411949 - protein, 11 aa, Influenza virus
SKSRSIIFNME

SEQ ID NO: 411950 - protein, 11 aa, Influenza virus
KSRSIIFNMER

SEQ ID NO: 411951 - protein, 11 aa, Influenza virus
LMSQSRTRGIL

SEQ ID NO: 411952 - protein, 11 aa, Influenza virus
MSQSRTRGILT

SEQ ID NO: 411953 - protein, 11 aa, Influenza virus
SRTREILTKIT

SEQ ID NO: 411954 - protein, 11 aa, Influenza virus
RTREILTKITV

SEQ ID NO: 411955 - protein, 11 aa, Influenza virus
TREILTKITVD

SEQ ID NO: 411956 - protein, 11 aa, Influenza virus
REILTKITVDH

SEQ ID NO: 411957 - protein, 11 aa, Influenza virus
EILTKITVDHM

SEQ ID NO: 411958 - protein, 11 aa, Influenza virus
ILTKITVDHMA

SEQ ID NO: 411959 - protein, 11 aa, Influenza virus
LTKITVDHMAI

SEQ ID NO: 411960 - protein, 11 aa, Influenza virus
TKITVDHMAII

SEQ ID NO: 411961 - protein, 11 aa, Influenza virus
KITVDHMAIIK

SEQ ID NO: 411962 - protein, 11 aa, Influenza virus
TTVDHMAIIKR

SEQ ID NO: 411963 - protein, 11 aa, Influenza virus
HMAIIKRYTSG

SEQ ID NO: 411964 - protein, 11 aa, Influenza virus
MAIIKRYTSGR

SEQ ID NO: 411965 - protein, 11 aa, Influenza virus
YTSARQEKNPA

SEQ ID NO: 411966 - protein, 11 aa, Influenza virus
TSARQEKNPAL

SEQ ID NO: 411967 - protein, 11 aa, Influenza virus
SARQEKNPALR

SEQ ID NO: 411968 - protein, 11 aa, Influenza virus
ARQEKNPALRM

SEQ ID NO: 411969 - protein, 11 aa, Influenza virus
ALRMKWMMAMR

SEQ ID NO: 411970 - protein, 11 aa, Influenza virus
MMAMKYPITAE

SEQ ID NO: 411971 - protein, 11 aa, Influenza virus
IVSPLAVTWWN

SEQ ID NO: 411972 - protein, 11 aa, Influenza virus
VSPLAITWWNR

SEQ ID NO: 411973 - protein, 11 aa, Influenza virus
SPLAVTWWNRS

SEQ ID NO: 411974 - protein, 11 aa, Influenza virus
PLAVTWWNRSG

SEQ ID NO: 411975 - protein, 11 aa, Influenza virus
LAVTWWNRSGP

SEQ ID NO: 411976 - protein, 11 aa, Influenza virus
GIFGPVHFRNQ

SEQ ID NO: 411977 - protein, 11 aa, Influenza virus
FGPVHFQNQVK

SEQ ID NO: 411978 - protein, 11 aa, Influenza virus
GPVHFQNQVKI

SEQ ID NO: 411979 - protein, 11 aa, Influenza virus
PVHFQNQVKIR

SEQ ID NO: 411980 - protein, 11 aa, Influenza virus
VHFQNQVKIRR

SEQ ID NO: 411981 - protein, 11 aa, Influenza virus
HFQNQVKIRRR

SEQ ID NO: 411982 - protein, 11 aa, Influenza virus
FQNQVKIRRRV

SEQ ID NO: 411983 - protein, 11 aa, Influenza virus
QNQVKIRRRVD

SEQ ID NO: 411984 - protein, 11 aa, Influenza virus
QVKIRRRVDVN

SEQ ID NO: 411985 - protein, 11 aa, Influenza virus
VKIRRRVDVNP

SEQ ID NO: 411986 - protein, 11 aa, Influenza virus
KIRRRVDVNPG

SEQ ID NO: 411987 - protein, 11 aa, Influenza virus
IRRRVDVNPGH

SEQ ID NO: 411988 - protein, 11 aa, Influenza virus
RRRVDVNPGHA

SEQ ID NO: 411989 - protein, 11 aa, Influenza virus
AKEAQDVIMEI

SEQ ID NO: 411990 - protein, 11 aa, Influenza virus
IVFPNEVGARI

SEQ ID NO: 411991 - protein, 11 aa, Influenza virus
VFPNEVGARII

SEQ ID NO: 411992 - protein, 11 aa, Influenza virus
FPNEVGARIIT

SEQ ID NO: 411993 - protein, 11 aa, Influenza virus
PNEVGARIITS

SEQ ID NO: 411994 - protein, 11 aa, Influenza virus
NEVGARIITSE

SEQ ID NO: 411995 - protein, 11 aa, Influenza virus
EVGARIITSES

SEQ ID NO: 411996 - protein, 11 aa, Influenza virus
VGARIITSESQ

SEQ ID NO: 411997 - protein, 11 aa, Influenza virus
GARILTSESQM

SEQ ID NO: 411998 - protein, 11 aa, Influenza virus
IAPLMMAYMLE

SEQ ID NO: 411999 - protein, 11 aa, Influenza virus
APLMMAYMLER

SEQ ID NO: 412000 - protein, 11 aa, Influenza virus
LVRKTRFLPVT

SEQ ID NO: 412001 - protein, 11 aa, Influenza virus
VRKTRFLPVTG

SEQ ID NO: 412002 - protein, 11 aa, Influenza virus
RKTRFLPVTGG

SEQ ID NO: 412003 - protein, 11 aa, Influenza virus
KTRFLPVTGGT

SEQ ID NO: 412004 - protein, 11 aa, Influenza virus
TRFLPVSGGTS

SEQ ID NO: 412005 - protein, 11 aa, Influenza virus
RFLPVSGGTSS

SEQ ID NO: 412006 - protein, 11 aa, Influenza virus
GGTSSIYIEVL

SEQ ID NO: 412007 - protein, 11 aa, Influenza virus
GTSSIYIEVLH

SEQ ID NO: 412008 - protein, 11 aa, Influenza virus
TSSIYIEVLHL

SEQ ID NO: 412009 - protein, 11 aa, Influenza virus
SSIYIEVLHLT

SEQ ID NO: 412010 - protein, 11 aa, Influenza virus
SVYVEVLHLTQ

SEQ ID NO: 412011 - protein, 11 aa, Influenza virus
VYVEVLHLTQG

SEQ ID NO: 412012 - protein, 11 aa, Influenza virus
YVEVLHLTQGT

SEQ ID NO: 412013 - protein, 11 aa, Influenza virus
VEVLHLTQGTC

SEQ ID NO: 412014 - protein, 11 aa, Influenza virus
HLTQGTCWEQL

SEQ ID NO: 412015 - protein, 11 aa, Influenza virus
LTQGTCWEQLY

SEQ ID NO: 412016 - protein, 11 aa, Influenza virus
TQGTCWEQLYT

SEQ ID NO: 412017 - protein, 11 aa, Influenza virus
QGTCWEQLYTP

SEQ ID NO: 412018 - protein, 11 aa, Influenza virus
GTCWEQLYTPG

SEQ ID NO: 412019 - protein, 11 aa, Influenza virus
TCWEQLYTPGG

SEQ ID NO: 412020 - protein, 11 aa, Influenza virus
CWEQLYTPGGE

SEQ ID NO: 412021 - protein, 11 aa, Influenza virus
WEQLYTPGGEV

SEQ ID NO: 412022 - protein, 11 aa, Influenza virus
NDDVDQSLVIA

SEQ ID NO: 412023 - protein, 11 aa, Influenza virus
DDVDQSLVIAA

SEQ ID NO: 412024 - protein, 11 aa, Influenza virus
DVDQSLVIAAR

SEQ ID NO: 412025 - protein, 11 aa, Influenza virus
VDQSLIIAARS

SEQ ID NO: 412026 - protein, 11 aa, Influenza virus
DQSLVIAARNI

SEQ ID NO: 412027 - protein, 11 aa, Influenza virus
QSLVIAARNIV

SEQ ID NO: 412028 - protein, 11 aa, Influenza virus
SLVIAARNIVR

SEQ ID NO: 412029 - protein, 11 aa, Influenza virus
LVIAARNIVRR

SEQ ID NO: 412030 - protein, 11 aa, Influenza virus
VIAARNIVRRA

SEQ ID NO: 412031 - protein, 11 aa, Influenza virus
IAARSIVRRAT

SEQ ID NO: 412032 - protein, 11 aa, Influenza virus
AARSIVRRATV

SEQ ID NO: 412033 - protein, 11 aa, Influenza virus
ARSIVRRATVS

SEQ ID NO: 412034 - protein, 11 aa, Influenza virus
RSIVRRATVSA

SEQ ID NO: 412035 - protein, 11 aa, Influenza virus
SIVRRATVSAD

SEQ ID NO: 412036 - protein, 11 aa, Influenza virus
IVRRAIVSADP

SEQ ID NO: 412037 - protein, 11 aa, Influenza virus
VRRAIVSADPL

SEQ ID NO: 412038 - protein, 11 aa, Influenza virus
RRAIVSADPLA

SEQ ID NO: 412039 - protein, 11 aa, Influenza virus
RAIVSADPLAS

SEQ ID NO: 412040 - protein, 11 aa, Influenza virus
AIVSADPLASL

SEQ ID NO: 412041 - protein, 11 aa, Influenza virus
VSADPLVSLLE

SEQ ID NO: 412042 - protein, 11 aa, Influenza virus
SADPLVSLLEM

SEQ ID NO: 412043 - protein, 11 aa, Influenza virus
ADPLVSLLEMC

SEQ ID NO: 412044 - protein, 11 aa, Influenza virus
PLASLLEMCHG

SEQ ID NO: 412045 - protein, 11 aa, Influenza virus
LLSLLEMCHST

SEQ ID NO: 412046 - protein, 11 aa, Influenza virus
LSLLEMCHSTQ

SEQ ID NO: 412047 - protein, 11 aa, Influenza virus
SLLEMCHGTQI

SEQ ID NO: 412048 - protein, 11 aa, Influenza virus
LLEMCHGTQIG

SEQ ID NO: 412049 - protein, 11 aa, Influenza virus
LEMCHGTQIGG

SEQ ID NO: 412050 - protein, 11 aa, Influenza virus
DILKHNPTEEQ

SEQ ID NO: 412051 - protein, 11 aa, Influenza virus
ILKHNPTEEQA

SEQ ID NO: 412052 - protein, 11 aa, Influenza virus
LKHNPTEEQAV

SEQ ID NO: 412053 - protein, 11 aa, Influenza virus
QNPTEEQAVNI

SEQ ID NO: 412054 - protein, 11 aa, Influenza virus
NPTEEQAVNIC

SEQ ID NO: 412055 - protein, 11 aa, Influenza virus
PTEEQAVNICK

SEQ ID NO: 412056 - protein, 11 aa, Influenza virus
TEEQAVNICKA

SEQ ID NO: 412057 - protein, 11 aa, Influenza virus
EEQAVNICKAA

SEQ ID NO: 412058 - protein, 11 aa, Influenza virus
EQAVGICKAAM

SEQ ID NO: 412059 - protein, 11 aa, Influenza virus
QAVGICKAAMG

SEQ ID NO: 412060 - protein, 11 aa, Influenza virus
ICKAALGLRIS

SEQ ID NO: 412061 - protein, 11 aa, Influenza virus
CKAALGLRISS

SEQ ID NO: 412062 - protein, 11 aa, Influenza virus
KAALGLRISSS

SEQ ID NO: 412063 - protein, 11 aa, Influenza virus
AALGLRISSSF

SEQ ID NO: 412064 - protein, 11 aa, Influenza virus
ALGLRISSSFS

SEQ ID NO: 412065 - protein, 11 aa, Influenza virus
LGLRISSSFSF

SEQ ID NO: 412066 - protein, 11 aa, Influenza virus
MRISSSFSFGG

SEQ ID NO: 412067 - protein, 11 aa, Influenza virus
SFGGFTFKRTN

SEQ ID NO: 412068 - protein, 11 aa, Influenza virus
FGGFTFKRTNG

SEQ ID NO: 412069 - protein, 11 aa, Influenza virus
EEEVLTGNLQA

SEQ ID NO: 412070 - protein, 11 aa, Influenza virus
EEVLTGNLQAL

SEQ ID NO: 412071 - protein, 11 aa, Influenza virus
EMLTGNLQTLK

SEQ ID NO: 412072 - protein, 11 aa, Influenza virus
IVAMVFSQEEC

SEQ ID NO: 412073 - protein, 11 aa, Influenza virus
VAMVFSQEDCV

SEQ ID NO: 412074 - protein, 11 aa, Influenza virus
CMMKAVRGDLN

SEQ ID NO: 412075 - protein, 11 aa, Influenza virus
MMKAVRGDLNF

SEQ ID NO: 412076 - protein, 11 aa, Influenza virus
MKAVRGDLNFV

SEQ ID NO: 412077 - protein, 11 aa, Influenza virus
QLLRHFQKNAK

SEQ ID NO: 412078 - protein, 11 aa, Influenza virus
LLRHFQKDARV

SEQ ID NO: 412079 - protein, 11 aa, Influenza virus
LRHFQKDARVL

SEQ ID NO: 412080 - protein, 11 aa, Influenza virus
VSIDRFLRVKD

SEQ ID NO: 412081 - protein, 11 aa, Influenza virus
SIDRFLRVKDQ

SEQ ID NO: 412082 - protein, 11 aa, Influenza virus
DRFLRVKDQQG

SEQ ID NO: 412083 - protein, 11 aa, Influenza virus
VLLSPEEVSEA

SEQ ID NO: 412084 - protein, 11 aa, Influenza virus
LLSPEEISETQ

SEQ ID NO: 412085 - protein, 11 aa, Influenza virus
LSPEEISETQG

SEQ ID NO: 412086 - protein, 11 aa, Influenza virus
SPEEVSETQGM

SEQ ID NO: 412087 - protein, 11 aa, Influenza virus
PEEVSETQGME

SEQ ID NO: 412088 - protein, 11 aa, Influenza virus
EKLTITYSSSL

SEQ ID NO: 412089 - protein, 11 aa, Influenza virus
KLTITYSSSLM

SEQ ID NO: 412090 - protein, 11 aa, Influenza virus
LTIIYSSSMMW

SEQ ID NO: 412091 - protein, 11 aa, Influenza virus
TIIYSSSMMWE

SEQ ID NO: 412092 - protein, 11 aa, Influenza virus
ITYSSSMMWEV

SEQ ID NO: 412093 - protein, 11 aa, Influenza virus
TYSSSMMWEVN

SEQ ID NO: 412094 - protein, 11 aa, Influenza virus
YSSSMMWEVNG

SEQ ID NO: 412095 - protein, 11 aa, Influenza virus
SSSMMWEVNGP

SEQ ID NO: 412096 - protein, 11 aa, Influenza virus
SSMMWEVNGPE

SEQ ID NO: 412097 - protein, 11 aa, Influenza virus
SMMWEVNGPES

SEQ ID NO: 412098 - protein, 11 aa, Influenza virus
MMWEVNGPESV

SEQ ID NO: 412099 - protein, 11 aa, Influenza virus
MWEINGPDSVL

SEQ ID NO: 412100 - protein, 11 aa, Influenza virus
WEVNGPESVLV

SEQ ID NO: 412101 - protein, 11 aa, Influenza virus
EVNGPESVLVN

SEQ ID NO: 412102 - protein, 11 aa, Influenza virus
VNGPESVLVNT

SEQ ID NO: 412103 - protein, 11 aa, Influenza virus
NGPDSVLVNTY

SEQ ID NO: 412104 - protein, 11 aa, Influenza virus
GPDSVLVNTYQ

SEQ ID NO: 412105 - protein, 11 aa, Influenza virus
PDSVLVNTYQW

SEQ ID NO: 412106 - protein, 11 aa, Influenza virus
ESVLVNTYQWV

SEQ ID NO: 412107 - protein, 11 aa, Influenza virus
SVLVNTYQWVI

SEQ ID NO: 412108 - protein, 11 aa, Influenza virus
VLVNTYQWVIR

SEQ ID NO: 412109 - protein, 11 aa, Influenza virus
LVNTYQWVIRN

SEQ ID NO: 412110 - protein, 11 aa, Influenza virus
VNTYQWVIRNW

SEQ ID NO: 412111 - protein, 11 aa, Influenza virus
NTYQWIIKNWE

SEQ ID NO: 412112 - protein, 11 aa, Influenza virus
LYNKVEFEPFQ

SEQ ID NO: 412113 - protein, 11 aa, Influenza virus
YNKVEFEPFQS

SEQ ID NO: 412114 - protein, 11 aa, Influenza virus
NKVEFEPFQSL

SEQ ID NO: 412115 - protein, 11 aa, Influenza virus
KMEFEPFQSLI

SEQ ID NO: 412116 - protein, 11 aa, Influenza virus
MEFEPFQSLIP

SEQ ID NO: 412117 - protein, 11 aa, Influenza virus
EFEPFQSLIPK

SEQ ID NO: 412118 - protein, 11 aa, Influenza virus
FEPFQSLIPKA

SEQ ID NO: 412119 - protein, 11 aa, Influenza virus
LYSGFVRTLFQ

SEQ ID NO: 412120 - protein, 11 aa, Influenza virus
RTLFQQMRDVI

SEQ ID NO: 412121 - protein, 11 aa, Influenza virus
TLFQQMRDVIG

SEQ ID NO: 412122 - protein, 11 aa, Influenza virus
QQMRDVIGTFD

SEQ ID NO: 412123 - protein, 11 aa, Influenza virus
QMRDVIGTFDT

SEQ ID NO: 412124 - protein, 11 aa, Influenza virus
QIIKLLPFASA

SEQ ID NO: 412125 - protein, 11 aa, Influenza virus
IIKLLPFASAP

SEQ ID NO: 412126 - protein, 11 aa, Influenza virus
KLLPFAAAPPV

SEQ ID NO: 412127 - protein, 11 aa, Influenza virus
LLPFAAAPPVQ

SEQ ID NO: 412128 - protein, 11 aa, Influenza virus
LPFAAAPPVQS

SEQ ID NO: 412129 - protein, 11 aa, Influenza virus
PPVQSRMQFSS

SEQ ID NO: 412130 - protein, 11 aa, Influenza virus
QNRMQFSSLTV

SEQ ID NO: 412131 - protein, 11 aa, Influenza virus
RMQFSSLTVSV

SEQ ID NO: 412132 - protein, 11 aa, Influenza virus
MQFSSLAVNVR

SEQ ID NO: 412133 - protein, 11 aa, Influenza virus
QFSSLAVNVRG

SEQ ID NO: 412134 - protein, 11 aa, Influenza virus
FSSLTVSVRGS

SEQ ID NO: 412135 - protein, 11 aa, Influenza virus
SSLTVSVRGSG

SEQ ID NO: 412136 - protein, 11 aa, Influenza virus
SLTVNVRGTGM

SEQ ID NO: 412137 - protein, 11 aa, Influenza virus
LTVNVRGTGMR

SEQ ID NO: 412138 - protein, 11 aa, Influenza virus
TVNVRGTGMRI

SEQ ID NO: 412139 - protein, 11 aa, Influenza virus
VNVRGTGMRIL

SEQ ID NO: 412140 - protein, 11 aa, Influenza virus
RGSGMRILIRG

SEQ ID NO: 412141 - protein, 11 aa, Influenza virus
GMRILIRGNSP

SEQ ID NO: 412142 - protein, 11 aa, Influenza virus
LVRGNSPAFNY

SEQ ID NO: 412143 - protein, 11 aa, Influenza virus
VRGNSPAFNYN

SEQ ID NO: 412144 - protein, 11 aa, Influenza virus
RGNSPIFNYNK

SEQ ID NO: 412145 - protein, 11 aa, Influenza virus
KRLTIIGKDAG

SEQ ID NO: 412146 - protein, 11 aa, Influenza virus
TGVESAVLRGF

SEQ ID NO: 412147 - protein, 11 aa, Influenza virus
AVLRGFLILGR

SEQ ID NO: 412148 - protein, 11 aa, Influenza virus
VLRGFLILGRE

SEQ ID NO: 412149 - protein, 11 aa, Influenza virus
LRGFLILGKEN

SEQ ID NO: 412150 - protein, 11 aa, Influenza virus
RGFLILGKEDR

SEQ ID NO: 412151 - protein, 11 aa, Influenza virus
ENKRYGPALSI

SEQ ID NO: 412152 - protein, 11 aa, Influenza virus
KKYGPALSINE

SEQ ID NO: 412153 - protein, 11 aa, Influenza virus
KYGPALSINEL

SEQ ID NO: 412154 - protein, 11 aa, Influenza virus
YGPALSINELG

SEQ ID NO: 412155 - protein, 11 aa, Influenza virus
LARGEKANVLI

SEQ ID NO: 412156 - protein, 11 aa, Influenza virus
ARGEKANVLIG

SEQ ID NO: 412157 - protein, 11 aa, Influenza virus
DVVLVMKRKRN

SEQ ID NO: 412158 - protein, 11 aa, Influenza virus
VVLVMKRKRNS

SEQ ID NO: 412159 - protein, 11 aa, Influenza virus
SQTATKRIRLA

SEQ ID NO: 412160 - protein, 11 aa, Influenza virus
QTATKRIRMAT

SEQ ID NO: 412161 - protein, 11 aa, Influenza virus
TKRIRMAINLV

SEQ ID NO: 412162 - protein, 11 aa, Influenza virus
QMTRGLFGAIA

SEQ ID NO: 412163 - protein, 11 aa, Influenza virus
ARGLFGAIAGF

SEQ ID NO: 412164 - protein, 11 aa, Influenza virus
AKAGVKMNPNQ

SEQ ID NO: 412165 - protein, 11 aa, Influenza virus
KAGVKMNPNQK

SEQ ID NO: 412166 - protein, 11 aa, Influenza virus
AGVKMNPNQKI

SEQ ID NO: 412167 - protein, 11 aa, Influenza virus
EIKMNPNQKII

SEQ ID NO: 412168 - protein, 11 aa, Influenza virus
KMNPNQKIMTI

SEQ ID NO: 412169 - protein, 11 aa, Influenza virus
VQHLEECSCYV

SEQ ID NO: 412170 - protein, 11 aa, Influenza virus
EIKMNPNQKIM

SEQ ID NO: 412171 - protein, 11 aa, Influenza virus
IKMNPNQKIMT

SEQ ID NO: 412172 - protein, 11 aa, Influenza virus
KMNPNQKIMTI

SEQ ID NO: 412173 - protein, 11 aa, Influenza virus
IRIGSRGDVFV

SEQ ID NO: 412174 - protein, 11 aa, Influenza virus
FIIREPFISCS

SEQ ID NO: 412175 - protein, 11 aa, Influenza virus
SECRTFFLTQG

SEQ ID NO: 412176 - protein, 11 aa, Influenza virus
LLNDKHSNGTA

SEQ ID NO: 412177 - protein, 11 aa, Influenza virus
RSPHRALMSCP

SEQ ID NO: 412178 - protein, 11 aa, Influenza virus
AWSASACHDGL

SEQ ID NO: 412179 - protein, 11 aa, Influenza virus
GWITIGISGPD

SEQ ID NO: 412180 - protein, 11 aa, Influenza virus
TIGISGPDSGA

SEQ ID NO: 412181 - protein, 11 aa, Influenza virus
IGISGPDSGAV

SEQ ID NO: 412182 - protein, 11 aa, Influenza virus
GISGPDSGAVA

SEQ ID NO: 412183 - protein, 11 aa, Influenza virus
ISGPDSGAVAV

SEQ ID NO: 412184 - protein, 11 aa, Influenza virus
SGPDSGAVAVL

SEQ ID NO: 412185 - protein, 11 aa, Influenza virus
GPDSGAVAVLK

SEQ ID NO: 412186 - protein, 11 aa, Influenza virus
PDSGAVAVLKY

SEQ ID NO: 412187 - protein, 11 aa, Influenza virus
NGFCFTVMTDG

SEQ ID NO: 412188 - protein, 11 aa, Influenza virus
GSCFTLMTDGP

SEQ ID NO: 412189 - protein, 11 aa, Influenza virus
APNSHYEECSC

SEQ ID NO: 412190 - protein, 11 aa, Influenza virus
PNSHYEECSCY

SEQ ID NO: 412191 - protein, 11 aa, Influenza virus
NSHYEECSCYP

SEQ ID NO: 412192 - protein, 11 aa, Influenza virus
DNWHGANRPWV

SEQ ID NO: 412193 - protein, 11 aa, Influenza virus
NWHGANRPWVS

SEQ ID NO: 412194 - protein, 11 aa, Influenza virus
WHGANRPWVSF

SEQ ID NO: 412195 - protein, 11 aa, Influenza virus
GYICSGVLGDN

SEQ ID NO: 412196 - protein, 11 aa, Influenza virus
YICSGVLGDNP

SEQ ID NO: 412197 - protein, 11 aa, Influenza virus
ICSGVLGDNPR

SEQ ID NO: 412198 - protein, 11 aa, Influenza virus
YGNGVWMGRTK

SEQ ID NO: 412199 - protein, 11 aa, Influenza virus
NDWSGYSGSFV

SEQ ID NO: 412200 - protein, 11 aa, Influenza virus
NCMRPCFWVEL

SEQ ID NO: 412201 - protein, 11 aa, Influenza virus
CMRPCFWVELV

SEQ ID NO: 412202 - protein, 11 aa, Influenza virus
MRPCFWVELVR

SEQ ID NO: 412203 - protein, 11 aa, Influenza virus
PCFWVELVRGR

SEQ ID NO: 412204 - protein, 11 aa, Influenza virus
CFWVELVRGRP

SEQ ID NO: 412205 - protein, 11 aa, Influenza virus
TIWTSGSIISF

SEQ ID NO: 412206 - protein, 11 aa, Influenza virus
IWTSGSIISFC

SEQ ID NO: 412207 - protein, 11 aa, Influenza virus
TSASSISFCGV

SEQ ID NO: 412208 - protein, 11 aa, Influenza virus
SGSIISFCGVN

SEQ ID NO: 412209 - protein, 11 aa, Influenza virus
WSWPDGAKLPF

SEQ ID NO: 412210 - protein, 11 aa, Influenza virus
KDNSIRLAAGG

SEQ ID NO: 412211 - protein, 11 aa, Influenza virus
VWVTREPYVSC

SEQ ID NO: 412212 - protein, 11 aa, Influenza virus
PYRTLLMSELG

SEQ ID NO: 412213 - protein, 11 aa, Influenza virus
YRTLLMSELGV

SEQ ID NO: 412214 - protein, 11 aa, Influenza virus
MNELGIPFHLG

SEQ ID NO: 412215 - protein, 11 aa, Influenza virus
NELGIPFHLGT

SEQ ID NO: 412216 - protein, 11 aa, Influenza virus
ELGIPFHLGTK

SEQ ID NO: 412217 - protein, 11 aa, Influenza virus
LGIPFHLGTKQ

SEQ ID NO: 412218 - protein, 11 aa, Influenza virus
GIPFHLGTKQV

SEQ ID NO: 412219 - protein, 11 aa, Influenza virus
IPFHLGTKQVC

SEQ ID NO: 412220 - protein, 11 aa, Influenza virus
RQVCMAWSSSS

SEQ ID NO: 412221 - protein, 11 aa, Influenza virus
VCIAWSSSSCY

SEQ ID NO: 412222 - protein, 11 aa, Influenza virus
CIAWSSSSCYD

SEQ ID NO: 412223 - protein, 11 aa, Influenza virus
IAWSSSSCYDG

SEQ ID NO: 412224 - protein, 11 aa, Influenza virus
WSSSSCHDGNA

SEQ ID NO: 412225 - protein, 11 aa, Influenza virus
SSSSCHDGNAW

SEQ ID NO: 412226 - protein, 11 aa, Influenza virus
SSSCHDGNAWL

SEQ ID NO: 412227 - protein, 11 aa, Influenza virus
SSCHDGNAWLH

SEQ ID NO: 412228 - protein, 11 aa, Influenza virus
RTQESECVCID

SEQ ID NO: 412229 - protein, 11 aa, Influenza virus
CTVIMTDGSAS

SEQ ID NO: 412230 - protein, 11 aa, Influenza virus
QHIEECSCYPQ

SEQ ID NO: 412231 - protein, 11 aa, Influenza virus
IRCVCRDNWKG

SEQ ID NO: 412232 - protein, 11 aa, Influenza virus
KCVCRDNWKGS

SEQ ID NO: 412233 - protein, 11 aa, Influenza virus
RDNWRGSNRPI

SEQ ID NO: 412234 - protein, 11 aa, Influenza virus
CSGLVGDTPRD

SEQ ID NO: 412235 - protein, 11 aa, Influenza virus
TSNSIIAFCGT

SEQ ID NO: 412236 - protein, 11 aa, Influenza virus
VAFCGTSGTYG

SEQ ID NO: 412237 - protein, 11 aa, Influenza virus
VFCGTSGTYGA

SEQ ID NO: 412238 - protein, 11 aa, Influenza virus
CGTSGTYGTGT

SEQ ID NO: 412239 - protein, 11 aa, Influenza virus
GTSGTYGTGTW

SEQ ID NO: 412240 - protein, 11 aa, Influenza virus
TSGTYGTGTWP

SEQ ID NO: 412241 - protein, 11 aa, Influenza virus
SGTYGTGTWPD

SEQ ID NO: 412242 - protein, 11 aa, Influenza virus
GTYGTGTWPDG

SEQ ID NO: 412243 - protein, 11 aa, Influenza virus
TYGTGTWPDGA

SEQ ID NO: 412244 - protein, 11 aa, Influenza virus
GRTSISCLYKL

SEQ ID NO: 412245 - protein, 11 aa, Influenza virus
ANINFMPYISF

SEQ ID NO: 412246 - protein, 11 aa, Influenza virus
HKDNAIRLGET

SEQ ID NO: 412247 - protein, 11 aa, Influenza virus
IITREPYVSCD

SEQ ID NO: 412248 - protein, 11 aa, Influenza virus
VTREPYVSCDS

SEQ ID NO: 412249 - protein, 11 aa, Influenza virus
WSFALAQGVLL

SEQ ID NO: 412250 - protein, 11 aa, Influenza virus
SFALSQGALLG

SEQ ID NO: 412251 - protein, 11 aa, Influenza virus
FALSQGALLGT

SEQ ID NO: 412252 - protein, 11 aa, Influenza virus
DRAPYRSLIRF

SEQ ID NO: 412253 - protein, 11 aa, Influenza virus
RAPYRSLIRFP

SEQ ID NO: 412254 - protein, 11 aa, Influenza virus
SCFDGKEWLHV

SEQ ID NO: 412255 - protein, 11 aa, Influenza virus
CFDGREWMHVC

SEQ ID NO: 412256 - protein, 11 aa, Influenza virus
KNILRTQESEC

SEQ ID NO: 412257 - protein, 11 aa, Influenza virus
KVQHLEECSCY

SEQ ID NO: 412258 - protein, 11 aa, Influenza virus
VQHLEECSCYV

SEQ ID NO: 412259 - protein, 11 aa, Influenza virus
RHLEECSCYVD

SEQ ID NO: 412260 - protein, 11 aa, Influenza virus
DIYCVCRDNWK

SEQ ID NO: 412261 - protein, 11 aa, Influenza virus
IYCVCRDNWKG

SEQ ID NO: 412262 - protein, 11 aa, Influenza virus
WKGSNRPWIRI

SEQ ID NO: 412263 - protein, 11 aa, Influenza virus
GSNRPWVRINN

SEQ ID NO: 412264 - protein, 11 aa, Influenza virus
SNRPWVRINNE

SEQ ID NO: 412265 - protein, 11 aa, Influenza virus
NRPWVRINNET

SEQ ID NO: 412266 - protein, 11 aa, Influenza virus
RPWVRINNETI

SEQ ID NO: 412267 - protein, 11 aa, Influenza virus
INNETIIETGY

SEQ ID NO: 412268 - protein, 11 aa, Influenza virus
NNETIIETGYV

SEQ ID NO: 412269 - protein, 11 aa, Influenza virus
NETIVETGYVC

SEQ ID NO: 412270 - protein, 11 aa, Influenza virus
ETIVETGYVCS

SEQ ID NO: 412271 - protein, 11 aa, Influenza virus
TIVETGYVCSK

SEQ ID NO: 412272 - protein, 11 aa, Influenza virus
IVETGYVCSKF

SEQ ID NO: 412273 - protein, 11 aa, Influenza virus
VETGYVCSKFH

SEQ ID NO: 412274 - protein, 11 aa, Influenza virus
KFHSDTPRPSD

SEQ ID NO: 412275 - protein, 11 aa, Influenza virus
FHSDTPRPSDP

SEQ ID NO: 412276 - protein, 11 aa, Influenza virus
HSDTPRPSDPS

SEQ ID NO: 412277 - protein, 11 aa, Influenza virus
TQTLVANNDWS

SEQ ID NO: 412278 - protein, 11 aa, Influenza virus
NDWSGYSGSFS

SEQ ID NO: 412279 - protein, 11 aa, Influenza virus
DWSGYSGSFSV

SEQ ID NO: 412280 - protein, 11 aa, Influenza virus
ACFQPCFYVEL

SEQ ID NO: 412281 - protein, 11 aa, Influenza virus
PCFYVELTRGV

SEQ ID NO: 412282 - protein, 11 aa, Influenza virus
VSWTSNSIITF

SEQ ID NO: 412283 - protein, 11 aa, Influenza virus
SWTSNSIITFC

SEQ ID NO: 412284 - protein, 11 aa, Influenza virus
SNSLVTFCGLD

SEQ ID NO: 412285 - protein, 11 aa, Influenza virus
NSIVTFCGLBN

SEQ ID NO: 412286 - protein, 11 aa, Influenza virus
SIVTFCGLBNE

SEQ ID NO: 412287 - protein, 11 aa, Influenza virus
IVTFCGLBNEP

SEQ ID NO: 412288 - protein, 11 aa, Influenza virus
LBNEPGSGNWP

SEQ ID NO: 412289 - protein, 11 aa, Influenza virus
DNEPGSGNGLM

SEQ ID NO: 412290 - protein, 11 aa, Influenza virus
EPGSGNWPDGP

SEQ ID NO: 412291 - protein, 11 aa, Influenza virus
WPDGSNIGLCP

SEQ ID NO: 412292 - protein, 11 aa, Influenza virus
PNQMIITIGSA

SEQ ID NO: 412293 - protein, 11 aa, Influenza virus
LTTVGLLLQVT

SEQ ID NO: 412294 - protein, 11 aa, Influenza virus
TTVGLLLQVTS

SEQ ID NO: 412295 - protein, 11 aa, Influenza virus
TIGPLLQITSL

SEQ ID NO: 412296 - protein, 11 aa, Influenza virus
VGLLLQVTSLC

SEQ ID NO: 412297 - protein, 11 aa, Influenza virus
SIWFSHYNQIT

SEQ ID NO: 412298 - protein, 11 aa, Influenza virus
IWFSHYNQVAQ

SEQ ID NO: 412299 - protein, 11 aa, Influenza virus
WFSHYNQMKQA

SEQ ID NO: 412300 - protein, 11 aa, Influenza virus
TFVNMTNVQNN

SEQ ID NO: 412301 - protein, 11 aa, Influenza virus
FVNITNVQNNY

SEQ ID NO: 412302 - protein, 11 aa, Influenza virus
VNITNVQNNYT

SEQ ID NO: 412303 - protein, 11 aa, Influenza virus
NMTNVQNNYTT

SEQ ID NO: 412304 - protein, 11 aa, Influenza virus
ISCSVSECRTF

SEQ ID NO: 412305 - protein, 11 aa, Influenza virus
SCSIHECRTFF

SEQ ID NO: 412306 - protein, 11 aa, Influenza virus
CSIHECRTFFL

SEQ ID NO: 412307 - protein, 11 aa, Influenza virus
SVSECRTFFLT

SEQ ID NO: 412308 - protein, 11 aa, Influenza virus
VSECRTFFLTQ

SEQ ID NO: 412309 - protein, 11 aa, Influenza virus
HECRTFFLTQG

SEQ ID NO: 412310 - protein, 11 aa, Influenza virus
RTLMSCHIGVA

SEQ ID NO: 412311 - protein, 11 aa, Influenza virus
TLMSCHIGVAP

SEQ ID NO: 412312 - protein, 11 aa, Influenza virus
LMSCHIGVAPS

SEQ ID NO: 412313 - protein, 11 aa, Influenza virus
MSCHIGVAPSP

SEQ ID NO: 412314 - protein, 11 aa, Influenza virus
SCHIGVAPSPS

SEQ ID NO: 412315 - protein, 11 aa, Influenza virus
CPIGVVPSPSN

SEQ ID NO: 412316 - protein, 11 aa, Influenza virus
HIGVAPSPSNS

SEQ ID NO: 412317 - protein, 11 aa, Influenza virus
WLTIGITGPDA

SEQ ID NO: 412318 - protein, 11 aa, Influenza virus
LTIGITGPDAT

SEQ ID NO: 412319 - protein, 11 aa, Influenza virus
TIGITGPDATA

SEQ ID NO: 412320 - protein, 11 aa, Influenza virus
IGITGPDATAV

SEQ ID NO: 412321 - protein, 11 aa, Influenza virus
TGPDATAVAVI

SEQ ID NO: 412322 - protein, 11 aa, Influenza virus
GPDATAVAVIK

SEQ ID NO: 412323 - protein, 11 aa, Influenza virus
PDATAVVVLKY

SEQ ID NO: 412324 - protein, 11 aa, Influenza virus
DATAVAVIKYN

SEQ ID NO: 412325 - protein, 11 aa, Influenza virus
ATAVVVLKYNG

SEQ ID NO: 412326 - protein, 11 aa, Influenza virus
IKYNGIITDTF

SEQ ID NO: 412327 - protein, 11 aa, Influenza virus
CYTLVTDGPSD

SEQ ID NO: 412328 - protein, 11 aa, Influenza virus
YTLVTDGPSDA

SEQ ID NO: 412329 - protein, 11 aa, Influenza virus
TLVTDGPSDAQ

SEQ ID NO: 412330 - protein, 11 aa, Influenza virus
LVTDGPSDAQA

SEQ ID NO: 412331 - protein, 11 aa, Influenza virus
VTDGPSDAQAF

SEQ ID NO: 412332 - protein, 11 aa, Influenza virus
KLLKIRKGKIV

SEQ ID NO: 412333 - protein, 11 aa, Influenza virus
AAGFHFEECSC

SEQ ID NO: 412334 - protein, 11 aa, Influenza virus
TGFHLEECSCY

SEQ ID NO: 412335 - protein, 11 aa, Influenza virus
EECSCYPSREN

SEQ ID NO: 412336 - protein, 11 aa, Influenza virus
RPWVRFNSDLD

SEQ ID NO: 412337 - protein, 11 aa, Influenza virus
PWVRFNSDLDY

SEQ ID NO: 412338 - protein, 11 aa, Influenza virus
WIRFNSDPDYQ

SEQ ID NO: 412339 - protein, 11 aa, Influenza virus
IRFNSDLNYQI

SEQ ID NO: 412340 - protein, 11 aa, Influenza virus
NSDLNYQIGYI

SEQ ID NO: 412341 - protein, 11 aa, Influenza virus
SDLNYQIGYIC

SEQ ID NO: 412342 - protein, 11 aa, Influenza virus
DLNYQIGYICS

SEQ ID NO: 412343 - protein, 11 aa, Influenza virus
GYVCSGIFGDS

SEQ ID NO: 412344 - protein, 11 aa, Influenza virus
YVCSGIFGDSP

SEQ ID NO: 412345 - protein, 11 aa, Influenza virus
ICSGIFGDNPR

SEQ ID NO: 412346 - protein, 11 aa, Influenza virus
DDNGWVSTDKD

SEQ ID NO: 412347 - protein, 11 aa, Influenza virus
DNGWVSTDKDS

SEQ ID NO: 412348 - protein, 11 aa, Influenza virus
AFCGVNSDTTS

SEQ ID NO: 412349 - protein, 11 aa, Influenza virus
FCGVNSDTTSW

SEQ ID NO: 412350 - protein, 11 aa, Influenza virus
SDTTCWSWPDG

SEQ ID NO: 412351 - protein, 11 aa, Influenza virus
DTTGWPWPDGA

SEQ ID NO: 412352 - protein, 11 aa, Influenza virus
TGWPWPDGALL

SEQ ID NO: 412353 - protein, 11 aa, Influenza virus
CWSWPDGALLP

SEQ ID NO: 412354 - protein, 11 aa, Influenza virus
PNQKIITIGSM

SEQ ID NO: 412355 - protein, 11 aa, Influenza virus
NQKIMTIGSVS

SEQ ID NO: 412356 - protein, 11 aa, Influenza virus
QKIMTIGSVSL

SEQ ID NO: 412357 - protein, 11 aa, Influenza virus
KIMTIGSVSLA

SEQ ID NO: 412358 - protein, 11 aa, Influenza virus
IITIGSVSLTL

SEQ ID NO: 412359 - protein, 11 aa, Influenza virus
FFNNTEPLCEV

SEQ ID NO: 412360 - protein, 11 aa, Influenza virus
FNNTEPLCEVS

SEQ ID NO: 412361 - protein, 11 aa, Influenza virus
TEPLCEVSGFV

SEQ ID NO: 412362 - protein, 11 aa, Influenza virus
EPLCEVSGFAV

SEQ ID NO: 412363 - protein, 11 aa, Influenza virus
SGFAVVSKDNG

SEQ ID NO: 412364 - protein, 11 aa, Influenza virus
GFAIASKDNGI

SEQ ID NO: 412365 - protein, 11 aa, Influenza virus
FAVVSKDNGIR

SEQ ID NO: 412366 - protein, 11 aa, Influenza virus
IISKDNGIRIG

SEQ ID NO: 412367 - protein, 11 aa, Influenza virus
ISKDNGIRIGS

SEQ ID NO: 412368 - protein, 11 aa, Influenza virus
IREPFVACGPA

SEQ ID NO: 412369 - protein, 11 aa, Influenza virus
REPFVACGPAE

SEQ ID NO: 412370 - protein, 11 aa, Influenza virus
EPFVACGPAEC

SEQ ID NO: 412371 - protein, 11 aa, Influenza virus
PFVACGPAECR

SEQ ID NO: 412372 - protein, 11 aa, Influenza virus
FVACGPAECRT

SEQ ID NO: 412373 - protein, 11 aa, Influenza virus
VACGPAECRTF

SEQ ID NO: 412374 - protein, 11 aa, Influenza virus
ACGPAECRTFF

SEQ ID NO: 412375 - protein, 11 aa, Influenza virus
CSPSECRTFFL

SEQ ID NO: 412376 - protein, 11 aa, Influenza virus
SPSECRTFFLT

SEQ ID NO: 412377 - protein, 11 aa, Influenza virus
STECRTFFLTQ

SEQ ID NO: 412378 - protein, 11 aa, Influenza virus
LGSSPNAYQAQ

SEQ ID NO: 412379 - protein, 11 aa, Influenza virus
PNAYQAQFESV

SEQ ID NO: 412380 - protein, 11 aa, Influenza virus
ATACHDGKGWL

SEQ ID NO: 412381 - protein, 11 aa, Influenza virus
GVSGTDDDAYA

SEQ ID NO: 412382 - protein, 11 aa, Influenza virus
VSGTDDDAYAV

SEQ ID NO: 412383 - protein, 11 aa, Influenza virus
IHYGGVPTDVI

SEQ ID NO: 412384 - protein, 11 aa, Influenza virus
HYGGVPTDVIR

SEQ ID NO: 412385 - protein, 11 aa, Influenza virus
YGGVPTDVIRS

SEQ ID NO: 412386 - protein, 11 aa, Influenza virus
GGVPTDVIRSW

SEQ ID NO: 412387 - protein, 11 aa, Influenza virus
PTDVVRSWRKK

SEQ ID NO: 412388 - protein, 11 aa, Influenza virus
TDVVRSWRKKI

SEQ ID NO: 412389 - protein, 11 aa, Influenza virus
DVVRSWRKKIL

SEQ ID NO: 412390 - protein, 11 aa, Influenza virus
VVRSWRKKILR

SEQ ID NO: 412391 - protein, 11 aa, Influenza virus
VRSWRKKILRT

SEQ ID NO: 412392 - protein, 11 aa, Influenza virus
RSWRRQILRTQ

SEQ ID NO: 412393 - protein, 11 aa, Influenza virus
SWRRQILRTQE

SEQ ID NO: 412394 - protein, 11 aa, Influenza virus
WRRQILRTQES

SEQ ID NO: 412395 - protein, 11 aa, Influenza virus
RRQILRTQESS

SEQ ID NO: 412396 - protein, 11 aa, Influenza virus
RTQESSCVCIK

SEQ ID NO: 412397 - protein, 11 aa, Influenza virus
TQESSCVCIKG

SEQ ID NO: 412398 - protein, 11 aa, Influenza virus
YWVMTDGPASN

SEQ ID NO: 412399 - protein, 11 aa, Influenza virus
WVMTDGPASNQ

SEQ ID NO: 412400 - protein, 11 aa, Influenza virus
VMTDGPASNQA

SEQ ID NO: 412401 - protein, 11 aa, Influenza virus
MTDGPASNQAS

SEQ ID NO: 412402 - protein, 11 aa, Influenza virus
TDGPASNQASY

SEQ ID NO: 412403 - protein, 11 aa, Influenza virus
DGPASNQASYK

SEQ ID NO: 412404 - protein, 11 aa, Influenza virus
GPASNQASYKI

SEQ ID NO: 412405 - protein, 11 aa, Influenza virus
PASNQASYKIF

SEQ ID NO: 412406 - protein, 11 aa, Influenza virus
ASNQASYKIFK

SEQ ID NO: 412407 - protein, 11 aa, Influenza virus
NKQASYKIFKS

SEQ ID NO: 412408 - protein, 11 aa, Influenza virus
EVSFRGGHIEE

SEQ ID NO: 412409 - protein, 11 aa, Influenza virus
ISFQSGHIEEC

SEQ ID NO: 412410 - protein, 11 aa, Influenza virus
EECSCYPNLGQ

SEQ ID NO: 412411 - protein, 11 aa, Influenza virus
ECSCYPNLGQV

SEQ ID NO: 412412 - protein, 11 aa, Influenza virus
CSCYPNLGQVE

SEQ ID NO: 412413 - protein, 11 aa, Influenza virus
SCYPNLGQVEC

SEQ ID NO: 412414 - protein, 11 aa, Influenza virus
CYPNLGQVECV

SEQ ID NO: 412415 - protein, 11 aa, Influenza virus
YPNLGQVECVC

SEQ ID NO: 412416 - protein, 11 aa, Influenza virus
PNLGQVECVCR

SEQ ID NO: 412417 - protein, 11 aa, Influenza virus
NLGQVECVCRD

SEQ ID NO: 412418 - protein, 11 aa, Influenza virus
LGQVECVCRDN

SEQ ID NO: 412419 - protein, 11 aa, Influenza virus
YKVGYLCAGIP

SEQ ID NO: 412420 - protein, 11 aa, Influenza virus
DVGYLCAGIPT

SEQ ID NO: 412421 - protein, 11 aa, Influenza virus
IPTDTPRVQDD

SEQ ID NO: 412422 - protein, 11 aa, Influenza virus
AVGRSGTNNYG

SEQ ID NO: 412423 - protein, 11 aa, Influenza virus
IGGSGTDNYGV

SEQ ID NO: 412424 - protein, 11 aa, Influenza virus
QGNSVWAGRTM

SEQ ID NO: 412425 - protein, 11 aa, Influenza virus
SSRNGFEILLI

SEQ ID NO: 412426 - protein, 11 aa, Influenza virus
RSGFEVLLIEN

SEQ ID NO: 412427 - protein, 11 aa, Influenza virus
NGFEILLIEDG

SEQ ID NO: 412428 - protein, 11 aa, Influenza virus
GFEVLFIEDGW

SEQ ID NO: 412429 - protein, 11 aa, Influenza virus
EILNNKNWSGY

SEQ ID NO: 412430 - protein, 11 aa, Influenza virus
VLNNRNWSGYS

SEQ ID NO: 412431 - protein, 11 aa, Influenza virus
LNNMNWSGYSG

SEQ ID NO: 412432 - protein, 11 aa, Influenza virus
NNRNWSGYSGS

SEQ ID NO: 412433 - protein, 11 aa, Influenza virus
NKHWSGYSGSF

SEQ ID NO: 412434 - protein, 11 aa, Influenza virus
RNWSGYSGSFT

SEQ ID NO: 412435 - protein, 11 aa, Influenza virus
SGYSGAFTVPI

SEQ ID NO: 412436 - protein, 11 aa, Influenza virus
LEMIRGKPKER

SEQ ID NO: 412437 - protein, 11 aa, Influenza virus
PEEKTSIWTSS

SEQ ID NO: 412438 - protein, 11 aa, Influenza virus
EERNSIWTSSS

SEQ ID NO: 412439 - protein, 11 aa, Influenza virus
ERNSIWTSSSS

SEQ ID NO: 412440 - protein, 11 aa, Influenza virus
RTSIWTSSSSM

SEQ ID NO: 412441 - protein, 11 aa, Influenza virus
FCGVSSEVPEW

SEQ ID NO: 412442 - protein, 11 aa, Influenza virus
CGVSSEVPEWS

SEQ ID NO: 412443 - protein, 11 aa, Influenza virus
GVSSEVPEWSW

SEQ ID NO: 412444 - protein, 11 aa, Influenza virus
VSSEVPGWSWG

SEQ ID NO: 412445 - protein, 11 aa, Influenza virus
SSEVPGWSWGD

SEQ ID NO: 412446 - protein, 11 aa, Influenza virus
SEVPGWSWGDG

SEQ ID NO: 412447 - protein, 11 aa, Influenza virus
NPNQKIICIST

SEQ ID NO: 412448 - protein, 11 aa, Influenza virus
PNQKIICISTT

SEQ ID NO: 412449 - protein, 11 aa, Influenza virus
CISATGMALSV

SEQ ID NO: 412450 - protein, 11 aa, Influenza virus
KSLCEVNSWHI

SEQ ID NO: 412451 - protein, 11 aa, Influenza virus
PLCEVNSWHIF

SEQ ID NO: 412452 - protein, 11 aa, Influenza virus
LCEVNSWHIFS

SEQ ID NO: 412453 - protein, 11 aa, Influenza virus
CEVNSWHIFSK

SEQ ID NO: 412454 - protein, 11 aa, Influenza virus
EVNSWHIFSKD

SEQ ID NO: 412455 - protein, 11 aa, Influenza virus
SKDNAVRIGED

SEQ ID NO: 412456 - protein, 11 aa, Influenza virus
KDNAVRIGEDA

SEQ ID NO: 412457 - protein, 11 aa, Influenza virus
DNAIRIGEGAH

SEQ ID NO: 412458 - protein, 11 aa, Influenza virus
DAHVLVTREPY

SEQ ID NO: 412459 - protein, 11 aa, Influenza virus
TLKGRHANGTI

SEQ ID NO: 412460 - protein, 11 aa, Influenza virus
LRGRHANGTMH

SEQ ID NO: 412461 - protein, 11 aa, Influenza virus
RGRHANGTMHD

SEQ ID NO: 412462 - protein, 11 aa, Influenza virus
GRHANGTINDR

SEQ ID NO: 412463 - protein, 11 aa, Influenza virus
RHANGTINDRS

SEQ ID NO: 412464 - protein, 11 aa, Influenza virus
HANGTINDRSP

SEQ ID NO: 412465 - protein, 11 aa, Influenza virus
ANGTMHDRSPF

SEQ ID NO: 412466 - protein, 11 aa, Influenza virus
NGTMHDRSPFR

SEQ ID NO: 412467 - protein, 11 aa, Influenza virus
GTMHDRSPFRA

SEQ ID NO: 412468 - protein, 11 aa, Influenza virus
TMHDRSPFRAL

SEQ ID NO: 412469 - protein, 11 aa, Influenza virus
HDRSPYRALIS

SEQ ID NO: 412470 - protein, 11 aa, Influenza virus
DRSPYRALISW

SEQ ID NO: 412471 - protein, 11 aa, Influenza virus
RSPYRALISWE

SEQ ID NO: 412472 - protein, 11 aa, Influenza virus
SPYRALISWEM

SEQ ID NO: 412473 - protein, 11 aa, Influenza virus
PYRALISWEMG

SEQ ID NO: 412474 - protein, 11 aa, Influenza virus
FRALISWGMGQ

SEQ ID NO: 412475 - protein, 11 aa, Influenza virus
RALISWEMGLA

SEQ ID NO: 412476 - protein, 11 aa, Influenza virus
ALISWEMGLAP

SEQ ID NO: 412477 - protein, 11 aa, Influenza virus
LISWEMGLAPS

SEQ ID NO: 412478 - protein, 11 aa, Influenza virus
ISWEMGLAPSP

SEQ ID NO: 412479 - protein, 11 aa, Influenza virus
WEMGLAPSPYN

SEQ ID NO: 412480 - protein, 11 aa, Influenza virus
IECVGWSSTSC

SEQ ID NO: 412481 - protein, 11 aa, Influenza virus
GWSSTSCHDGR

SEQ ID NO: 412482 - protein, 11 aa, Influenza virus
SSTSCHDGRSR

SEQ ID NO: 412483 - protein, 11 aa, Influenza virus
STSCHDGRSRM

SEQ ID NO: 412484 - protein, 11 aa, Influenza virus
TSCHDGRSRMS

SEQ ID NO: 412485 - protein, 11 aa, Influenza virus
SRMSICVSGPN

SEQ ID NO: 412486 - protein, 11 aa, Influenza virus
RMSVCMSGPNN

SEQ ID NO: 412487 - protein, 11 aa, Influenza virus
MSVCMSGPNNN

SEQ ID NO: 412488 - protein, 11 aa, Influenza virus
SVCMSGPNNNA

SEQ ID NO: 412489 - protein, 11 aa, Influenza virus
VCMSGPNNNAS

SEQ ID NO: 412490 - protein, 11 aa, Influenza virus
CVSGPNNNASA

SEQ ID NO: 412491 - protein, 11 aa, Influenza virus
VSGPNNNASAV

SEQ ID NO: 412492 - protein, 11 aa, Influenza virus
TEIPSWAGNVL

SEQ ID NO: 412493 - protein, 11 aa, Influenza virus
EIPSWAGNVLR

SEQ ID NO: 412494 - protein, 11 aa, Influenza virus
IPSWAGNVLRT

SEQ ID NO: 412495 - protein, 11 aa, Influenza virus
PSWAGNVLRTQ

SEQ ID NO: 412496 - protein, 11 aa, Influenza virus
QESECVCHNGV

SEQ ID NO: 412497 - protein, 11 aa, Influenza virus
ESECVCHNGVC

SEQ ID NO: 412498 - protein, 11 aa, Influenza virus
SECVCHNGVCP

SEQ ID NO: 412499 - protein, 11 aa, Influenza virus
ECVCHNGVCPV

SEQ ID NO: 412500 - protein, 11 aa, Influenza virus
CVCHNGVCPVV

SEQ ID NO: 412501 - protein, 11 aa, Influenza virus
CPVVMTDGPAD

SEQ ID NO: 412502 - protein, 11 aa, Influenza virus
GKAQHIEECSC

SEQ ID NO: 412503 - protein, 11 aa, Influenza virus
SAEHIEECSCY

SEQ ID NO: 412504 - protein, 11 aa, Influenza virus
IKCICRDNWRG

SEQ ID NO: 412505 - protein, 11 aa, Influenza virus
NWRGANRPVIT

SEQ ID NO: 412506 - protein, 11 aa, Influenza virus
WRGANRPVITI

SEQ ID NO: 412507 - protein, 11 aa, Influenza virus
YLCSRVLTDTS

SEQ ID NO: 412508 - protein, 11 aa, Influenza virus
LCSRVLTDTSR

SEQ ID NO: 412509 - protein, 11 aa, Influenza virus
CSRVLTDTSRP

SEQ ID NO: 412510 - protein, 11 aa, Influenza virus
GGNPDPGVKGF

SEQ ID NO: 412511 - protein, 11 aa, Influenza virus
GTPDPGVKGFA

SEQ ID NO: 412512 - protein, 11 aa, Influenza virus
TPDPGVKGFAF

SEQ ID NO: 412513 - protein, 11 aa, Influenza virus
PGVKGFAFLDR

SEQ ID NO: 412514 - protein, 11 aa, Influenza virus
SWLGRTISKDT

SEQ ID NO: 412515 - protein, 11 aa, Influenza virus
WLGRTISKDTR

SEQ ID NO: 412516 - protein, 11 aa, Influenza virus
LGRTISKDTRS

SEQ ID NO: 412517 - protein, 11 aa, Influenza virus
GRTISKDTRSG

SEQ ID NO: 412518 - protein, 11 aa, Influenza virus
RTISKDTRSGY

SEQ ID NO: 412519 - protein, 11 aa, Influenza virus
TISKDTRSGYE

SEQ ID NO: 412520 - protein, 11 aa, Influenza virus
DLRSGYEMLKV

SEQ ID NO: 412521 - protein, 11 aa, Influenza virus
LRSGYEMLKVP

SEQ ID NO: 412522 - protein, 11 aa, Influenza virus
RSGYEVLKVPD

SEQ ID NO: 412523 - protein, 11 aa, Influenza virus
SGYEVLKVPDA

SEQ ID NO: 412524 - protein, 11 aa, Influenza virus
GYEVLKVPDAE

SEQ ID NO: 412525 - protein, 11 aa, Influenza virus
IVDNQNWSGYS

SEQ ID NO: 412526 - protein, 11 aa, Influenza virus
VNNPNWSGYSG

SEQ ID NO: 412527 - protein, 11 aa, Influenza virus
NNQKWSGYSGA

SEQ ID NO: 412528 - protein, 11 aa, Influenza virus
NPNWSGYSGAF

SEQ ID NO: 412529 - protein, 11 aa, Influenza virus
WSGYSGAFVDY

SEQ ID NO: 412530 - protein, 11 aa, Influenza virus
SGYSGAFVDYW

SEQ ID NO: 412531 - protein, 11 aa, Influenza virus
FYVELIRGKPK

SEQ ID NO: 412532 - protein, 11 aa, Influenza virus
YAELIRGRPKE

SEQ ID NO: 412533 - protein, 11 aa, Influenza virus
VLWTSNSMVAL

SEQ ID NO: 412534 - protein, 11 aa, Influenza virus
LWTSNSVVALC

SEQ ID NO: 412535 - protein, 11 aa, Influenza virus
SIVALCGSKKR

SEQ ID NO: 412536 - protein, 11 aa, Influenza virus
IVALCGSKKRL

SEQ ID NO: 412537 - protein, 11 aa, Influenza virus
VALCGSKKRLG

SEQ ID NO: 412538 - protein, 11 aa, Influenza virus
ALCGSKKRLGS

SEQ ID NO: 412539 - protein, 11 aa, Influenza virus
LCGSKKRLGSW

SEQ ID NO: 412540 - protein, 11 aa, Influenza virus
CGSKKRLGSWS

SEQ ID NO: 412541 - protein, 11 aa, Influenza virus
GSKKRLGSWSW

SEQ ID NO: 412542 - protein, 11 aa, Influenza virus
SKKRLGSWSWH

SEQ ID NO: 412543 - protein, 11 aa, Influenza virus
KKRLGSWSWHD

SEQ ID NO: 412544 - protein, 11 aa, Influenza virus
MNPSQKLFALS

SEQ ID NO: 412545 - protein, 11 aa, Influenza virus
NPSQKLFALSG

SEQ ID NO: 412546 - protein, 11 aa, Influenza virus
PSQKLFALSGV

SEQ ID NO: 412547 - protein, 11 aa, Influenza virus
SQKLFALSGVA

SEQ ID NO: 412548 - protein, 11 aa, Influenza virus
QKLFALSGVAV

SEQ ID NO: 412549 - protein, 11 aa, Influenza virus
NLLIGVSNVGL

SEQ ID NO: 412550 - protein, 11 aa, Influenza virus
LLIGVSNVGLN

SEQ ID NO: 412551 - protein, 11 aa, Influenza virus
SNIGLNVSLHL

SEQ ID NO: 412552 - protein, 11 aa, Influenza virus
ENKYVNNTTII

SEQ ID NO: 412553 - protein, 11 aa, Influenza virus
YLLLNKSLCSV

SEQ ID NO: 412554 - protein, 11 aa, Influenza virus
WVAVAKDNAIR

SEQ ID NO: 412555 - protein, 11 aa, Influenza virus
VAVAKDNAIRF

SEQ ID NO: 412556 - protein, 11 aa, Influenza virus
AVAKDNAIRFG

SEQ ID NO: 412557 - protein, 11 aa, Influenza virus
IAQDNAIRFGE

SEQ ID NO: 412558 - protein, 11 aa, Influenza virus
NAIRFGEGEQI

SEQ ID NO: 412559 - protein, 11 aa, Influenza virus
AIRFGEGEQII

SEQ ID NO: 412560 - protein, 11 aa, Influenza virus
IRFGEGEQIIV

SEQ ID NO: 412561 - protein, 11 aa, Influenza virus
TREPYVSCDPI

SEQ ID NO: 412562 - protein, 11 aa, Influenza virus
GCKMFALHQGT

SEQ ID NO: 412563 - protein, 11 aa, Influenza virus
TIRNRHSNGTI

SEQ ID NO: 412564 - protein, 11 aa, Influenza virus
IRNRHSNGTIH

SEQ ID NO: 412565 - protein, 11 aa, Influenza virus
RNRHSNGTIHD

SEQ ID NO: 412566 - protein, 11 aa, Influenza virus
NRHSNGTIHDR

SEQ ID NO: 412567 - protein, 11 aa, Influenza virus
TINDRTAFRGL

SEQ ID NO: 412568 - protein, 11 aa, Influenza virus
DGTAFRGLIST

SEQ ID NO: 412569 - protein, 11 aa, Influenza virus
AFRGLISTQLG

SEQ ID NO: 412570 - protein, 11 aa, Influenza virus
SNSEFICVGWS

SEQ ID NO: 412571 - protein, 11 aa, Influenza virus
NSEFICVGWSS

SEQ ID NO: 412572 - protein, 11 aa, Influenza virus
SEFICVGWSST

SEQ ID NO: 412573 - protein, 11 aa, Influenza virus
FICVGWSSTTC

SEQ ID NO: 412574 - protein, 11 aa, Influenza virus
ICVGWSSTTCH

SEQ ID NO: 412575 - protein, 11 aa, Influenza virus
GWSSTTCHDGV

SEQ ID NO: 412576 - protein, 11 aa, Influenza virus
CHDGVSRMTIC

SEQ ID NO: 412577 - protein, 11 aa, Influenza virus
QGNNENATATV

SEQ ID NO: 412578 - protein, 11 aa, Influenza virus
GNNENATATVY

SEQ ID NO: 412579 - protein, 11 aa, Influenza virus
NNENATATVYY

SEQ ID NO: 412580 - protein, 11 aa, Influenza virus
NENATATVYYN

SEQ ID NO: 412581 - protein, 11 aa, Influenza virus
NATATVYYNGR

SEQ ID NO: 412582 - protein, 11 aa, Influenza virus
ATATVYYNGRL

SEQ ID NO: 412583 - protein, 11 aa, Influenza virus
TATVYYNGRLT

SEQ ID NO: 412584 - protein, 11 aa, Influenza virus
ATVYYNGRLTT

SEQ ID NO: 412585 - protein, 11 aa, Influenza virus
TVYYNGRLTTT

SEQ ID NO: 412586 - protein, 11 aa, Influenza virus
VYYNGRLTTTI

SEQ ID NO: 412587 - protein, 11 aa, Influenza virus
RRLTTTIKPWA

SEQ ID NO: 412588 - protein, 11 aa, Influenza virus
RLTTTIKPWAR

SEQ ID NO: 412589 - protein, 11 aa, Influenza virus
TTTIKTWAGKI

SEQ ID NO: 412590 - protein, 11 aa, Influenza virus
TTIKTWAGKIL

SEQ ID NO: 412591 - protein, 11 aa, Influenza virus
TIKTWAGKILR

SEQ ID NO: 412592 - protein, 11 aa, Influenza virus
IKTWAGKILRT

SEQ ID NO: 412593 - protein, 11 aa, Influenza virus
KTWAGKILRTQ

SEQ ID NO: 412594 - protein, 11 aa, Influenza virus
TWAGKILRTQE

SEQ ID NO: 412595 - protein, 11 aa, Influenza virus
WAGKILRTQES

SEQ ID NO: 412596 - protein, 11 aa, Influenza virus
AGKILRTQESE

SEQ ID NO: 412597 - protein, 11 aa, Influenza virus
GKILRTQESEC

SEQ ID NO: 412598 - protein, 11 aa, Influenza virus
SECVSHNGTWA

SEQ ID NO: 412599 - protein, 11 aa, Influenza virus
LQGSARHIEEC

SEQ ID NO: 412600 - protein, 11 aa, Influenza virus
GSARHVEECSC

SEQ ID NO: 412601 - protein, 11 aa, Influenza virus
SARHIEEWSCY

SEQ ID NO: 412602 - protein, 11 aa, Influenza virus
ARHVEECSCYG

SEQ ID NO: 412603 - protein, 11 aa, Influenza virus
RHIEEWSCYGH

SEQ ID NO: 412604 - protein, 11 aa, Influenza virus
HIEEWSCYGHS

SEQ ID NO: 412605 - protein, 11 aa, Influenza virus
VSCVCRDNWQG

SEQ ID NO: 412606 - protein, 11 aa, Influenza virus
QGANRPVIEIN

SEQ ID NO: 412607 - protein, 11 aa, Influenza virus
GANRPVIEINM

SEQ ID NO: 412608 - protein, 11 aa, Influenza virus
TGVLTDTSRPG

SEQ ID NO: 412609 - protein, 11 aa, Influenza virus
GVLTDTSRPGD

SEQ ID NO: 412610 - protein, 11 aa, Influenza virus
DCSNPITGSPS

SEQ ID NO: 412611 - protein, 11 aa, Influenza virus
NPITGSPGSPG

SEQ ID NO: 412612 - protein, 11 aa, Influenza virus
VPGVKGFGFLN

SEQ ID NO: 412613 - protein, 11 aa, Influenza virus
STWLGRTISPR

SEQ ID NO: 412614 - protein, 11 aa, Influenza virus
TWLGRTFSPRS

SEQ ID NO: 412615 - protein, 11 aa, Influenza virus
WLGRTISPHSR

SEQ ID NO: 412616 - protein, 11 aa, Influenza virus
TFSPRSRSGFE

SEQ ID NO: 412617 - protein, 11 aa, Influenza virus
STRSRSGFEML

SEQ ID NO: 412618 - protein, 11 aa, Influenza virus
SRSGFEVLKVP

SEQ ID NO: 412619 - protein, 11 aa, Influenza virus
RSGFEVLKVPN

SEQ ID NO: 412620 - protein, 11 aa, Influenza virus
SGFEVLKVPNA

SEQ ID NO: 412621 - protein, 11 aa, Influenza virus
GFEMLKVPNAG

SEQ ID NO: 412622 - protein, 11 aa, Influenza virus
SKCYNPCFYVE

SEQ ID NO: 412623 - protein, 11 aa, Influenza virus
RPEEVKYVWWT

SEQ ID NO: 412624 - protein, 11 aa, Influenza virus
PEEVKYVWWTS

SEQ ID NO: 412625 - protein, 11 aa, Influenza virus
EEVKYVWWTSN

SEQ ID NO: 412626 - protein, 11 aa, Influenza virus
EVKYVWWTSNS

SEQ ID NO: 412627 - protein, 11 aa, Influenza virus
VKYVWWTSNSL

SEQ ID NO: 412628 - protein, 11 aa, Influenza virus
KYVWWASNSLI

SEQ ID NO: 412629 - protein, 11 aa, Influenza virus
YVWWASNSLIA

SEQ ID NO: 412630 - protein, 11 aa, Influenza virus
VWWASNSLIAL

SEQ ID NO: 412631 - protein, 11 aa, Influenza virus
WWASNSLIALC

SEQ ID NO: 412632 - protein, 11 aa, Influenza virus
NSLIALCGSPI

SEQ ID NO: 412633 - protein, 11 aa, Influenza virus
PIGSGFFPDGP

SEQ ID NO: 412634 - protein, 11 aa, Influenza virus
VGSGSFPNGAQ

SEQ ID NO: 412635 - protein, 11 aa, Influenza virus
GSGSFPNGAQI

SEQ ID NO: 412636 - protein, 11 aa, Influenza virus
GSFPDGARIQY

SEQ ID NO: 412637 - protein, 11 aa, Influenza virus
SFPDGARIQYF

SEQ ID NO: 412638 - protein, 11 aa, Influenza virus
LPDGAQIQYFS

SEQ ID NO: 412639 - protein, 11 aa, Influenza virus
EGFAPFSKDNG

SEQ ID NO: 412640 - protein, 11 aa, Influenza virus
IRIGSRGHVFI

SEQ ID NO: 412641 - protein, 11 aa, Influenza virus
HVFVIREPFIS

SEQ ID NO: 412642 - protein, 11 aa, Influenza virus
VFVIREPFISC

SEQ ID NO: 412643 - protein, 11 aa, Influenza virus
DCRTFFLTQGS

SEQ ID NO: 412644 - protein, 11 aa, Influenza virus
KTFFLTQGSLL

SEQ ID NO: 412645 - protein, 11 aa, Influenza virus
TFFLTQGSLPN

SEQ ID NO: 412646 - protein, 11 aa, Influenza virus
FLTQGSLPNDK

SEQ ID NO: 412647 - protein, 11 aa, Influenza virus
ITQGSLLNDKH

SEQ ID NO: 412648 - protein, 11 aa, Influenza virus
TQGSLLNDKHF

SEQ ID NO: 412649 - protein, 11 aa, Influenza virus
QGSLLNDKHFN

SEQ ID NO: 412650 - protein, 11 aa, Influenza virus
GSLPNDKHSNG

SEQ ID NO: 412651 - protein, 11 aa, Influenza virus
SLPNDKHSNGT

SEQ ID NO: 412652 - protein, 11 aa, Influenza virus
NDKHSNGTMKD

SEQ ID NO: 412653 - protein, 11 aa, Influenza virus
DKHSNGTMKDR

SEQ ID NO: 412654 - protein, 11 aa, Influenza virus
KHSNGTMKDRS

SEQ ID NO: 412655 - protein, 11 aa, Influenza virus
HSSGTVKDRSP

SEQ ID NO: 412656 - protein, 11 aa, Influenza virus
SNGTMKDRSPY

SEQ ID NO: 412657 - protein, 11 aa, Influenza virus
NGTMKDRSPYR

SEQ ID NO: 412658 - protein, 11 aa, Influenza virus
GTMKDRSPYRT

SEQ ID NO: 412659 - protein, 11 aa, Influenza virus
TMKDRSPYRTL

SEQ ID NO: 412660 - protein, 11 aa, Influenza virus
MKDRSPYRTLM

SEQ ID NO: 412661 - protein, 11 aa, Influenza virus
RSPFRTLMSVK

SEQ ID NO: 412662 - protein, 11 aa, Influenza virus
GLSPNVYQARF

SEQ ID NO: 412663 - protein, 11 aa, Influenza virus
LSPNVYQARFE

SEQ ID NO: 412664 - protein, 11 aa, Influenza virus
VYQSRFEAVAW

SEQ ID NO: 412665 - protein, 11 aa, Influenza virus
YQSRFEAVAWS

SEQ ID NO: 412666 - protein, 11 aa, Influenza virus
QSRFEAVAWSA

SEQ ID NO: 412667 - protein, 11 aa, Influenza virus
SRFEAVAWSAT

SEQ ID NO: 412668 - protein, 11 aa, Influenza virus
KFEAVAWSATA

SEQ ID NO: 412669 - protein, 11 aa, Influenza virus
ATACHDGKKWI

SEQ ID NO: 412670 - protein, 11 aa, Influenza virus
GDILRTQEFSC

SEQ ID NO: 412671 - protein, 11 aa, Influenza virus
DILRTQESSCS

SEQ ID NO: 412672 - protein, 11 aa, Influenza virus
RTQESSCTCIL

SEQ ID NO: 412673 - protein, 11 aa, Influenza virus
TQESSCTCILG

SEQ ID NO: 412674 - protein, 11 aa, Influenza virus
GNCYWVMTDGP

SEQ ID NO: 412675 - protein, 11 aa, Influenza virus
NCYWVMTDGPA

SEQ ID NO: 412676 - protein, 11 aa, Influenza virus
WVMTDGPANNQ

SEQ ID NO: 412677 - protein, 11 aa, Influenza virus
VMTDGPANNQA

SEQ ID NO: 412678 - protein, 11 aa, Influenza virus
FNEGHIEECSC

SEQ ID NO: 412679 - protein, 11 aa, Influenza virus
NEGHIEECSCY

SEQ ID NO: 412680 - protein, 11 aa, Influenza virus
CYPNNGKVECI

SEQ ID NO: 412681 - protein, 11 aa, Influenza virus
YPNNGKVECIC

SEQ ID NO: 412682 - protein, 11 aa, Influenza virus
PNNGKVECICR

SEQ ID NO: 412683 - protein, 11 aa, Influenza virus
NNGKVECICRD

SEQ ID NO: 412684 - protein, 11 aa, Influenza virus
NGKVECICRDN

SEQ ID NO: 412685 - protein, 11 aa, Influenza virus
NWTGTNRPILA

SEQ ID NO: 412686 - protein, 11 aa, Influenza virus
WTGTNRPVLVV

SEQ ID NO: 412687 - protein, 11 aa, Influenza virus
LSYQVGYLCAG

SEQ ID NO: 412688 - protein, 11 aa, Influenza virus
PSDTPRGEDNQ

SEQ ID NO: 412689 - protein, 11 aa, Influenza virus
SDTPRGEDNQF

SEQ ID NO: 412690 - protein, 11 aa, Influenza virus
VKGFGFRQGSD

SEQ ID NO: 412691 - protein, 11 aa, Influenza virus
KGFGFRQGSDV

SEQ ID NO: 412692 - protein, 11 aa, Influenza virus
GFGFRQGSDVW

SEQ ID NO: 412693 - protein, 11 aa, Influenza virus
DNPNWSGYSGS

SEQ ID NO: 412694 - protein, 11 aa, Influenza virus
NPNWSGYSGSF

SEQ ID NO: 412695 - protein, 11 aa, Influenza virus
YSGSFTLPVGL

SEQ ID NO: 412696 - protein, 11 aa, Influenza virus
WVETIRGKPEE

SEQ ID NO: 412697 - protein, 11 aa, Influenza virus
AIWTSSSSIVM

SEQ ID NO: 412698 - protein, 11 aa, Influenza virus
SSSIVMCGVNY

SEQ ID NO: 412699 - protein, 11 aa, Influenza virus
SWSWHDGAVLP

SEQ ID NO: 412700 - protein, 11 aa, Influenza virus
WSWQDGAILPF

SEQ ID NO: 412701 - protein, 11 aa, Influenza virus
MNPNQRILCTS

SEQ ID NO: 412702 - protein, 11 aa, Influenza virus
NPNQRILCTSA

SEQ ID NO: 412703 - protein, 11 aa, Influenza virus
PNQKILCTSAI

SEQ ID NO: 412704 - protein, 11 aa, Influenza virus
NQKILFASATA

SEQ ID NO: 412705 - protein, 11 aa, Influenza virus
QKILCTSATAL

SEQ ID NO: 412706 - protein, 11 aa, Influenza virus
TNLGLNIGLHL

SEQ ID NO: 412707 - protein, 11 aa, Influenza virus
FNNLTKRLCTI

SEQ ID NO: 412708 - protein, 11 aa, Influenza virus
NNLTKRLCTIN

SEQ ID NO: 412709 - protein, 11 aa, Influenza virus
NLTKRLCTINS

SEQ ID NO: 412710 - protein, 11 aa, Influenza virus
LTKRLCTINSW

SEQ ID NO: 412711 - protein, 11 aa, Influenza virus
TKRLCTINSWH

SEQ ID NO: 412712 - protein, 11 aa, Influenza virus
KRLCTINSWHI

SEQ ID NO: 412713 - protein, 11 aa, Influenza virus
RLCTINSWHIY

SEQ ID NO: 412714 - protein, 11 aa, Influenza virus
SWHIYGKDNAI

SEQ ID NO: 412715 - protein, 11 aa, Influenza virus
WHIYGKDNAIR

SEQ ID NO: 412716 - protein, 11 aa, Influenza virus
HIYGKDNAIRI

SEQ ID NO: 412717 - protein, 11 aa, Influenza virus
IYGKDNAIRIG

SEQ ID NO: 412718 - protein, 11 aa, Influenza virus
YGKDNAIRIGE

SEQ ID NO: 412719 - protein, 11 aa, Influenza virus
GKDNAIRIGED

SEQ ID NO: 412720 - protein, 11 aa, Influenza virus
KDNAIRIGEDS

SEQ ID NO: 412721 - protein, 11 aa, Influenza virus
RIGESSDVLVT

SEQ ID NO: 412722 - protein, 11 aa, Influenza virus
IGGNSDVLVTR

SEQ ID NO: 412723 - protein, 11 aa, Influenza virus
GEKSDVLVTRE

SEQ ID NO: 412724 - protein, 11 aa, Influenza virus
DSDVLVTRESY

SEQ ID NO: 412725 - protein, 11 aa, Influenza virus
REPYVSCDPNE

SEQ ID NO: 412726 - protein, 11 aa, Influenza virus
EPYVSCDPNEC

SEQ ID NO: 412727 - protein, 11 aa, Influenza virus
PYVSCDPNECR

SEQ ID NO: 412728 - protein, 11 aa, Influenza virus
YVSCDPNECRF

SEQ ID NO: 412729 - protein, 11 aa, Influenza virus
VSCDPNECRFY

SEQ ID NO: 412730 - protein, 11 aa, Influenza virus
SCDPNECRFYA

SEQ ID NO: 412731 - protein, 11 aa, Influenza virus
CDPNECRFYAL

SEQ ID NO: 412732 - protein, 11 aa, Influenza virus
DPNECRFYALS

SEQ ID NO: 412733 - protein, 11 aa, Influenza virus
SQYRALISWPQ

SEQ ID NO: 412734 - protein, 11 aa, Influenza virus
QYRALISWPQS

SEQ ID NO: 412735 - protein, 11 aa, Influenza virus
YRALISWPQSS

SEQ ID NO: 412736 - protein, 11 aa, Influenza virus
RALISWPQSSP

SEQ ID NO: 412737 - protein, 11 aa, Influenza virus
ALISWPQSSPP

SEQ ID NO: 412738 - protein, 11 aa, Influenza virus
PQSSPPTVYNS

SEQ ID NO: 412739 - protein, 11 aa, Influenza virus
WSSTSCHDGKF

SEQ ID NO: 412740 - protein, 11 aa, Influenza virus
SSTSCHDGKFR

SEQ ID NO: 412741 - protein, 11 aa, Influenza virus
STSCHDGKFRM

SEQ ID NO: 412742 - protein, 11 aa, Influenza virus
TSCHDGKFRMS

SEQ ID NO: 412743 - protein, 11 aa, Influenza virus
SGPNNNASTVI

SEQ ID NO: 412744 - protein, 11 aa, Influenza virus
GPNNNASAIIW

SEQ ID NO: 412745 - protein, 11 aa, Influenza virus
PNNNASPVIWY

SEQ ID NO: 412746 - protein, 11 aa, Influenza virus
NNNASAVIWYK

SEQ ID NO: 412747 - protein, 11 aa, Influenza virus
RPTTEINTWAR

SEQ ID NO: 412748 - protein, 11 aa, Influenza virus
PTTEINTWARN

SEQ ID NO: 412749 - protein, 11 aa, Influenza virus
TTEINTWARNI

SEQ ID NO: 412750 - protein, 11 aa, Influenza virus
QESECVCHDGV

SEQ ID NO: 412751 - protein, 11 aa, Influenza virus
ESECVCHDGVC

SEQ ID NO: 412752 - protein, 11 aa, Influenza virus
SECVCQNGVCP

SEQ ID NO: 412753 - protein, 11 aa, Influenza virus
ECVCQNGVCPV

SEQ ID NO: 412754 - protein, 11 aa, Influenza virus
CVCQNGVCPVV

SEQ ID NO: 412755 - protein, 11 aa, Influenza virus
VCHSGVCPVVF

SEQ ID NO: 412756 - protein, 11 aa, Influenza virus
CQNGVCPVVFT

SEQ ID NO: 412757 - protein, 11 aa, Influenza virus
HSGVCPVVFTD

SEQ ID NO: 412758 - protein, 11 aa, Influenza virus
DGVCPVVFTDG

SEQ ID NO: 412759 - protein, 11 aa, Influenza virus
GSATGPADTRV

SEQ ID NO: 412760 - protein, 11 aa, Influenza virus
SATGPADTRVY

SEQ ID NO: 412761 - protein, 11 aa, Influenza virus
ATGPADTRVYY

SEQ ID NO: 412762 - protein, 11 aa, Influenza virus
TGPADTRVYYF

SEQ ID NO: 412763 - protein, 11 aa, Influenza virus
RHIEECSCYGD

SEQ ID NO: 412764 - protein, 11 aa, Influenza virus
TMTHTSQYICS

SEQ ID NO: 412765 - protein, 11 aa, Influenza virus
LTDNPRPNDPV

SEQ ID NO: 412766 - protein, 11 aa, Influenza virus
CNDPYPGNNNK

SEQ ID NO: 412767 - protein, 11 aa, Influenza virus
NDPYPGNNNKG

SEQ ID NO: 412768 - protein, 11 aa, Influenza virus
DPYPGNNNKGV

SEQ ID NO: 412769 - protein, 11 aa, Influenza virus
PYPGSNNNGVK

SEQ ID NO: 412770 - protein, 11 aa, Influenza virus
YPGNNNGVKGF

SEQ ID NO: 412771 - protein, 11 aa, Influenza virus
PGSNNNGVKGF

SEQ ID NO: 412772 - protein, 11 aa, Influenza virus
GNNBNGVKGFS

SEQ ID NO: 412773 - protein, 11 aa, Influenza virus
NNBNGVKGFSY

SEQ ID NO: 412774 - protein, 11 aa, Influenza virus
NGVKGFSYLDE

SEQ ID NO: 412775 - protein, 11 aa, Influenza virus
NTWLGRTTSTA

SEQ ID NO: 412776 - protein, 11 aa, Influenza virus
TWLGRTLNTAS

SEQ ID NO: 412777 - protein, 11 aa, Influenza virus
WLGRTTSTASR

SEQ ID NO: 412778 - protein, 11 aa, Influenza virus
GRTLNTASRSG

SEQ ID NO: 412779 - protein, 11 aa, Influenza virus
RTLNTASRSGY

SEQ ID NO: 412780 - protein, 11 aa, Influenza virus
TISTASRYGYE

SEQ ID NO: 412781 - protein, 11 aa, Influenza virus
STASRSGYEVL

SEQ ID NO: 412782 - protein, 11 aa, Influenza virus
TASRAGYEMLK

SEQ ID NO: 412783 - protein, 11 aa, Influenza virus
ILKVPNALTDE

SEQ ID NO: 412784 - protein, 11 aa, Influenza virus
LKVPNALTDER

SEQ ID NO: 412785 - protein, 11 aa, Influenza virus
KVPNALIDDRS

SEQ ID NO: 412786 - protein, 11 aa, Influenza virus
VPNALTNDRSK

SEQ ID NO: 412787 - protein, 11 aa, Influenza virus
PNALTDERSKP

SEQ ID NO: 412788 - protein, 11 aa, Influenza virus
QGQIIVLNTDW

SEQ ID NO: 412789 - protein, 11 aa, Influenza virus
GQTIVLDTDWS

SEQ ID NO: 412790 - protein, 11 aa, Influenza virus
QTIVLTTDWSG

SEQ ID NO: 412791 - protein, 11 aa, Influenza virus
TIVLTTDWSGY

SEQ ID NO: 412792 - protein, 11 aa, Influenza virus
YSGSFVDYWAE

SEQ ID NO: 412793 - protein, 11 aa, Influenza virus
SGSFIDYWAEG

SEQ ID NO: 412794 - protein, 11 aa, Influenza virus
DYWAKGDCYRA

SEQ ID NO: 412795 - protein, 11 aa, Influenza virus
YWAKGDCYRAC

SEQ ID NO: 412796 - protein, 11 aa, Influenza virus
WAKGDCYRACF

SEQ ID NO: 412797 - protein, 11 aa, Influenza virus
AKGDCYRACFY

SEQ ID NO: 412798 - protein, 11 aa, Influenza virus
KGDCYRACFYV

SEQ ID NO: 412799 - protein, 11 aa, Influenza virus
LIRGRPKEDEV

SEQ ID NO: 412800 - protein, 11 aa, Influenza virus
IRGRPKEDEVW

SEQ ID NO: 412801 - protein, 11 aa, Influenza virus
RGRPKEDEVWW

SEQ ID NO: 412802 - protein, 11 aa, Influenza virus
GRPKEDEVWWT

SEQ ID NO: 412803 - protein, 11 aa, Influenza virus
RPKEDEVWWTS

SEQ ID NO: 412804 - protein, 11 aa, Influenza virus
PKEDEVWWTSN

SEQ ID NO: 412805 - protein, 11 aa, Influenza virus
KEDEVWWTSNS

SEQ ID NO: 412806 - protein, 11 aa, Influenza virus
EDEVWWTSNSI

SEQ ID NO: 412807 - protein, 11 aa, Influenza virus
DEVWWTSNSIV

SEQ ID NO: 412808 - protein, 11 aa, Influenza virus
EVWWTSNSIVS

SEQ ID NO: 412809 - protein, 11 aa, Influenza virus
WNWPDGAKIET

SEQ ID NO: 412810 - protein, 11 aa, Influenza virus
DWPDGAKIKYF

SEQ ID NO: 412811 - protein, 11 aa, Influenza virus
SLDKICLGHHA

SEQ ID NO: 412812 - protein, 11 aa, Influenza virus
DRICLGHHAVA

SEQ ID NO: 412813 - protein, 11 aa, Influenza virus
RICLGHHAVAN

SEQ ID NO: 412814 - protein, 11 aa, Influenza virus
ICLGHHAVTNG

SEQ ID NO: 412815 - protein, 11 aa, Influenza virus
CLGHHAVTNGT

SEQ ID NO: 412816 - protein, 11 aa, Influenza virus
KEKVTNATETV

SEQ ID NO: 412817 - protein, 11 aa, Influenza virus
QSFPQTTNTYR

SEQ ID NO: 412818 - protein, 11 aa, Influenza virus
NFPRTTNTYRN

SEQ ID NO: 412819 - protein, 11 aa, Influenza virus
RTTNTYRNTDS

SEQ ID NO: 412820 - protein, 11 aa, Influenza virus
LYGTQPLSISV

SEQ ID NO: 412821 - protein, 11 aa, Influenza virus
YGTQPLSISVG

SEQ ID NO: 412822 - protein, 11 aa, Influenza virus
GTQPLSISVGS

SEQ ID NO: 412823 - protein, 11 aa, Influenza virus
TQPLSISVGSS

SEQ ID NO: 412824 - protein, 11 aa, Influenza virus
QPLSISVGSST

SEQ ID NO: 412825 - protein, 11 aa, Influenza virus
PLSISVGSSTY

SEQ ID NO: 412826 - protein, 11 aa, Influenza virus
LSISVGSSIYQ

SEQ ID NO: 412827 - protein, 11 aa, Influenza virus
SISVGSSTYQS

SEQ ID NO: 412828 - protein, 11 aa, Influenza virus
IGSSTYQNNFV

SEQ ID NO: 412829 - protein, 11 aa, Influenza virus
GSSTYQSNFVP

SEQ ID NO: 412830 - protein, 11 aa, Influenza virus
STYQNNFVPVM

SEQ ID NO: 412831 - protein, 11 aa, Influenza virus
NNFVPVVRARP

SEQ ID NO: 412832 - protein, 11 aa, Influenza virus
FVPVVRARPQV

SEQ ID NO: 412833 - protein, 11 aa, Influenza virus
VPVVRARPQVN

SEQ ID NO: 412834 - protein, 11 aa, Influenza virus
PVMGARPQVNG

SEQ ID NO: 412835 - protein, 11 aa, Influenza virus
VVRARPQVNGQ

SEQ ID NO: 412836 - protein, 11 aa, Influenza virus
GARPQVNGQRG

SEQ ID NO: 412837 - protein, 11 aa, Influenza virus
RPLVNGQRGRI

SEQ ID NO: 412838 - protein, 11 aa, Influenza virus
VNGQRGRIDFH

SEQ ID NO: 412839 - protein, 11 aa, Influenza virus
NGQRGRIDFHW

SEQ ID NO: 412840 - protein, 11 aa, Influenza virus
PGDHITFSHNG

SEQ ID NO: 412841 - protein, 11 aa, Influenza virus
GDNITFLHNGG

SEQ ID NO: 412842 - protein, 11 aa, Influenza virus
ITFSHNGGLVA

SEQ ID NO: 412843 - protein, 11 aa, Influenza virus
TFSHNGGLVAP

SEQ ID NO: 412844 - protein, 11 aa, Influenza virus
HNGGRIAPSRV

SEQ ID NO: 412845 - protein, 11 aa, Influenza virus
CESKCFWKGGT

SEQ ID NO: 412846 - protein, 11 aa, Influenza virus
ESKCFWKGGTI

SEQ ID NO: 412847 - protein, 11 aa, Influenza virus
SKCFWRGGSII

SEQ ID NO: 412848 - protein, 11 aa, Influenza virus
KCFWRGGSIIT

SEQ ID NO: 412849 - protein, 11 aa, Influenza virus
GGSIITELPFQ

SEQ ID NO: 412850 - protein, 11 aa, Influenza virus
GSIITELPFQN

SEQ ID NO: 412851 - protein, 11 aa, Influenza virus
SIITELPFQNL

SEQ ID NO: 412852 - protein, 11 aa, Influenza virus
IITELPFQNLS

SEQ ID NO: 412853 - protein, 11 aa, Influenza virus
ITELPFQNLSP

SEQ ID NO: 412854 - protein, 11 aa, Influenza virus
RSLMLATGMRN

SEQ ID NO: 412855 - protein, 11 aa, Influenza virus
DQGTGQAADYK

SEQ ID NO: 412856 - protein, 11 aa, Influenza virus
GQAADYKSTQK

SEQ ID NO: 412857 - protein, 11 aa, Influenza virus
QAADYESTQAA

SEQ ID NO: 412858 - protein, 11 aa, Influenza virus
AADYKSTQKTI

SEQ ID NO: 412859 - protein, 11 aa, Influenza virus
AIVQITGKLNR

SEQ ID NO: 412860 - protein, 11 aa, Influenza virus
INQITGKLNRL

SEQ ID NO: 412861 - protein, 11 aa, Influenza virus
DQVTGKLNRLI

SEQ ID NO: 412862 - protein, 11 aa, Influenza virus
SIESEFNEIEY

SEQ ID NO: 412863 - protein, 11 aa, Influenza virus
IESEFNEIEYQ

SEQ ID NO: 412864 - protein, 11 aa, Influenza virus
ESEFNEIEYQI

SEQ ID NO: 412865 - protein, 11 aa, Influenza virus
SEFNEIEYQIG

SEQ ID NO: 412866 - protein, 11 aa, Influenza virus
EFSEIEHQISN

SEQ ID NO: 412867 - protein, 11 aa, Influenza virus
FNEIEYQIGNV

SEQ ID NO: 412868 - protein, 11 aa, Influenza virus
NEIEYQIGNVI

SEQ ID NO: 412869 - protein, 11 aa, Influenza virus
EIEHQISNVIN

SEQ ID NO: 412870 - protein, 11 aa, Influenza virus
LADSEMLNLYE

SEQ ID NO: 412871 - protein, 11 aa, Influenza virus
TDSEMLNLYER

SEQ ID NO: 412872 - protein, 11 aa, Influenza virus
SCMERIRNNTY

SEQ ID NO: 412873 - protein, 11 aa, Influenza virus
IRNNTYDHSHY

SEQ ID NO: 412874 - protein, 11 aa, Influenza virus
RNNTYDHSHYR

SEQ ID NO: 412875 - protein, 11 aa, Influenza virus
NNTYNHTQYRE

SEQ ID NO: 412876 - protein, 11 aa, Influenza virus
NTYNHTQYREE

SEQ ID NO: 412877 - protein, 11 aa, Influenza virus
QYREEALLNRI

SEQ ID NO: 412878 - protein, 11 aa, Influenza virus
YREEALLSRLN

SEQ ID NO: 412879 - protein, 11 aa, Influenza virus
REEALLSRLNI

SEQ ID NO: 412880 - protein, 11 aa, Influenza virus
EEALLNRININ

SEQ ID NO: 412881 - protein, 11 aa, Influenza virus
ESLLNRLSINP

SEQ ID NO: 412882 - protein, 11 aa, Influenza virus
SLLNRLSINPV

SEQ ID NO: 412883 - protein, 11 aa, Influenza virus
INSVKLFSGYK

SEQ ID NO: 412884 - protein, 11 aa, Influenza virus
SLDKICLGHHA

SEQ ID NO: 412885 - protein, 11 aa, Influenza virus
DKICLGHHAVA

SEQ ID NO: 412886 - protein, 11 aa, Influenza virus
KICLGHHAVAN

SEQ ID NO: 412887 - protein, 11 aa, Influenza virus
ICLGHHAVTNG

SEQ ID NO: 412888 - protein, 11 aa, Influenza virus
CLGHHAVTNGT

SEQ ID NO: 412889 - protein, 11 aa, Influenza virus
LGHHAIPNGTI

SEQ ID NO: 412890 - protein, 11 aa, Influenza virus
GTIIKTLTNEK

SEQ ID NO: 412891 - protein, 11 aa, Influenza virus
TIVKTLTNERE

SEQ ID NO: 412892 - protein, 11 aa, Influenza virus
EHEEVTNATET

SEQ ID NO: 412893 - protein, 11 aa, Influenza virus
KEEVINATETV

SEQ ID NO: 412894 - protein, 11 aa, Influenza virus
VTNATETVENK

SEQ ID NO: 412895 - protein, 11 aa, Influenza virus
KDLGNCHPVGM

SEQ ID NO: 412896 - protein, 11 aa, Influenza virus
GAPACDLHLTG

SEQ ID NO: 412897 - protein, 11 aa, Influenza virus
CDLHLTGMWDT

SEQ ID NO: 412898 - protein, 11 aa, Influenza virus
DLHLTGMWDTL

SEQ ID NO: 412899 - protein, 11 aa, Influenza virus
LHLTGKWDTLI

SEQ ID NO: 412900 - protein, 11 aa, Influenza virus
HLTGIWDTLIE

SEQ ID NO: 412901 - protein, 11 aa, Influenza virus
TGMWDTLIERD

SEQ ID NO: 412902 - protein, 11 aa, Influenza virus
GIWDTLIERDN

SEQ ID NO: 412903 - protein, 11 aa, Influenza virus
AYCYPGSTVNE

SEQ ID NO: 412904 - protein, 11 aa, Influenza virus
CYPGATVNEGA

SEQ ID NO: 412905 - protein, 11 aa, Influenza virus
YPGSTVNEEAL

SEQ ID NO: 412906 - protein, 11 aa, Influenza virus
PGATVNEGALR

SEQ ID NO: 412907 - protein, 11 aa, Influenza virus
GSTVNEEALRQ

SEQ ID NO: 412908 - protein, 11 aa, Influenza virus
STVNEEALRQK

SEQ ID NO: 412909 - protein, 11 aa, Influenza virus
KIMESGGIDKV

SEQ ID NO: 412910 - protein, 11 aa, Influenza virus
IMESGGISKMS

SEQ ID NO: 412911 - protein, 11 aa, Influenza virus
MESGGISKMST

SEQ ID NO: 412912 - protein, 11 aa, Influenza virus
GENSFYAELKW

SEQ ID NO: 412913 - protein, 11 aa, Influenza virus
RNSFYAELKWL

SEQ ID NO: 412914 - protein, 11 aa, Influenza virus
YAELKWLISKS

SEQ ID NO: 412915 - protein, 11 aa, Influenza virus
AELKWLISKSK

SEQ ID NO: 412916 - protein, 11 aa, Influenza virus
ELKWLISKSKE

SEQ ID NO: 412917 - protein, 11 aa, Influenza virus
LKWLVSKDKGR

SEQ ID NO: 412918 - protein, 11 aa, Influenza virus
RNFPQTTNTYR

SEQ ID NO: 412919 - protein, 11 aa, Influenza virus
SFPQTTNTYRN

SEQ ID NO: 412920 - protein, 11 aa, Influenza virus
RTTNTYRNTDS

SEQ ID NO: 412921 - protein, 11 aa, Influenza virus
EHLIMWGIHHP

SEQ ID NO: 412922 - protein, 11 aa, Influenza virus
HLITWGIHHPS

SEQ ID NO: 412923 - protein, 11 aa, Influenza virus
LIMWGIHHPSS

SEQ ID NO: 412924 - protein, 11 aa, Influenza virus
HHPSSTKEKNE

SEQ ID NO: 412925 - protein, 11 aa, Influenza virus
HPSSTKEKNEL

SEQ ID NO: 412926 - protein, 11 aa, Influenza virus
PSSTKEKNELY

SEQ ID NO: 412927 - protein, 11 aa, Influenza virus
SSTKEKNELYG

SEQ ID NO: 412928 - protein, 11 aa, Influenza virus
ERNDLYGTQSL

SEQ ID NO: 412929 - protein, 11 aa, Influenza virus
KNDLYGAQSLS

SEQ ID NO: 412930 - protein, 11 aa, Influenza virus
NDLYGAQSLSI

SEQ ID NO: 412931 - protein, 11 aa, Influenza virus
ALYGTQSLSIS

SEQ ID NO: 412932 - protein, 11 aa, Influenza virus
YGTQSLSISIG

SEQ ID NO: 412933 - protein, 11 aa, Influenza virus
GTQSLSISIGS

SEQ ID NO: 412934 - protein, 11 aa, Influenza virus
TQPLSISVGSS

SEQ ID NO: 412935 - protein, 11 aa, Influenza virus
QPLSISVGSST

SEQ ID NO: 412936 - protein, 11 aa, Influenza virus
PLSISVGSSTY

SEQ ID NO: 412937 - protein, 11 aa, Influenza virus
LSISVGSSIYQ

SEQ ID NO: 412938 - protein, 11 aa, Influenza virus
SISVGSSTYHN

SEQ ID NO: 412939 - protein, 11 aa, Influenza virus
ISIGSSTYQNN

SEQ ID NO: 412940 - protein, 11 aa, Influenza virus
SIGSSTYQNNF

SEQ ID NO: 412941 - protein, 11 aa, Influenza virus
IGSSTYQNNFV

SEQ ID NO: 412942 - protein, 11 aa, Influenza virus
GSSIYQNSFVP

SEQ ID NO: 412943 - protein, 11 aa, Influenza virus
STYQNNFVPVI

SEQ ID NO: 412944 - protein, 11 aa, Influenza virus
TYHNSFVPVVG

SEQ ID NO: 412945 - protein, 11 aa, Influenza virus
VQPGDNITFLH

SEQ ID NO: 412946 - protein, 11 aa, Influenza virus
QPGDNITFSDN

SEQ ID NO: 412947 - protein, 11 aa, Influenza virus
NITFSDNGGLI

SEQ ID NO: 412948 - protein, 11 aa, Influenza virus
ITFLHNGGLIA

SEQ ID NO: 412949 - protein, 11 aa, Influenza virus
IFSHNGGLIAP

SEQ ID NO: 412950 - protein, 11 aa, Influenza virus
FSHNGGLVAPS

SEQ ID NO: 412951 - protein, 11 aa, Influenza virus
LHNGGLIAPSR

SEQ ID NO: 412952 - protein, 11 aa, Influenza virus
CFWRGGSINTR

SEQ ID NO: 412953 - protein, 11 aa, Influenza virus
FWRGGSINTRL

SEQ ID NO: 412954 - protein, 11 aa, Influenza virus
WRGGSINTRLP

SEQ ID NO: 412955 - protein, 11 aa, Influenza virus
RGGSINTRLPF

SEQ ID NO: 412956 - protein, 11 aa, Influenza virus
TVGQCPKYVSQ

SEQ ID NO: 412957 - protein, 11 aa, Influenza virus
GSLLLATGMRN

SEQ ID NO: 412958 - protein, 11 aa, Influenza virus
QAADYKSTQAT

SEQ ID NO: 412959 - protein, 11 aa, Influenza virus
AADYKSTQKTI

SEQ ID NO: 412960 - protein, 11 aa, Influenza virus
ADYKSTQKTID

SEQ ID NO: 412961 - protein, 11 aa, Influenza virus
DYESTQAAIDQ

SEQ ID NO: 412962 - protein, 11 aa, Influenza virus
YESTQAAIDQI

SEQ ID NO: 412963 - protein, 11 aa, Influenza virus
KSTQKTIDQVT

SEQ ID NO: 412964 - protein, 11 aa, Influenza virus
STQAAIDQMTG

SEQ ID NO: 412965 - protein, 11 aa, Influenza virus
TQATIDQITGK

SEQ ID NO: 412966 - protein, 11 aa, Influenza virus
QATIDQITGKL

SEQ ID NO: 412967 - protein, 11 aa, Influenza virus
ATIDQITGKLN

SEQ ID NO: 412968 - protein, 11 aa, Influenza virus
AIDQMTGKLNR

SEQ ID NO: 412969 - protein, 11 aa, Influenza virus
SIESEFNEIEY

SEQ ID NO: 412970 - protein, 11 aa, Influenza virus
IESEFNEIEYQ

SEQ ID NO: 412971 - protein, 11 aa, Influenza virus
ESEFNEIEYQI

SEQ ID NO: 412972 - protein, 11 aa, Influenza virus
SEFNEIEYQIG

SEQ ID NO: 412973 - protein, 11 aa, Influenza virus
EFNEIEYQIGN

SEQ ID NO: 412974 - protein, 11 aa, Influenza virus
FNEIEYQIGNV

SEQ ID NO: 412975 - protein, 11 aa, Influenza virus
NEIEYQIGNVI

SEQ ID NO: 412976 - protein, 11 aa, Influenza virus
DGRGCFEIYHK

SEQ ID NO: 412977 - protein, 11 aa, Influenza virus
GKGCFEIYHNC

SEQ ID NO: 412978 - protein, 11 aa, Influenza virus
DNCMERIRNNT

SEQ ID NO: 412979 - protein, 11 aa, Influenza virus
PCMESIRNNTY

SEQ ID NO: 412980 - protein, 11 aa, Influenza virus
ESIRDNTYDHT

SEQ ID NO: 412981 - protein, 11 aa, Influenza virus
RIRNNTYDHTQ

SEQ ID NO: 412982 - protein, 11 aa, Influenza virus
LLNRLNINPVT

SEQ ID NO: 412983 - protein, 11 aa, Influenza virus
LNRLNINPVTL

SEQ ID NO: 412984 - protein, 11 aa, Influenza virus
NRLNINPVTLS

SEQ ID NO: 412985 - protein, 11 aa, Influenza virus
RLNINPVTLSS

SEQ ID NO: 412986 - protein, 11 aa, Influenza virus
LNINPVTLSSG

SEQ ID NO: 412987 - protein, 11 aa, Influenza virus
NINPVTLSSGY

SEQ ID NO: 412988 - protein, 11 aa, Influenza virus
NPVRLSSGYKD

SEQ ID NO: 412989 - protein, 11 aa, Influenza virus
VKLSSGYKNVI

SEQ ID NO: 412990 - protein, 11 aa, Influenza virus
RLSSGYKDIIL

SEQ ID NO: 412991 - protein, 11 aa, Influenza virus
FGESCFVLLAV

SEQ ID NO: 412992 - protein, 11 aa, Influenza virus
IMGLFFFCLKN

SEQ ID NO: 412993 - protein, 11 aa, Influenza virus
VGLVFFCLKNG

SEQ ID NO: 412994 - protein, 11 aa, Influenza virus
QNLFTLSGVAI

SEQ ID NO: 412995 - protein, 11 aa, Influenza virus
KLFALSGVAIS

SEQ ID NO: 412996 - protein, 11 aa, Influenza virus
LFALSGVAISL

SEQ ID NO: 412997 - protein, 11 aa, Influenza virus
FNLLIGISNVG

SEQ ID NO: 412998 - protein, 11 aa, Influenza virus
EKGPKQEENLT

SEQ ID NO: 412999 - protein, 11 aa, Influenza virus
TGTAKQNYLML

SEQ ID NO: 413000 - protein, 11 aa, Influenza virus
IENTYVNNTTI

SEQ ID NO: 413001 - protein, 11 aa, Influenza virus
YLLLNKSLCSV

SEQ ID NO: 413002 - protein, 11 aa, Influenza virus
LLLNKSLCSVE

SEQ ID NO: 413003 - protein, 11 aa, Influenza virus
LSKSLCKVEGW

SEQ ID NO: 413004 - protein, 11 aa, Influenza virus
SKSLCKVEGWV

SEQ ID NO: 413005 - protein, 11 aa, Influenza virus
KSLCKVEEWVV

SEQ ID NO: 413006 - protein, 11 aa, Influenza virus
SLCKVEEWVVV

SEQ ID NO: 413007 - protein, 11 aa, Influenza virus
NAIRFGEGEQI

SEQ ID NO: 413008 - protein, 11 aa, Influenza virus
AIRFGEGEQII

SEQ ID NO: 413009 - protein, 11 aa, Influenza virus
IRFGEGEQIIV

SEQ ID NO: 413010 - protein, 11 aa, Influenza virus
TREPYVSCDPI

SEQ ID NO: 413011 - protein, 11 aa, Influenza virus
PYVSCDPTGCK

SEQ ID NO: 413012 - protein, 11 aa, Influenza virus
YVSCDPTGCKM

SEQ ID NO: 413013 - protein, 11 aa, Influenza virus
VSCDPTGCKMY

SEQ ID NO: 413014 - protein, 11 aa, Influenza virus
SCDPTGCKMYA

SEQ ID NO: 413015 - protein, 11 aa, Influenza virus
CDPSGCKMYAL

SEQ ID NO: 413016 - protein, 11 aa, Influenza virus
DPSGCKMYALH

SEQ ID NO: 413017 - protein, 11 aa, Influenza virus
PTGCKMYALHQ

SEQ ID NO: 413018 - protein, 11 aa, Influenza virus
TGCKMYALHQG

SEQ ID NO: 413019 - protein, 11 aa, Influenza virus
LISTPLGSPPM

SEQ ID NO: 413020 - protein, 11 aa, Influenza virus
ISTPLGSPPMV

SEQ ID NO: 413021 - protein, 11 aa, Influenza virus
STPLGSPPMVS

SEQ ID NO: 413022 - protein, 11 aa, Influenza virus
TPLGSPPMVSN

SEQ ID NO: 413023 - protein, 11 aa, Influenza virus
PLGSPPMVSNS

SEQ ID NO: 413024 - protein, 11 aa, Influenza virus
LGSPPIVSNSE

SEQ ID NO: 413025 - protein, 11 aa, Influenza virus
GSPPIVSNSEF

SEQ ID NO: 413026 - protein, 11 aa, Influenza virus
VSNSDFMCVGW

SEQ ID NO: 413027 - protein, 11 aa, Influenza virus
SNSDFMCVGWS

SEQ ID NO: 413028 - protein, 11 aa, Influenza virus
NSDFMCVGWSS

SEQ ID NO: 413029 - protein, 11 aa, Influenza virus
SDFMCVGWSST

SEQ ID NO: 413030 - protein, 11 aa, Influenza virus
DFMCVGWSSTT

SEQ ID NO: 413031 - protein, 11 aa, Influenza virus
FICVGWSSTTC

SEQ ID NO: 413032 - protein, 11 aa, Influenza virus
ICVGWSSTTCH

SEQ ID NO: 413033 - protein, 11 aa, Influenza virus
TTCHDGVGRMT

SEQ ID NO: 413034 - protein, 11 aa, Influenza virus
TCHDGVGRMTI

SEQ ID NO: 413035 - protein, 11 aa, Influenza virus
HDGIGRMTICI

SEQ ID NO: 413036 - protein, 11 aa, Influenza virus
DGIGRMTICIQ

SEQ ID NO: 413037 - protein, 11 aa, Influenza virus
GIGRMTICIQG

SEQ ID NO: 413038 - protein, 11 aa, Influenza virus
IGRMTICIQGN

SEQ ID NO: 413039 - protein, 11 aa, Influenza virus
RMTICVQGNNK

SEQ ID NO: 413040 - protein, 11 aa, Influenza virus
MTICVQGNNKN

SEQ ID NO: 413041 - protein, 11 aa, Influenza virus
TICVQGNNKNA

SEQ ID NO: 413042 - protein, 11 aa, Influenza virus
ICVQGNNKNAT

SEQ ID NO: 413043 - protein, 11 aa, Influenza virus
CVQGNNKNATA

SEQ ID NO: 413044 - protein, 11 aa, Influenza virus
VQGNNKNATAT

SEQ ID NO: 413045 - protein, 11 aa, Influenza virus
NKNATATVYYD

SEQ ID NO: 413046 - protein, 11 aa, Influenza virus
KNATATVYYDR

SEQ ID NO: 413047 - protein, 11 aa, Influenza virus
ATATVYYERRL

SEQ ID NO: 413048 - protein, 11 aa, Influenza virus
TATVYYNGRLT

SEQ ID NO: 413049 - protein, 11 aa, Influenza virus
ATVYYERRLTT

SEQ ID NO: 413050 - protein, 11 aa, Influenza virus
TVYYERRLTTT

SEQ ID NO: 413051 - protein, 11 aa, Influenza virus
VYYNRRPTTTI

SEQ ID NO: 413052 - protein, 11 aa, Influenza virus
YYNGRLTTTIK

SEQ ID NO: 413053 - protein, 11 aa, Influenza virus
YERRLTTTIKT

SEQ ID NO: 413054 - protein, 11 aa, Influenza virus
ERRLTTTIKTW

SEQ ID NO: 413055 - protein, 11 aa, Influenza virus
LTTTIKTWAGK

SEQ ID NO: 413056 - protein, 11 aa, Influenza virus
TTTIKTWAGKI

SEQ ID NO: 413057 - protein, 11 aa, Influenza virus
TTIKTWAGKIL

SEQ ID NO: 413058 - protein, 11 aa, Influenza virus
TIKTWAGKILR

SEQ ID NO: 413059 - protein, 11 aa, Influenza virus
IKTWAGKILRT

SEQ ID NO: 413060 - protein, 11 aa, Influenza virus
KTWAGKILRTQ

SEQ ID NO: 413061 - protein, 11 aa, Influenza virus
TWAGKILRTQE

SEQ ID NO: 413062 - protein, 11 aa, Influenza virus
GTCVVIMTDGP

SEQ ID NO: 413063 - protein, 11 aa, Influenza virus
TCVVIMTDGPA

SEQ ID NO: 413064 - protein, 11 aa, Influenza virus
CVVIMTDGPAS

SEQ ID NO: 413065 - protein, 11 aa, Influenza virus
VIMTDGPANSQ

SEQ ID NO: 413066 - protein, 11 aa, Influenza virus
VMTDGSASGQA

SEQ ID NO: 413067 - protein, 11 aa, Influenza virus
MTDGSANSQAY

SEQ ID NO: 413068 - protein, 11 aa, Influenza virus
TDGSANSQAYT

SEQ ID NO: 413069 - protein, 11 aa, Influenza virus
DGSASGQAYTK

SEQ ID NO: 413070 - protein, 11 aa, Influenza virus
QAYTKIMYFHK

SEQ ID NO: 413071 - protein, 11 aa, Influenza virus
AYTKIMYFHKG

SEQ ID NO: 413072 - protein, 11 aa, Influenza virus
YFHKGLVVKEE

SEQ ID NO: 413073 - protein, 11 aa, Influenza virus
KEEALQGSARH

SEQ ID NO: 413074 - protein, 11 aa, Influenza virus
KGSARHVEECS

SEQ ID NO: 413075 - protein, 11 aa, Influenza virus
HIEECPCYGHN

SEQ ID NO: 413076 - protein, 11 aa, Influenza virus
IEECSCYGHSQ

SEQ ID NO: 413077 - protein, 11 aa, Influenza virus
EECSCYGHSQK

SEQ ID NO: 413078 - protein, 11 aa, Influenza virus
QKATCVCRDNW

SEQ ID NO: 413079 - protein, 11 aa, Influenza virus
QGANRPVIEIN

SEQ ID NO: 413080 - protein, 11 aa, Influenza virus
GANRPVIEINM

SEQ ID NO: 413081 - protein, 11 aa, Influenza virus
AMDHTSQYLCT

SEQ ID NO: 413082 - protein, 11 aa, Influenza virus
MKHTSQYLCTG

SEQ ID NO: 413083 - protein, 11 aa, Influenza virus
KHTSQYLCTGV

SEQ ID NO: 413084 - protein, 11 aa, Influenza virus
LCTGVLTDTSK

SEQ ID NO: 413085 - protein, 11 aa, Influenza virus
VLTDTSRPSDR

SEQ ID NO: 413086 - protein, 11 aa, Influenza virus
DCDNPITGSPG

SEQ ID NO: 413087 - protein, 11 aa, Influenza virus
CNNPITGSPEA

SEQ ID NO: 413088 - protein, 11 aa, Influenza virus
NNPITGSPEAP

SEQ ID NO: 413089 - protein, 11 aa, Influenza virus
PGVKGFGFLDN

SEQ ID NO: 413090 - protein, 11 aa, Influenza virus
DNTWLGGTISP

SEQ ID NO: 413091 - protein, 11 aa, Influenza virus
FEMLKIPNAGI

SEQ ID NO: 413092 - protein, 11 aa, Influenza virus
EMLKIPNAGID

SEQ ID NO: 413093 - protein, 11 aa, Influenza virus
MLKIPNAGIDP

SEQ ID NO: 413094 - protein, 11 aa, Influenza virus
LKVPNAGTDPN

SEQ ID NO: 413095 - protein, 11 aa, Influenza virus
KVPNAGTDPNS

SEQ ID NO: 413096 - protein, 11 aa, Influenza virus
NRNWSGYSGSF

SEQ ID NO: 413097 - protein, 11 aa, Influenza virus
SDWSGYSGSFI

SEQ ID NO: 413098 - protein, 11 aa, Influenza virus
SKCYNPCFYVE

SEQ ID NO: 413099 - protein, 11 aa, Influenza virus
ACYNPCFYVEL

SEQ ID NO: 413100 - protein, 11 aa, Influenza virus
SLIALCGSPFP

SEQ ID NO: 413101 - protein, 11 aa, Influenza virus
LIALCGSPFPV

SEQ ID NO: 413102 - protein, 11 aa, Influenza virus
IALCGSPFPVG

SEQ ID NO: 413103 - protein, 11 aa, Influenza virus
ALCGSPFPVGS

SEQ ID NO: 413104 - protein, 11 aa, Influenza virus
LCGSPFPVGSG

SEQ ID NO: 413105 - protein, 11 aa, Influenza virus
CGSPFPVGSGS

SEQ ID NO: 413106 - protein, 11 aa, Influenza virus
GSPFPVGSGSF

SEQ ID NO: 413107 - protein, 11 aa, Influenza virus
SPFPVGSGSFP

SEQ ID NO: 413108 - protein, 11 aa, Influenza virus
PFPVGSGSFPD

SEQ ID NO: 413109 - protein, 11 aa, Influenza virus
FPVGSGSFPDG

SEQ ID NO: 413110 - protein, 11 aa, Influenza virus
QADEICIGYMS

SEQ ID NO: 413111 - protein, 11 aa, Influenza virus
IGYMSNNSTEK

SEQ ID NO: 413112 - protein, 11 aa, Influenza virus
GYMSNNSTEKV

SEQ ID NO: 413113 - protein, 11 aa, Influenza virus
LSNNSTERVDT

SEQ ID NO: 413114 - protein, 11 aa, Influenza virus
SNNSTERVDTI

SEQ ID NO: 413115 - protein, 11 aa, Influenza virus
NNSTERVDTII

SEQ ID NO: 413116 - protein, 11 aa, Influenza virus
NSTERVDTIIE

SEQ ID NO: 413117 - protein, 11 aa, Influenza virus
STERVDTIIES

SEQ ID NO: 413118 - protein, 11 aa, Influenza virus
TERVDTIIESN

SEQ ID NO: 413119 - protein, 11 aa, Influenza virus
RVDTIIESNVT

SEQ ID NO: 413120 - protein, 11 aa, Influenza virus
VDTIIESNITV

SEQ ID NO: 413121 - protein, 11 aa, Influenza virus
NTIIESNVTVT

SEQ ID NO: 413122 - protein, 11 aa, Influenza virus
IESNVTVTNSV

SEQ ID NO: 413123 - protein, 11 aa, Influenza virus
ESNITVTSSVE

SEQ ID NO: 413124 - protein, 11 aa, Influenza virus
SNVTVTNSVEL

SEQ ID NO: 413125 - protein, 11 aa, Influenza virus
YTGSFCSIDGK

SEQ ID NO: 413126 - protein, 11 aa, Influenza virus
FCSLDGKAPIS

SEQ ID NO: 413127 - protein, 11 aa, Influenza virus
CSINGRAPISL

SEQ ID NO: 413128 - protein, 11 aa, Influenza virus
SINGKEPISLG

SEQ ID NO: 413129 - protein, 11 aa, Influenza virus
NGKEPISLGDC

SEQ ID NO: 413130 - protein, 11 aa, Influenza virus
GKAPISLGGCS

SEQ ID NO: 413131 - protein, 11 aa, Influenza virus
KAPISLGGCSF

SEQ ID NO: 413132 - protein, 11 aa, Influenza virus
EPISLGDCSFA

SEQ ID NO: 413133 - protein, 11 aa, Influenza virus
GWILGNPMCDN

SEQ ID NO: 413134 - protein, 11 aa, Influenza virus
WILGNPMCDYL

SEQ ID NO: 413135 - protein, 11 aa, Influenza virus
ILGNPMCDYLI

SEQ ID NO: 413136 - protein, 11 aa, Influenza virus
LGNPMCDNLIG

SEQ ID NO: 413137 - protein, 11 aa, Influenza virus
GNPMCDNLIGK

SEQ ID NO: 413138 - protein, 11 aa, Influenza virus
CDNLIGKTSWS

SEQ ID NO: 413139 - protein, 11 aa, Influenza virus
DYLIGKTSWSY

SEQ ID NO: 413140 - protein, 11 aa, Influenza virus
YLIGKTSWSYI

SEQ ID NO: 413141 - protein, 11 aa, Influenza virus
KTSWSYIVEKL

SEQ ID NO: 413142 - protein, 11 aa, Influenza virus
TSWSYIVERPN

SEQ ID NO: 413143 - protein, 11 aa, Influenza virus
SWSYIVEKLNP

SEQ ID NO: 413144 - protein, 11 aa, Influenza virus
GQAGRMTFYWI

SEQ ID NO: 413145 - protein, 11 aa, Influenza virus
QAGRMTFYWAI

SEQ ID NO: 413146 - protein, 11 aa, Influenza virus
TFESNGALLAP

SEQ ID NO: 413147 - protein, 11 aa, Influenza virus
FESNGALLAPR

SEQ ID NO: 413148 - protein, 11 aa, Influenza virus
ESNGALLAPRY

SEQ ID NO: 413149 - protein, 11 aa, Influenza virus
NVHRSTIGDCP

SEQ ID NO: 413150 - protein, 11 aa, Influenza virus
VHRSTIGDCPK

SEQ ID NO: 413151 - protein, 11 aa, Influenza virus
HRNAIGDCPKY

SEQ ID NO: 413152 - protein, 11 aa, Influenza virus
RNAIGDCPKYV

SEQ ID NO: 413153 - protein, 11 aa, Influenza virus
NTIGNCPKYVN

SEQ ID NO: 413154 - protein, 11 aa, Influenza virus
AIGDCPKYVNV

SEQ ID NO: 413155 - protein, 11 aa, Influenza virus
IGDCPKYVNIK

SEQ ID NO: 413156 - protein, 11 aa, Influenza virus
GDCPKYVNIKS

SEQ ID NO: 413157 - protein, 11 aa, Influenza virus
DCPKYVNIKSL

SEQ ID NO: 413158 - protein, 11 aa, Influenza virus
CPKYVNIKSLK

SEQ ID NO: 413159 - protein, 11 aa, Influenza virus
PKYVNIKSLKL

SEQ ID NO: 413160 - protein, 11 aa, Influenza virus
KYVNIKSLKLA

SEQ ID NO: 413161 - protein, 11 aa, Influenza virus
KSLKLASGLRN

SEQ ID NO: 413162 - protein, 11 aa, Influenza virus
SLKLASGLRNV

SEQ ID NO: 413163 - protein, 11 aa, Influenza virus
LKLASGLRNVP

SEQ ID NO: 413164 - protein, 11 aa, Influenza virus
KLASGLRNVPA

SEQ ID NO: 413165 - protein, 11 aa, Influenza virus
SRGLFGAKAGF

SEQ ID NO: 413166 - protein, 11 aa, Influenza virus
DEEGTGIAADK

SEQ ID NO: 413167 - protein, 11 aa, Influenza virus
GIAADKESTQE

SEQ ID NO: 413168 - protein, 11 aa, Influenza virus
DLWSYNAQLLV

SEQ ID NO: 413169 - protein, 11 aa, Influenza virus
LWSYNAQLLVL

SEQ ID NO: 413170 - protein, 11 aa, Influenza virus
HDSNVTNLHEK

SEQ ID NO: 413171 - protein, 11 aa, Influenza virus
LKNNAKDEGNG

SEQ ID NO: 413172 - protein, 11 aa, Influenza virus
KNNAKDEGNGC

SEQ ID NO: 413173 - protein, 11 aa, Influenza virus
GCFPFYHKCDN

SEQ ID NO: 413174 - protein, 11 aa, Influenza virus
FYHKCNNECIE

SEQ ID NO: 413175 - protein, 11 aa, Influenza virus
DECIEKVRNGT

SEQ ID NO: 413176 - protein, 11 aa, Influenza virus
ECIEKIRNGTY

SEQ ID NO: 413177 - protein, 11 aa, Influenza virus
YDHKEFEKESK

SEQ ID NO: 413178 - protein, 11 aa, Influenza virus
ESRINRQEIEG

SEQ ID NO: 413179 - protein, 11 aa, Influenza virus
LNRQEIGGVKL

SEQ ID NO: 413180 - protein, 11 aa, Influenza virus
NRQEIGGVKLD

SEQ ID NO: 413181 - protein, 11 aa, Influenza virus
GNVYKILSICS

SEQ ID NO: 413182 - protein, 11 aa, Influenza virus
CVASSLVLAAI

SEQ ID NO: 413183 - protein, 11 aa, Influenza virus
ASSLILAALIM

SEQ ID NO: 413184 - protein, 11 aa, Influenza virus
SSLVLAASIMG

SEQ ID NO: 413185 - protein, 11 aa, Influenza virus
WACGNGSCRCT

SEQ ID NO: 413186 - protein, 11 aa, Influenza virus
VCSNGSCRCTI

SEQ ID NO: 413187 - protein, 11 aa, Influenza virus
NNSTETVNTLT

SEQ ID NO: 413188 - protein, 11 aa, Influenza virus
NSTETVNTLTE

SEQ ID NO: 413189 - protein, 11 aa, Influenza virus
STETVNTLTEQ

SEQ ID NO: 413190 - protein, 11 aa, Influenza virus
TETVNTLTEQN

SEQ ID NO: 413191 - protein, 11 aa, Influenza virus
TVNTLIEQNIP

SEQ ID NO: 413192 - protein, 11 aa, Influenza virus
VNTLIEQNIPV

SEQ ID NO: 413193 - protein, 11 aa, Influenza virus
NTLIEQNIPVT

SEQ ID NO: 413194 - protein, 11 aa, Influenza virus
TLIEQNIPVTQ

SEQ ID NO: 413195 - protein, 11 aa, Influenza virus
LIEQNIPVTQV

SEQ ID NO: 413196 - protein, 11 aa, Influenza virus
IEQNIPVTQVE

SEQ ID NO: 413197 - protein, 11 aa, Influenza virus
TQVEELVHRGI

SEQ ID NO: 413198 - protein, 11 aa, Influenza virus
QVEELVHRGID

SEQ ID NO: 413199 - protein, 11 aa, Influenza virus
VEELVHRGIDP

SEQ ID NO: 413200 - protein, 11 aa, Influenza virus
VLDDCSLKGLI

SEQ ID NO: 413201 - protein, 11 aa, Influenza virus
LDDCSLKGLIL

SEQ ID NO: 413202 - protein, 11 aa, Influenza virus
DDCSLEGLVLG

SEQ ID NO: 413203 - protein, 11 aa, Influenza virus
DCSLEGLVLGN

SEQ ID NO: 413204 - protein, 11 aa, Influenza virus
CSLEGLILSNP

SEQ ID NO: 413205 - protein, 11 aa, Influenza virus
SLEGLVLGNPK

SEQ ID NO: 413206 - protein, 11 aa, Influenza virus
LKGLILGNPKC

SEQ ID NO: 413207 - protein, 11 aa, Influenza virus
EGLILSNPKCD

SEQ ID NO: 413208 - protein, 11 aa, Influenza virus
GLVLGNPKCDL

SEQ ID NO: 413209 - protein, 11 aa, Influenza virus
LILSNPKCDLY

SEQ ID NO: 413210 - protein, 11 aa, Influenza virus
ILSNPKCDLYL

SEQ ID NO: 413211 - protein, 11 aa, Influenza virus
LGNPKCDLYLS

SEQ ID NO: 413212 - protein, 11 aa, Influenza virus
GNPKCDLYLSG

SEQ ID NO: 413213 - protein, 11 aa, Influenza virus
IVERPKEIEGI

SEQ ID NO: 413214 - protein, 11 aa, Influenza virus
VERPKEIEGIC

SEQ ID NO: 413215 - protein, 11 aa, Influenza virus
ERPKEIEGICY

SEQ ID NO: 413216 - protein, 11 aa, Influenza virus
RPKEIEGICYP

SEQ ID NO: 413217 - protein, 11 aa, Influenza virus
PKEIEGICYPG

SEQ ID NO: 413218 - protein, 11 aa, Influenza virus
EMEGICYPGSV

SEQ ID NO: 413219 - protein, 11 aa, Influenza virus
MEGICYPGSVE

SEQ ID NO: 413220 - protein, 11 aa, Influenza virus
EGVCYPGSIKN

SEQ ID NO: 413221 - protein, 11 aa, Influenza virus
GVCYPGSIKNQ

SEQ ID NO: 413222 - protein, 11 aa, Influenza virus
VCYPGSIKNQE

SEQ ID NO: 413223 - protein, 11 aa, Influenza virus
PGSIKNQEELR

SEQ ID NO: 413224 - protein, 11 aa, Influenza virus
GSIENQEELKS

SEQ ID NO: 413225 - protein, 11 aa, Influenza virus
SIENQEELKSL

SEQ ID NO: 413226 - protein, 11 aa, Influenza virus
IKNQEELRSLF

SEQ ID NO: 413227 - protein, 11 aa, Influenza virus
ENQEELKSLFS

SEQ ID NO: 413228 - protein, 11 aa, Influenza virus
ELRSLFSSIKR

SEQ ID NO: 413229 - protein, 11 aa, Influenza virus
LRSLFSSIKRY

SEQ ID NO: 413230 - protein, 11 aa, Influenza virus
RSLFSSIKRYE

SEQ ID NO: 413231 - protein, 11 aa, Influenza virus
RYERVKMFDFT

SEQ ID NO: 413232 - protein, 11 aa, Influenza virus
MFDFIKWNVTY

SEQ ID NO: 413233 - protein, 11 aa, Influenza virus
FDFIKWNVTYT

SEQ ID NO: 413234 - protein, 11 aa, Influenza virus
DFIKWNVTYTG

SEQ ID NO: 413235 - protein, 11 aa, Influenza virus
FIKWNVTYTGT

SEQ ID NO: 413236 - protein, 11 aa, Influenza virus
IKWNVTYTGTS

SEQ ID NO: 413237 - protein, 11 aa, Influenza virus
KWNVTHTGTSK

SEQ ID NO: 413238 - protein, 11 aa, Influenza virus
WNVTHTGTSKA

SEQ ID NO: 413239 - protein, 11 aa, Influenza virus
NVTHTGTSKAC

SEQ ID NO: 413240 - protein, 11 aa, Influenza virus
VTHTGTSKACN

SEQ ID NO: 413241 - protein, 11 aa, Influenza virus
SNQGSFYRNMR

SEQ ID NO: 413242 - protein, 11 aa, Influenza virus
NRGSFYRSMRW

SEQ ID NO: 413243 - protein, 11 aa, Influenza virus
QGSFYRNMRWL

SEQ ID NO: 413244 - protein, 11 aa, Influenza virus
DSFYRSMKWLT

SEQ ID NO: 413245 - protein, 11 aa, Influenza virus
SFYRSMKWLTL

SEQ ID NO: 413246 - protein, 11 aa, Influenza virus
FYRSMKWLTLK

SEQ ID NO: 413247 - protein, 11 aa, Influenza virus
YRSMRWLTLKL

SEQ ID NO: 413248 - protein, 11 aa, Influenza virus
MRWLTLKLGQF

SEQ ID NO: 413249 - protein, 11 aa, Influenza virus
KWLTLKSGQFP

SEQ ID NO: 413250 - protein, 11 aa, Influenza virus
FIWAIHHPPTS

SEQ ID NO: 413251 - protein, 11 aa, Influenza virus
WAIHHPPTSAE

SEQ ID NO: 413252 - protein, 11 aa, Influenza virus
AIHHPPTSAEQ

SEQ ID NO: 413253 - protein, 11 aa, Influenza virus
IHHPPTTDEQM

SEQ ID NO: 413254 - protein, 11 aa, Influenza virus
EINRNFKPNIG

SEQ ID NO: 413255 - protein, 11 aa, Influenza virus
IDRSFRPNIGP

SEQ ID NO: 413256 - protein, 11 aa, Influenza virus
NRNFKPNIGPR

SEQ ID NO: 413257 - protein, 11 aa, Influenza virus
RNFKPNIGPRP

SEQ ID NO: 413258 - protein, 11 aa, Influenza virus
IFRPNIGPRPL

SEQ ID NO: 413259 - protein, 11 aa, Influenza virus
FRPNIGPRPLI

SEQ ID NO: 413260 - protein, 11 aa, Influenza virus
RPNIGPRPLIR

SEQ ID NO: 413261 - protein, 11 aa, Influenza virus
PNIGPRPLVMG

SEQ ID NO: 413262 - protein, 11 aa, Influenza virus
NIGPRPLIRGQ

SEQ ID NO: 413263 - protein, 11 aa, Influenza virus
IGPRPLVMGQQ

SEQ ID NO: 413264 - protein, 11 aa, Influenza virus
GPRPLIRGQQG

SEQ ID NO: 413265 - protein, 11 aa, Influenza virus
PRPLVMGQQGR

SEQ ID NO: 413266 - protein, 11 aa, Influenza virus
RPLVMGQQGRM

SEQ ID NO: 413267 - protein, 11 aa, Influenza virus
PLVMGQQGRMD

SEQ ID NO: 413268 - protein, 11 aa, Influenza virus
LIRGQQGRMDY

SEQ ID NO: 413269 - protein, 11 aa, Influenza virus
VMGQQGRMDYY

SEQ ID NO: 413270 - protein, 11 aa, Influenza virus
NLIAPEYGHLT

SEQ ID NO: 413271 - protein, 11 aa, Influenza virus
LIAPEYGYLIT

SEQ ID NO: 413272 - protein, 11 aa, Influenza virus
IAPEYGYLITG

SEQ ID NO: 413273 - protein, 11 aa, Influenza virus
APEYGYLITGK

SEQ ID NO: 413274 - protein, 11 aa, Influenza virus
PEYGYLITGKS

SEQ ID NO: 413275 - protein, 11 aa, Influenza virus
EYGHLTTGKSH

SEQ ID NO: 413276 - protein, 11 aa, Influenza virus
YGYLITGKSHG

SEQ ID NO: 413277 - protein, 11 aa, Influenza virus
GYLITGKSHGR

SEQ ID NO: 413278 - protein, 11 aa, Influenza virus
HLTTGKSHGRI

SEQ ID NO: 413279 - protein, 11 aa, Influenza virus
LTTGKSHGRIL

SEQ ID NO: 413280 - protein, 11 aa, Influenza virus
TTGKSHGRILK

SEQ ID NO: 413281 - protein, 11 aa, Influenza virus
TECQLNEGVIN

SEQ ID NO: 413282 - protein, 11 aa, Influenza virus
ECQLNEGVINT

SEQ ID NO: 413283 - protein, 11 aa, Influenza virus
NEGIMNTSKPF

SEQ ID NO: 413284 - protein, 11 aa, Influenza virus
EGVMNTSKPLQ

SEQ ID NO: 413285 - protein, 11 aa, Influenza virus
GVINTSKPFQN

SEQ ID NO: 413286 - protein, 11 aa, Influenza virus
VMNTSKPFQNI

SEQ ID NO: 413287 - protein, 11 aa, Influenza virus
MNTSKPFQNIC

SEQ ID NO: 413288 - protein, 11 aa, Influenza virus
NTSKPFQNICK

SEQ ID NO: 413289 - protein, 11 aa, Influenza virus
TSKPLQNTSKH

SEQ ID NO: 413290 - protein, 11 aa, Influenza virus
SKPFQNTSRHY

SEQ ID NO: 413291 - protein, 11 aa, Influenza virus
KPFQNICKPYI

SEQ ID NO: 413292 - protein, 11 aa, Influenza virus
PLQNTSKHYIG

SEQ ID NO: 413293 - protein, 11 aa, Influenza virus
FQNTSRHYIGK

SEQ ID NO: 413294 - protein, 11 aa, Influenza virus
TSRHYIGKCPK

SEQ ID NO: 413295 - protein, 11 aa, Influenza virus
SRHYIGKCPKY

SEQ ID NO: 413296 - protein, 11 aa, Influenza virus
RHYIGKCPKYI

SEQ ID NO: 413297 - protein, 11 aa, Influenza virus
PYIGKCPKYIP

SEQ ID NO: 413298 - protein, 11 aa, Influenza virus
IGKCPKYISSG

SEQ ID NO: 413299 - protein, 11 aa, Influenza virus
GKCPKYISSGS

SEQ ID NO: 413300 - protein, 11 aa, Influenza virus
KCPKYIPSRSL

SEQ ID NO: 413301 - protein, 11 aa, Influenza virus
CPKYISSGSLK

SEQ ID NO: 413302 - protein, 11 aa, Influenza virus
PKYISSGSLKL

SEQ ID NO: 413303 - protein, 11 aa, Influenza virus
KYIPSRSLKLA

SEQ ID NO: 413304 - protein, 11 aa, Influenza virus
YISSGSLKLAI

SEQ ID NO: 413305 - protein, 11 aa, Influenza virus
IPSRSLKLAIG

SEQ ID NO: 413306 - protein, 11 aa, Influenza virus
SSGSLKLAIGL

SEQ ID NO: 413307 - protein, 11 aa, Influenza virus
SRSLKLAIGLR

SEQ ID NO: 413308 - protein, 11 aa, Influenza virus
RSLKLAIGLRN

SEQ ID NO: 413309 - protein, 11 aa, Influenza virus
LAIGPRNVPQA

SEQ ID NO: 413310 - protein, 11 aa, Influenza virus
AIGPRNVPQAQ

SEQ ID NO: 413311 - protein, 11 aa, Influenza virus
RNVPQVQDRGL

SEQ ID NO: 413312 - protein, 11 aa, Influenza virus
NVPQVQDRGLF

SEQ ID NO: 413313 - protein, 11 aa, Influenza virus
VPQVQDRGLFG

SEQ ID NO: 413314 - protein, 11 aa, Influenza virus
PQVQDRGLFGA

SEQ ID NO: 413315 - protein, 11 aa, Influenza virus
QDRGLFGAKAG

SEQ ID NO: 413316 - protein, 11 aa, Influenza virus
DRGLFGAKAGF

SEQ ID NO: 413317 - protein, 11 aa, Influenza virus
FQHQNAEGIGI

SEQ ID NO: 413318 - protein, 11 aa, Influenza virus
QHQNSEGTGIV

SEQ ID NO: 413319 - protein, 11 aa, Influenza virus
HQNSEGTGIVA

SEQ ID NO: 413320 - protein, 11 aa, Influenza virus
QNAEGIGIAAD

SEQ ID NO: 413321 - protein, 11 aa, Influenza virus
NSEGTGIVADR

SEQ ID NO: 413322 - protein, 11 aa, Influenza virus
EGIGIAADRDS

SEQ ID NO: 413323 - protein, 11 aa, Influenza virus
GTGIVADRDST

SEQ ID NO: 413324 - protein, 11 aa, Influenza virus
IGIAADRDSTQ

SEQ ID NO: 413325 - protein, 11 aa, Influenza virus
VADRDSTQKAI

SEQ ID NO: 413326 - protein, 11 aa, Influenza virus
ADRGSTQKAID

SEQ ID NO: 413327 - protein, 11 aa, Influenza virus
DRGSTQKAIDN

SEQ ID NO: 413328 - protein, 11 aa, Influenza virus
RDSTQKAIDIM

SEQ ID NO: 413329 - protein, 11 aa, Influenza virus
GSTQKAIDNMQ

SEQ ID NO: 413330 - protein, 11 aa, Influenza virus
STQKAIDIMQN

SEQ ID NO: 413331 - protein, 11 aa, Influenza virus
TQKAIDNMQNR

SEQ ID NO: 413332 - protein, 11 aa, Influenza virus
QKAIDIMQNKL

SEQ ID NO: 413333 - protein, 11 aa, Influenza virus
KAIDIMQNKLN

SEQ ID NO: 413334 - protein, 11 aa, Influenza virus
KLNNVIDKMNN

SEQ ID NO: 413335 - protein, 11 aa, Influenza virus
NNVIDKMNKQL

SEQ ID NO: 413336 - protein, 11 aa, Influenza virus
RINMINSKIND

SEQ ID NO: 413337 - protein, 11 aa, Influenza virus
INMINSKINDQ

SEQ ID NO: 413338 - protein, 11 aa, Influenza virus
IEDQITDIWAY

SEQ ID NO: 413339 - protein, 11 aa, Influenza virus
NDQITDIWAYN

SEQ ID NO: 413340 - protein, 11 aa, Influenza virus
DANVRNLHERI

SEQ ID NO: 413341 - protein, 11 aa, Influenza virus
ANVRNLHERIR

SEQ ID NO: 413342 - protein, 11 aa, Influenza virus
NVRNLHDRTRR

SEQ ID NO: 413343 - protein, 11 aa, Influenza virus
ENAVDTGDGCF

SEQ ID NO: 413344 - protein, 11 aa, Influenza virus
NAVDTGDGCFE

SEQ ID NO: 413345 - protein, 11 aa, Influenza virus
AIDAGDGCFEI

SEQ ID NO: 413346 - protein, 11 aa, Influenza virus
IDAGDGCFEIL

SEQ ID NO: 413347 - protein, 11 aa, Influenza virus
NGDGCFEILHK

SEQ ID NO: 413348 - protein, 11 aa, Influenza virus
DGCFEILHKCN

SEQ ID NO: 413349 - protein, 11 aa, Influenza virus
GCFEILHRCND

SEQ ID NO: 413350 - protein, 11 aa, Influenza virus
YEDESRIERQK

SEQ ID NO: 413351 - protein, 11 aa, Influenza virus
ERQKISGVKLE

SEQ ID NO: 413352 - protein, 11 aa, Influenza virus
RQKISGVKLEE

SEQ ID NO: 413353 - protein, 11 aa, Influenza virus
QKISGVKLEEN

SEQ ID NO: 413354 - protein, 11 aa, Influenza virus
KISGVKLEENS

SEQ ID NO: 413355 - protein, 11 aa, Influenza virus
CIGYLSTNSSE

SEQ ID NO: 413356 - protein, 11 aa, Influenza virus
VGYLSTNSSDK

SEQ ID NO: 413357 - protein, 11 aa, Influenza virus
GYLSTNSSDKV

SEQ ID NO: 413358 - protein, 11 aa, Influenza virus
YLSTNSSDKVD

SEQ ID NO: 413359 - protein, 11 aa, Influenza virus
LSTNSSDKVDT

SEQ ID NO: 413360 - protein, 11 aa, Influenza virus
STNSSEKVNTL

SEQ ID NO: 413361 - protein, 11 aa, Influenza virus
TNSSDKVDTLL

SEQ ID NO: 413362 - protein, 11 aa, Influenza virus
NSSDKVDTLLE

SEQ ID NO: 413363 - protein, 11 aa, Influenza virus
VNTLLENDVPV

SEQ ID NO: 413364 - protein, 11 aa, Influenza virus
NTLLENDVPVT

SEQ ID NO: 413365 - protein, 11 aa, Influenza virus
TLLESDVPVTS

SEQ ID NO: 413366 - protein, 11 aa, Influenza virus
LLENGVPVTST

SEQ ID NO: 413367 - protein, 11 aa, Influenza virus
VPVTSSIDLVE

SEQ ID NO: 413368 - protein, 11 aa, Influenza virus
PVTSSIDLVET

SEQ ID NO: 413369 - protein, 11 aa, Influenza virus
DLIETTHTGTY

SEQ ID NO: 413370 - protein, 11 aa, Influenza virus
LIETTHTGTYC

SEQ ID NO: 413371 - protein, 11 aa, Influenza virus
IETTHTGTYCS

SEQ ID NO: 413372 - protein, 11 aa, Influenza virus
GVSPVHLGDCN

SEQ ID NO: 413373 - protein, 11 aa, Influenza virus
VSPVHLGDCNF

SEQ ID NO: 413374 - protein, 11 aa, Influenza virus
LGDCSFEGWIG

SEQ ID NO: 413375 - protein, 11 aa, Influenza virus
GDCSFEGWIGG

SEQ ID NO: 413376 - protein, 11 aa, Influenza virus
DCSFEGWIGGN

SEQ ID NO: 413377 - protein, 11 aa, Influenza virus
CNFEGWIVGNP

SEQ ID NO: 413378 - protein, 11 aa, Influenza virus
SFEGWIGGNPA

SEQ ID NO: 413379 - protein, 11 aa, Influenza virus
REWSYLIEDPT

SEQ ID NO: 413380 - protein, 11 aa, Influenza virus
EWSYLIEDPAA

SEQ ID NO: 413381 - protein, 11 aa, Influenza virus
WSYLIEDPAAP

SEQ ID NO: 413382 - protein, 11 aa, Influenza virus
SYLIEDPAAPH

SEQ ID NO: 413383 - protein, 11 aa, Influenza virus
YLIEDPAAPHG

SEQ ID NO: 413384 - protein, 11 aa, Influenza virus
LIEDPTAPHGL

SEQ ID NO: 413385 - protein, 11 aa, Influenza virus
IEDPAAPHGLC

SEQ ID NO: 413386 - protein, 11 aa, Influenza virus
EDPAAPHGLCY

SEQ ID NO: 413387 - protein, 11 aa, Influenza virus
DPTAPHGLCYP

SEQ ID NO: 413388 - protein, 11 aa, Influenza virus
PAAPHGLCYPG

SEQ ID NO: 413389 - protein, 11 aa, Influenza virus
TAPHGLCYPGE

SEQ ID NO: 413390 - protein, 11 aa, Influenza virus
IKSFSRTQLIA

SEQ ID NO: 413391 - protein, 11 aa, Influenza virus
KSFSRTQLIAP

SEQ ID NO: 413392 - protein, 11 aa, Influenza virus
GAYNNTTGRDV

SEQ ID NO: 413393 - protein, 11 aa, Influenza virus
TGRDVLVMWGL

SEQ ID NO: 413394 - protein, 11 aa, Influenza virus
GRDVLVMWGLH

SEQ ID NO: 413395 - protein, 11 aa, Influenza virus
RDVLVMWGLHH

SEQ ID NO: 413396 - protein, 11 aa, Influenza virus
DVLVMWGLHHP

SEQ ID NO: 413397 - protein, 11 aa, Influenza virus
PYTLVTTSSWS

SEQ ID NO: 413398 - protein, 11 aa, Influenza virus
GTRPGYNGQKS

SEQ ID NO: 413399 - protein, 11 aa, Influenza virus
TRPGYNGQKSW

SEQ ID NO: 413400 - protein, 11 aa, Influenza virus
RPRYNGQRSWM

SEQ ID NO: 413401 - protein, 11 aa, Influenza virus
PGYNGQKSWTK

SEQ ID NO: 413402 - protein, 11 aa, Influenza virus
GYNGQKSWTKI

SEQ ID NO: 413403 - protein, 11 aa, Influenza virus
VSFESNGGLLA

SEQ ID NO: 413404 - protein, 11 aa, Influenza virus
EYGRGRIFQSR

SEQ ID NO: 413405 - protein, 11 aa, Influenza virus
YGRGRIFQSRI

SEQ ID NO: 413406 - protein, 11 aa, Influenza virus
GRGRIFQSRIR

SEQ ID NO: 413407 - protein, 11 aa, Influenza virus
DTNKTFQNIDK

SEQ ID NO: 413408 - protein, 11 aa, Influenza virus
TNKTFQNIDKN

SEQ ID NO: 413409 - protein, 11 aa, Influenza virus
NKTFQNIDKNA

SEQ ID NO: 413410 - protein, 11 aa, Influenza virus
KTFQNIDKNAL

SEQ ID NO: 413411 - protein, 11 aa, Influenza virus
FQNIDRNALGD

SEQ ID NO: 413412 - protein, 11 aa, Influenza virus
QNIDRNALGDC

SEQ ID NO: 413413 - protein, 11 aa, Influenza virus
NIDRNALGDCP

SEQ ID NO: 413414 - protein, 11 aa, Influenza virus
IDKNALGECPK

SEQ ID NO: 413415 - protein, 11 aa, Influenza virus
DKNALGECPKY

SEQ ID NO: 413416 - protein, 11 aa, Influenza virus
KNALGECPKYI

SEQ ID NO: 413417 - protein, 11 aa, Influenza virus
KLATGLRNVPS

SEQ ID NO: 413418 - protein, 11 aa, Influenza virus
RAVDGTIAGFI

SEQ ID NO: 413419 - protein, 11 aa, Influenza virus
GLLGAIAGFIE

SEQ ID NO: 413420 - protein, 11 aa, Influenza virus
VDGTIAGFIEG

SEQ ID NO: 413421 - protein, 11 aa, Influenza virus
FQHQNEQGMGM

SEQ ID NO: 413422 - protein, 11 aa, Influenza virus
QHQNEQGMGMA

SEQ ID NO: 413423 - protein, 11 aa, Influenza virus
HQNEQGMGMAA

SEQ ID NO: 413424 - protein, 11 aa, Influenza virus
QNEQGTGIAAE

SEQ ID NO: 413425 - protein, 11 aa, Influenza virus
NEQGTGIAAEK

SEQ ID NO: 413426 - protein, 11 aa, Influenza virus
EQGTGIAAEKE

SEQ ID NO: 413427 - protein, 11 aa, Influenza virus
QGTGIAAEKES

SEQ ID NO: 413428 - protein, 11 aa, Influenza virus
GTGIAAEKEST

SEQ ID NO: 413429 - protein, 11 aa, Influenza virus
TGIAAEKESTQ

SEQ ID NO: 413430 - protein, 11 aa, Influenza virus
SIRGEFSQVER

SEQ ID NO: 413431 - protein, 11 aa, Influenza virus
IRGEFSQVERR

SEQ ID NO: 413432 - protein, 11 aa, Influenza virus
RGEFSQVERRI

SEQ ID NO: 413433 - protein, 11 aa, Influenza virus
GEFSQVERRIN

SEQ ID NO: 413434 - protein, 11 aa, Influenza virus
EFSQVERRINM

SEQ ID NO: 413435 - protein, 11 aa, Influenza virus
FSQVERRINML

SEQ ID NO: 413436 - protein, 11 aa, Influenza virus
SQVERRINMLA

SEQ ID NO: 413437 - protein, 11 aa, Influenza virus
QVERRINMLAD

SEQ ID NO: 413438 - protein, 11 aa, Influenza virus
VERRINMLADR

SEQ ID NO: 413439 - protein, 11 aa, Influenza virus
ERRINMLADRI

SEQ ID NO: 413440 - protein, 11 aa, Influenza virus
RRINMLADRID

SEQ ID NO: 413441 - protein, 11 aa, Influenza virus
KTLNMHDANVR

SEQ ID NO: 413442 - protein, 11 aa, Influenza virus
TLDLHDANVRN

SEQ ID NO: 413443 - protein, 11 aa, Influenza virus
LNMHDANVRNL

SEQ ID NO: 413444 - protein, 11 aa, Influenza virus
NMHDANVRNLH

SEQ ID NO: 413445 - protein, 11 aa, Influenza virus
LHDANVRNLHE

SEQ ID NO: 413446 - protein, 11 aa, Influenza virus
DANVRNLHDQI

SEQ ID NO: 413447 - protein, 11 aa, Influenza virus
ANVRNLHDQIR

SEQ ID NO: 413448 - protein, 11 aa, Influenza virus
LLHKCNNTCME

SEQ ID NO: 413449 - protein, 11 aa, Influenza virus
LHKCNNTCMET

SEQ ID NO: 413450 - protein, 11 aa, Influenza virus
HKCNDSCMDTI

SEQ ID NO: 413451 - protein, 11 aa, Influenza virus
KCNDSCMDTIR

SEQ ID NO: 413452 - protein, 11 aa, Influenza virus
CNDSCMDTIRN

SEQ ID NO: 413453 - protein, 11 aa, Influenza virus
NNTCMETIRNG

SEQ ID NO: 413454 - protein, 11 aa, Influenza virus
DSCMDTIRNGT

SEQ ID NO: 413455 - protein, 11 aa, Influenza virus
KLKRQEIEGIR

SEQ ID NO: 413456 - protein, 11 aa, Influenza virus
LKRQEIEGIRL

SEQ ID NO: 413457 - protein, 11 aa, Influenza virus
KRQEIEGIRLK

SEQ ID NO: 413458 - protein, 11 aa, Influenza virus
RQEIEGIKLES

SEQ ID NO: 413459 - protein, 11 aa, Influenza virus
SEDGVYKALSI

SEQ ID NO: 413460 - protein, 11 aa, Influenza virus
EDGVYKALSIY

SEQ ID NO: 413461 - protein, 11 aa, Influenza virus
DNVYRALSIYS

SEQ ID NO: 413462 - protein, 11 aa, Influenza virus
NVYRALSIYSC

SEQ ID NO: 413463 - protein, 11 aa, Influenza virus
CIASSVVLVGP

SEQ ID NO: 413464 - protein, 11 aa, Influenza virus
IASSVVLVGPI

SEQ ID NO: 413465 - protein, 11 aa, Influenza virus
ASSVVLVGPIL

SEQ ID NO: 413466 - protein, 11 aa, Influenza virus
VLVGPILSFIM

SEQ ID NO: 413467 - protein, 11 aa, Influenza virus
LVGPILSFIMW

SEQ ID NO: 413468 - protein, 11 aa, Influenza virus
VGPILSFIMWA

SEQ ID NO: 413469 - protein, 11 aa, Influenza virus
GLILTFIMWAC

SEQ ID NO: 413470 - protein, 11 aa, Influenza virus
FIMWACNSGNC

SEQ ID NO: 413471 - protein, 11 aa, Influenza virus
IMWACNSGNCR

SEQ ID NO: 413472 - protein, 11 aa, Influenza virus
MWACNSGNCRF

SEQ ID NO: 413473 - protein, 11 aa, Influenza virus
SEMKWLLSSKD

SEQ ID NO: 413474 - protein, 11 aa, Influenza virus
EMKWLSSSGNN

SEQ ID NO: 413475 - protein, 11 aa, Influenza virus
MKWLLSSKDNQ

SEQ ID NO: 413476 - protein, 11 aa, Influenza virus
KWLSSSGNNQV

SEQ ID NO: 413477 - protein, 11 aa, Influenza virus
WLLSSKDNQVF

SEQ ID NO: 413478 - protein, 11 aa, Influenza virus
LLSSKDNQVFP

SEQ ID NO: 413479 - protein, 11 aa, Influenza virus
SSSGNNQVFPQ

SEQ ID NO: 413480 - protein, 11 aa, Influenza virus
SSKDNQVFPQL

SEQ ID NO: 413481 - protein, 11 aa, Influenza virus
SGNNQVFPQLN

SEQ ID NO: 413482 - protein, 11 aa, Influenza virus
KDNQVFPQLNQ

SEQ ID NO: 413483 - protein, 11 aa, Influenza virus
GRYSRADKICI

SEQ ID NO: 413484 - protein, 11 aa, Influenza virus
RYSRADKICIG

SEQ ID NO: 413485 - protein, 11 aa, Influenza virus
IGYLSNNATDT

SEQ ID NO: 413486 - protein, 11 aa, Influenza virus
GYLSNNSTDKI

SEQ ID NO: 413487 - protein, 11 aa, Influenza virus
YLSNNSTDKID

SEQ ID NO: 413488 - protein, 11 aa, Influenza virus
LSNNSTDKIDT

SEQ ID NO: 413489 - protein, 11 aa, Influenza virus
SNNSTDKIDTL

SEQ ID NO: 413490 - protein, 11 aa, Influenza virus
NNSTDKIDTLT

SEQ ID NO: 413491 - protein, 11 aa, Influenza virus
NSTDKIDTLTE

SEQ ID NO: 413492 - protein, 11 aa, Influenza virus
TDKIDTLTETG

SEQ ID NO: 413493 - protein, 11 aa, Influenza virus
DKVDTLTETGV

SEQ ID NO: 413494 - protein, 11 aa, Influenza virus
KVDTLTETGVP

SEQ ID NO: 413495 - protein, 11 aa, Influenza virus
TYCSLNGISPV

SEQ ID NO: 413496 - protein, 11 aa, Influenza virus
YCSLNGISPVH

SEQ ID NO: 413497 - protein, 11 aa, Influenza virus
CSLNGISPVHL

SEQ ID NO: 413498 - protein, 11 aa, Influenza virus
SLNGISPVHLG

SEQ ID NO: 413499 - protein, 11 aa, Influenza virus
LNGISPVHLGD

SEQ ID NO: 413500 - protein, 11 aa, Influenza virus
NGISPVHLGDC

SEQ ID NO: 413501 - protein, 11 aa, Influenza virus
GISPVHLGDCS

SEQ ID NO: 413502 - protein, 11 aa, Influenza virus
ISPVHLGDCSF

SEQ ID NO: 413503 - protein, 11 aa, Influenza virus
EDPNAPHKLCY

SEQ ID NO: 413504 - protein, 11 aa, Influenza virus
DPNAPHKLCYP

SEQ ID NO: 413505 - protein, 11 aa, Influenza virus
PNAPHKLCYPG

SEQ ID NO: 413506 - protein, 11 aa, Influenza virus
NAPHKLCYPGE

SEQ ID NO: 413507 - protein, 11 aa, Influenza virus
KLCYPGEVDNN

SEQ ID NO: 413508 - protein, 11 aa, Influenza virus
LCYPGEVDNNG

SEQ ID NO: 413509 - protein, 11 aa, Influenza virus
CYPGEVDNNGE

SEQ ID NO: 413510 - protein, 11 aa, Influenza virus
YPGEVDNNGEL

SEQ ID NO: 413511 - protein, 11 aa, Influenza virus
SFSRTELINPN

SEQ ID NO: 413512 - protein, 11 aa, Influenza virus
FSRTELINPNK

SEQ ID NO: 413513 - protein, 11 aa, Influenza virus
SRTELINPNKW

SEQ ID NO: 413514 - protein, 11 aa, Influenza virus
RTELINPNKWG

SEQ ID NO: 413515 - protein, 11 aa, Influenza virus
PNKWGNVLDGV

SEQ ID NO: 413516 - protein, 11 aa, Influenza virus
NKWGNVLDGVT

SEQ ID NO: 413517 - protein, 11 aa, Influenza virus
KWGDILDGVTA

SEQ ID NO: 413518 - protein, 11 aa, Influenza virus
WGDILDGVTAS

SEQ ID NO: 413519 - protein, 11 aa, Influenza virus
GDILDGVTASC

SEQ ID NO: 413520 - protein, 11 aa, Influenza virus
DILDGVTASCR

SEQ ID NO: 413521 - protein, 11 aa, Influenza virus
LDGVTASCRDN

SEQ ID NO: 413522 - protein, 11 aa, Influenza virus
DGVTASCRDNG

SEQ ID NO: 413523 - protein, 11 aa, Influenza virus
GVTASCLDRGT

SEQ ID NO: 413524 - protein, 11 aa, Influenza virus
SFYRNLIWLVK

SEQ ID NO: 413525 - protein, 11 aa, Influenza virus
VRGDYNNTTGR

SEQ ID NO: 413526 - protein, 11 aa, Influenza virus
LWGIHHPDTEE

SEQ ID NO: 413527 - protein, 11 aa, Influenza virus
WGIHHPDTEEV

SEQ ID NO: 413528 - protein, 11 aa, Influenza virus
GIHHPDTEEVA

SEQ ID NO: 413529 - protein, 11 aa, Influenza virus
AINLYASKNPY

SEQ ID NO: 413530 - protein, 11 aa, Influenza virus
TRLYVNKNPYT

SEQ ID NO: 413531 - protein, 11 aa, Influenza virus
RLYVNKNPYTL

SEQ ID NO: 413532 - protein, 11 aa, Influenza virus
SWMKLYWHLMS

SEQ ID NO: 413533 - protein, 11 aa, Influenza virus
WMKLYWHLMSP

SEQ ID NO: 413534 - protein, 11 aa, Influenza virus
MKLYWHLMSPG

SEQ ID NO: 413535 - protein, 11 aa, Influenza virus
KLYWHLMSPGE

SEQ ID NO: 413536 - protein, 11 aa, Influenza virus
LYWHLMSPGER

SEQ ID NO: 413537 - protein, 11 aa, Influenza virus
YWHLMRPGERT

SEQ ID NO: 413538 - protein, 11 aa, Influenza virus
PGERTTFESNG

SEQ ID NO: 413539 - protein, 11 aa, Influenza virus
GERTTFESNGG

SEQ ID NO: 413540 - protein, 11 aa, Influenza virus
ERTTFESNGGL

SEQ ID NO: 413541 - protein, 11 aa, Influenza virus
TFESSGGLLAP

SEQ ID NO: 413542 - protein, 11 aa, Influenza virus
YGTGRIFQSRI

SEQ ID NO: 413543 - protein, 11 aa, Influenza virus
GTGRIFQSRIR

SEQ ID NO: 413544 - protein, 11 aa, Influenza virus
GRIFQSGVRVA

SEQ ID NO: 413545 - protein, 11 aa, Influenza virus
RMGKCNTKCQT

SEQ ID NO: 413546 - protein, 11 aa, Influenza virus
MGKCNTKCQTS

SEQ ID NO: 413547 - protein, 11 aa, Influenza virus
RCNTKCQTSLG

SEQ ID NO: 413548 - protein, 11 aa, Influenza virus
NTKCQTSMGGV

SEQ ID NO: 413549 - protein, 11 aa, Influenza virus
IDTNKTFQNID

SEQ ID NO: 413550 - protein, 11 aa, Influenza virus
DTNKTFQNIDR

SEQ ID NO: 413551 - protein, 11 aa, Influenza virus
SERGLFGAIAG

SEQ ID NO: 413552 - protein, 11 aa, Influenza virus
AADKVSTQKAL

SEQ ID NO: 413553 - protein, 11 aa, Influenza virus
ADKVSTQKAIN

SEQ ID NO: 413554 - protein, 11 aa, Influenza virus
DKVSTQKAINE

SEQ ID NO: 413555 - protein, 11 aa, Influenza virus
KVSTQKAINEI

SEQ ID NO: 413556 - protein, 11 aa, Influenza virus
VSTQKAINEIT

SEQ ID NO: 413557 - protein, 11 aa, Influenza virus
LVLLENGRTLG

SEQ ID NO: 413558 - protein, 11 aa, Influenza virus
VLLENGRTLGL

SEQ ID NO: 413559 - protein, 11 aa, Influenza virus
LLENGRTLGLH

SEQ ID NO: 413560 - protein, 11 aa, Influenza virus
LENGRTLGLHD

SEQ ID NO: 413561 - protein, 11 aa, Influenza virus
LHDANVKNLHD

SEQ ID NO: 413562 - protein, 11 aa, Influenza virus
HDANVKNLHDQ

SEQ ID NO: 413563 - protein, 11 aa, Influenza virus
DANVKNLHEQV

SEQ ID NO: 413564 - protein, 11 aa, Influenza virus
ANVKNLHEQVK

SEQ ID NO: 413565 - protein, 11 aa, Influenza virus
NVRNLHDQIKR

SEQ ID NO: 413566 - protein, 11 aa, Influenza virus
LQNNAIDEGDG

SEQ ID NO: 413567 - protein, 11 aa, Influenza virus
QNNAIDEGDGC

SEQ ID NO: 413568 - protein, 11 aa, Influenza virus
AIDEGDGCFNF

SEQ ID NO: 413569 - protein, 11 aa, Influenza virus
IDEGDGCFNFF

SEQ ID NO: 413570 - protein, 11 aa, Influenza virus
DEGDGCFNFFH

SEQ ID NO: 413571 - protein, 11 aa, Influenza virus
EGDGCFNFFHK

SEQ ID NO: 413572 - protein, 11 aa, Influenza virus
GDGCFNFFHKC

SEQ ID NO: 413573 - protein, 11 aa, Influenza virus
DGCFNFFHKCN

SEQ ID NO: 413574 - protein, 11 aa, Influenza virus
GCFNFFHKCND

SEQ ID NO: 413575 - protein, 11 aa, Influenza virus
CFNFFHKCNDS

SEQ ID NO: 413576 - protein, 11 aa, Influenza virus
FNFFHKCNDSC

SEQ ID NO: 413577 - protein, 11 aa, Influenza virus
NFFHKCNDSCM

SEQ ID NO: 413578 - protein, 11 aa, Influenza virus
KLKSEDNVYKV

SEQ ID NO: 413579 - protein, 11 aa, Influenza virus
LKSEDNVYKVL

SEQ ID NO: 413580 - protein, 11 aa, Influenza virus
KTEDNVYKVLA

SEQ ID NO: 413581 - protein, 11 aa, Influenza virus
TEDNVYKVLAI

SEQ ID NO: 413582 - protein, 11 aa, Influenza virus
EDNIYKILSIY

SEQ ID NO: 413583 - protein, 11 aa, Influenza virus
DNIYKILSIYS

SEQ ID NO: 413584 - protein, 11 aa, Influenza virus
NVYKVLAIYSC

SEQ ID NO: 413585 - protein, 11 aa, Influenza virus
VYKVLAIYSCI

SEQ ID NO: 413586 - protein, 11 aa, Influenza virus
LAIYSCIASSI

SEQ ID NO: 413587 - protein, 11 aa, Influenza virus
AIYSCIASSIV

SEQ ID NO: 413588 - protein, 11 aa, Influenza virus
IYSCIASSTVL

SEQ ID NO: 413589 - protein, 11 aa, Influenza virus
YSCIASSTVLV

SEQ ID NO: 413590 - protein, 11 aa, Influenza virus
SCIASSTVLVG

SEQ ID NO: 413591 - protein, 11 aa, Influenza virus
CIASSTVLVGL

SEQ ID NO: 413592 - protein, 11 aa, Influenza virus
IASSTVLVGLI

SEQ ID NO: 413593 - protein, 11 aa, Influenza virus
ASSTVLVGLIL

SEQ ID NO: 413594 - protein, 11 aa, Influenza virus
SSTVLVGLILA

SEQ ID NO: 413595 - protein, 11 aa, Influenza virus
STVLVGLILAF

SEQ ID NO: 413596 - protein, 11 aa, Influenza virus
TVLVGLILAFI

SEQ ID NO: 413597 - protein, 11 aa, Influenza virus
AFIMWACSNGN

SEQ ID NO: 413598 - protein, 11 aa, Influenza virus
FIMWACSNGNC

SEQ ID NO: 413599 - protein, 11 aa, Influenza virus
IMWACSNGNCR

SEQ ID NO: 413600 - protein, 11 aa, Influenza virus
MWACSNGNCRF

SEQ ID NO: 413601 - protein, 11 aa, Influenza virus
WACSSGNCRFS

SEQ ID NO: 413602 - protein, 11 aa, Influenza virus
ACSNGNCRFNV

SEQ ID NO: 413603 - protein, 11 aa, Influenza virus
CSNGNCRFNVC

SEQ ID NO: 413604 - protein, 11 aa, Influenza virus
SNGNCRFNVCI

SEQ ID NO: 413605 - protein, 11 aa, Influenza virus
ATKMEAILVVL

SEQ ID NO: 413606 - protein, 11 aa, Influenza virus
PNDGQVLYFLI

SEQ ID NO: 413607 - protein, 11 aa, Influenza virus
GFIENGWEGMV

SEQ ID NO: 413608 - protein, 11 aa, Influenza virus
FIENGWEGMVD

SEQ ID NO: 413609 - protein, 11 aa, Influenza virus
IENGWEGMVDG

SEQ ID NO: 413610 - protein, 11 aa, Influenza virus
ENGWEGMVDGW

SEQ ID NO: 413611 - protein, 11 aa, Influenza virus
NGWEGMVDGWY

SEQ ID NO: 413612 - protein, 11 aa, Influenza virus
GWEGMVDGWYG

SEQ ID NO: 413613 - protein, 11 aa, Influenza virus
WEGMVDGWYGF

SEQ ID NO: 413614 - protein, 11 aa, Influenza virus
EGMVDGWYGFR

SEQ ID NO: 413615 - protein, 11 aa, Influenza virus
GMVDGWYGFRH

SEQ ID NO: 413616 - protein, 11 aa, Influenza virus
YNAQLLVLLEN

SEQ ID NO: 413617 - protein, 11 aa, Influenza virus
SLQCRICIDFR

SEQ ID NO: 413618 - protein, 11 aa, Influenza virus
LQCRICILDQN

SEQ ID NO: 413619 - protein, 11 aa, Influenza virus
KMKAIIVVLLY

SEQ ID NO: 413620 - protein, 11 aa, Influenza virus
NSTDTVDTVRE

SEQ ID NO: 413621 - protein, 11 aa, Influenza virus
STDTVDTLLEK

SEQ ID NO: 413622 - protein, 11 aa, Influenza virus
TDTVDTLLEKN

SEQ ID NO: 413623 - protein, 11 aa, Influenza virus
TVDTLLEKNVT

SEQ ID NO: 413624 - protein, 11 aa, Influenza virus
VDTLLEKNVTV

SEQ ID NO: 413625 - protein, 11 aa, Influenza virus
DTLLEKNVTVT

SEQ ID NO: 413626 - protein, 11 aa, Influenza virus
TLLEKNVTVTH

SEQ ID NO: 413627 - protein, 11 aa, Influenza virus
LLEKNVTVTHS

SEQ ID NO: 413628 - protein, 11 aa, Influenza virus
KNVTVTHSVDL

SEQ ID NO: 413629 - protein, 11 aa, Influenza virus
VAGWLLGNPEC

SEQ ID NO: 413630 - protein, 11 aa, Influenza virus
DYEELREQLST

SEQ ID NO: 413631 - protein, 11 aa, Influenza virus
YEELREHLSSV

SEQ ID NO: 413632 - protein, 11 aa, Influenza virus
EELREHLSSVS

SEQ ID NO: 413633 - protein, 11 aa, Influenza virus
ELREHLSSVSS

SEQ ID NO: 413634 - protein, 11 aa, Influenza virus
LREHLSSVSSF

SEQ ID NO: 413635 - protein, 11 aa, Influenza virus
EHLSSVSSFER

SEQ ID NO: 413636 - protein, 11 aa, Influenza virus
HLSSVSSFERF

SEQ ID NO: 413637 - protein, 11 aa, Influenza virus
LSSVSSFKRFE

SEQ ID NO: 413638 - protein, 11 aa, Influenza virus
SSVSSFERFEM

SEQ ID NO: 413639 - protein, 11 aa, Influenza virus
SVSSFERFEMF

SEQ ID NO: 413640 - protein, 11 aa, Influenza virus
VSSFKRFEIFP

SEQ ID NO: 413641 - protein, 11 aa, Influenza virus
SSFERFEIFPN

SEQ ID NO: 413642 - protein, 11 aa, Influenza virus
DTIIFEASGNL

SEQ ID NO: 413643 - protein, 11 aa, Influenza virus
TIGKCSKYVKS

SEQ ID NO: 413644 - protein, 11 aa, Influenza virus
IGECPKYVRST

SEQ ID NO: 413645 - protein, 11 aa, Influenza virus
LRLATGLRNIP

SEQ ID NO: 413646 - protein, 11 aa, Influenza virus
RLATGLRNIPS

SEQ ID NO: 413647 - protein, 11 aa, Influenza virus
VTGLRNVPSIQ

SEQ ID NO: 413648 - protein, 11 aa, Influenza virus
RNVPSVQSRGL

SEQ ID NO: 413649 - protein, 11 aa, Influenza virus
NVPSVQSRGLF

SEQ ID NO: 413650 - protein, 11 aa, Influenza virus
VPSVQSRGLFG

SEQ ID NO: 413651 - protein, 11 aa, Influenza virus
NEQGSGYAADR

SEQ ID NO: 413652 - protein, 11 aa, Influenza virus
EQGSGYAADRK

SEQ ID NO: 413653 - protein, 11 aa, Influenza virus
NKVNTVIEKMN

SEQ ID NO: 413654 - protein, 11 aa, Influenza virus
NSVVEKMNTQF

SEQ ID NO: 413655 - protein, 11 aa, Influenza virus
SVVEKMNTQFT

SEQ ID NO: 413656 - protein, 11 aa, Influenza virus
MNTQFTVVGKE

SEQ ID NO: 413657 - protein, 11 aa, Influenza virus
NTQFTSVGKEF

SEQ ID NO: 413658 - protein, 11 aa, Influenza virus
RIENLNRKVDD

SEQ ID NO: 413659 - protein, 11 aa, Influenza virus
IENLNRKVDDG

SEQ ID NO: 413660 - protein, 11 aa, Influenza virus
ENLNRKVDDGF

SEQ ID NO: 413661 - protein, 11 aa, Influenza virus
NLNKKVDDGLL

SEQ ID NO: 413662 - protein, 11 aa, Influenza virus
LNKKVDDGLLD

SEQ ID NO: 413663 - protein, 11 aa, Influenza virus
DDGLLDVWTYN

SEQ ID NO: 413664 - protein, 11 aa, Influenza virus
DGLLDVWTYNA

SEQ ID NO: 413665 - protein, 11 aa, Influenza virus
GLLDVWTYNAE

SEQ ID NO: 413666 - protein, 11 aa, Influenza virus
LLDVWTYNAEL

SEQ ID NO: 413667 - protein, 11 aa, Influenza virus
IDVWTYNAELL

SEQ ID NO: 413668 - protein, 11 aa, Influenza virus
ENERTLDFHDF

SEQ ID NO: 413669 - protein, 11 aa, Influenza virus
GCFEFYHKCNN

SEQ ID NO: 413670 - protein, 11 aa, Influenza virus
CMESIKNGTYD

SEQ ID NO: 413671 - protein, 11 aa, Influenza virus
MESIKNGTYDY

SEQ ID NO: 413672 - protein, 11 aa, Influenza virus
ESIKNGTYDYP

SEQ ID NO: 413673 - protein, 11 aa, Influenza virus
SIKNGTYDYPK

SEQ ID NO: 413674 - protein, 11 aa, Influenza virus
IKNGTYDYPKY

SEQ ID NO: 413675 - protein, 11 aa, Influenza virus
TYDYPKYSKES

SEQ ID NO: 413676 - protein, 11 aa, Influenza virus
AIYSTVASSLI

SEQ ID NO: 413677 - protein, 11 aa, Influenza virus
IYSTVASSLIL

SEQ ID NO: 413678 - protein, 11 aa, Influenza virus
ASSLVLIVSLG

SEQ ID NO: 413679 - protein, 11 aa, Influenza virus
SSLVLIVSLGA

SEQ ID NO: 413680 - protein, 11 aa, Influenza virus
LLVSLGAVSFW

SEQ ID NO: 413681 - protein, 11 aa, Influenza virus
LVSLGAVSFWM

SEQ ID NO: 413682 - protein, 11 aa, Influenza virus
GAIGFWMCSNG

SEQ ID NO: 413683 - protein, 11 aa, Influenza virus
AIGFWMCSNGS

SEQ ID NO: 413684 - protein, 11 aa, Influenza virus
IGFWMCSNGSL

SEQ ID NO: 413685 - protein, 11 aa, Influenza virus
GFWMCSNGSLQ

SEQ ID NO: 413686 - protein, 11 aa, Influenza virus
MCSGHSCRICI

SEQ ID NO: 413687 - protein, 11 aa, Influenza virus
CSWSLQCRICI

SEQ ID NO: 413688 - protein, 11 aa, Influenza virus
SKDNGIRIGSK

SEQ ID NO: 413689 - protein, 11 aa, Influenza virus
KDNGVRIGSKG

SEQ ID NO: 413690 - protein, 11 aa, Influenza virus
DNGVRIGSKGD

SEQ ID NO: 413691 - protein, 11 aa, Influenza virus
NGIRIGSKGDV

SEQ ID NO: 413692 - protein, 11 aa, Influenza virus
GIRIGSKGDVF

SEQ ID NO: 413693 - protein, 11 aa, Influenza virus
RIGSKGDVFVM

SEQ ID NO: 413694 - protein, 11 aa, Influenza virus
IGSKGDVFVMR

SEQ ID NO: 413695 - protein, 11 aa, Influenza virus
GSKGDVFVMRE

SEQ ID NO: 413696 - protein, 11 aa, Influenza virus
SKGDVFVMREP

SEQ ID NO: 413697 - protein, 11 aa, Influenza virus
KGDVFVMREPF

SEQ ID NO: 413698 - protein, 11 aa, Influenza virus
VIREPFISCSQ

SEQ ID NO: 413699 - protein, 11 aa, Influenza virus
IREPFISCSQL

SEQ ID NO: 413700 - protein, 11 aa, Influenza virus
REPFISCSHFE

SEQ ID NO: 413701 - protein, 11 aa, Influenza virus
EPFISCSHFEC

SEQ ID NO: 413702 - protein, 11 aa, Influenza virus
LLNDKHSNGTA

SEQ ID NO: 413703 - protein, 11 aa, Influenza virus
LNDKHSNGTAK

SEQ ID NO: 413704 - protein, 11 aa, Influenza virus
KDRSPFRALMS

SEQ ID NO: 413705 - protein, 11 aa, Influenza virus
NRSPYRALMSC

SEQ ID NO: 413706 - protein, 11 aa, Influenza virus
LMSCPVGEAPS

SEQ ID NO: 413707 - protein, 11 aa, Influenza virus
MSCPVGEAPSP

SEQ ID NO: 413708 - protein, 11 aa, Influenza virus
SCPVGEAPSPY

SEQ ID NO: 413709 - protein, 11 aa, Influenza virus
CPVGEAPSPYN

SEQ ID NO: 413710 - protein, 11 aa, Influenza virus
PVGEAPSPYNS

SEQ ID NO: 413711 - protein, 11 aa, Influenza virus
AWSASACHDGL

SEQ ID NO: 413712 - protein, 11 aa, Influenza virus
GWITIGISGPD

SEQ ID NO: 413713 - protein, 11 aa, Influenza virus
WITIGISGPDN

SEQ ID NO: 413714 - protein, 11 aa, Influenza virus
ITIGISGPDNG

SEQ ID NO: 413715 - protein, 11 aa, Influenza virus
IGISGPDSGAV

SEQ ID NO: 413716 - protein, 11 aa, Influenza virus
DNEAVAVLKYN

SEQ ID NO: 413717 - protein, 11 aa, Influenza virus
NGAVAVLKYND

SEQ ID NO: 413718 - protein, 11 aa, Influenza virus
GAVAVLKYNGV

SEQ ID NO: 413719 - protein, 11 aa, Influenza virus
AVLKYNDIITD

SEQ ID NO: 413720 - protein, 11 aa, Influenza virus
VLKYKGIITGT

SEQ ID NO: 413721 - protein, 11 aa, Influenza virus
LRTQESECVCI

SEQ ID NO: 413722 - protein, 11 aa, Influenza virus
QESECVCINGS

SEQ ID NO: 413723 - protein, 11 aa, Influenza virus
ESECVCINGSC

SEQ ID NO: 413724 - protein, 11 aa, Influenza virus
SCFTIMTDGPN

SEQ ID NO: 413725 - protein, 11 aa, Influenza virus
APNSHYEECSC

SEQ ID NO: 413726 - protein, 11 aa, Influenza virus
PNSHYEECSCY

SEQ ID NO: 413727 - protein, 11 aa, Influenza virus
NSHYEECSCYP

SEQ ID NO: 413728 - protein, 11 aa, Influenza virus
HASNRPWVSFN

SEQ ID NO: 413729 - protein, 11 aa, Influenza virus
NRPWISFDQNL

SEQ ID NO: 413730 - protein, 11 aa, Influenza virus
VGYICSGVFGD

SEQ ID NO: 413731 - protein, 11 aa, Influenza virus
CSGVLGDNPRP

SEQ ID NO: 413732 - protein, 11 aa, Influenza virus
GFSYKYDNGVW

SEQ ID NO: 413733 - protein, 11 aa, Influenza virus
KYGNGVWMGRT

SEQ ID NO: 413734 - protein, 11 aa, Influenza virus
GDGVWIGRTKS

SEQ ID NO: 413735 - protein, 11 aa, Influenza virus
FEIIWDPNGWT

SEQ ID NO: 413736 - protein, 11 aa, Influenza virus
TNWSGYSGSFV

SEQ ID NO: 413737 - protein, 11 aa, Influenza virus
FVQHPELTGMD

SEQ ID NO: 413738 - protein, 11 aa, Influenza virus
VQHPELTGMDC

SEQ ID NO: 413739 - protein, 11 aa, Influenza virus
QHPELTGLNCI

SEQ ID NO: 413740 - protein, 11 aa, Influenza virus
NCIKPCFWVEL

SEQ ID NO: 413741 - protein, 11 aa, Influenza virus
CMRPCFWVELV

SEQ ID NO: 413742 - protein, 11 aa, Influenza virus
MRPCFWVELVR

SEQ ID NO: 413743 - protein, 11 aa, Influenza virus
TIWTSGSIISF

SEQ ID NO: 413744 - protein, 11 aa, Influenza virus
IWTSASSISFC

SEQ ID NO: 413745 - protein, 11 aa, Influenza virus
SASSISFCGVN

SEQ ID NO: 413746 - protein, 11 aa, Influenza virus
DTLCICYHANN

SEQ ID NO: 413747 - protein, 11 aa, Influenza virus
TLCICYHANNS

SEQ ID NO: 413748 - protein, 11 aa, Influenza virus
LCIDYHAHNST

SEQ ID NO: 413749 - protein, 11 aa, Influenza virus
GYHANNSSDTV

SEQ ID NO: 413750 - protein, 11 aa, Influenza virus
KNVAVTHSVNL

SEQ ID NO: 413751 - protein, 11 aa, Influenza virus
NVKVTHRENLL

SEQ ID NO: 413752 - protein, 11 aa, Influenza virus
LTVTHSVNLLE

SEQ ID NO: 413753 - protein, 11 aa, Influenza virus
PFQNIHPITIG

SEQ ID NO: 413754 - protein, 11 aa, Influenza virus
HPVTIGKCPKY

SEQ ID NO: 413755 - protein, 11 aa, Influenza virus
PVTIGKCPKYV

SEQ ID NO: 413756 - protein, 11 aa, Influenza virus
ATIGECPKYVK

SEQ ID NO: 413757 - protein, 11 aa, Influenza virus
SVQSRGLFGAI

SEQ ID NO: 413758 - protein, 11 aa, Influenza virus
IQSKGLFGAIA

SEQ ID NO: 413759 - protein, 11 aa, Influenza virus
QSKGLFGAIAG

SEQ ID NO: 413760 - protein, 11 aa, Influenza virus
FIEGGWTGMIE

SEQ ID NO: 413761 - protein, 11 aa, Influenza virus
IEGGWTGMIEG

SEQ ID NO: 413762 - protein, 11 aa, Influenza virus
LWTYNAELLIL

SEQ ID NO: 413763 - protein, 11 aa, Influenza virus
ILLENERTLDF

SEQ ID NO: 413764 - protein, 11 aa, Influenza virus
ENERTLDFHDF

SEQ ID NO: 413765 - protein, 11 aa, Influenza virus
NERTLDFHDFN

SEQ ID NO: 413766 - protein, 11 aa, Influenza virus
ERTLDFHDFNV

SEQ ID NO: 413767 - protein, 11 aa, Influenza virus
NKVKEIGNGCF

SEQ ID NO: 413768 - protein, 11 aa, Influenza virus
NAKEIGNGCFK

SEQ ID NO: 413769 - protein, 11 aa, Influenza virus
AREIGNGCFEF

SEQ ID NO: 413770 - protein, 11 aa, Influenza virus
RELGNGCFEFY

SEQ ID NO: 413771 - protein, 11 aa, Influenza virus
IGNGCFEFYHT

SEQ ID NO: 413772 - protein, 11 aa, Influenza virus
GCFEFYHKCDN

SEQ ID NO: 413773 - protein, 11 aa, Influenza virus
SFWMCSNGSLH

SEQ ID NO: 413774 - protein, 11 aa, Influenza virus
WMCSNGSLQSK

SEQ ID NO: 413775 - protein, 11 aa, Influenza virus
MCSNGSLHGRI

SEQ ID NO: 413776 - protein, 11 aa, Influenza virus
ITGFAPFSEDN

SEQ ID NO: 413777 - protein, 11 aa, Influenza virus
NGFAPFSKDNS

SEQ ID NO: 413778 - protein, 11 aa, Influenza virus
NSIRLSAGGAV

SEQ ID NO: 413779 - protein, 11 aa, Influenza virus
SIRVSAGGDIW

SEQ ID NO: 413780 - protein, 11 aa, Influenza virus
RVSAGGDIWVT

SEQ ID NO: 413781 - protein, 11 aa, Influenza virus
VSAGGDIWVTR

SEQ ID NO: 413782 - protein, 11 aa, Influenza virus
SAGGDIWVTRK

SEQ ID NO: 413783 - protein, 11 aa, Influenza virus
AGGAVWVTREP

SEQ ID NO: 413784 - protein, 11 aa, Influenza virus
GGDIWVTRKPY

SEQ ID NO: 413785 - protein, 11 aa, Influenza virus
GDVWVTREPYV

SEQ ID NO: 413786 - protein, 11 aa, Influenza virus
DVWVTREPYVS

SEQ ID NO: 413787 - protein, 11 aa, Influenza virus
QFALGQGTTLK

SEQ ID NO: 413788 - protein, 11 aa, Influenza virus
FALGQGTTLKN

SEQ ID NO: 413789 - protein, 11 aa, Influenza virus
PHRTLLMSELG

SEQ ID NO: 413790 - protein, 11 aa, Influenza virus
HRTLLMSELGV

SEQ ID NO: 413791 - protein, 11 aa, Influenza virus
ELGVPFYLGTR

SEQ ID NO: 413792 - protein, 11 aa, Influenza virus
LGTKQVCMAWS

SEQ ID NO: 413793 - protein, 11 aa, Influenza virus
GTKQVCMAWSS

SEQ ID NO: 413794 - protein, 11 aa, Influenza virus
TKQVCMAWSSS

SEQ ID NO: 413795 - protein, 11 aa, Influenza virus
KQVCMAWSSSS

SEQ ID NO: 413796 - protein, 11 aa, Influenza virus
WSSSSCHDGKS

SEQ ID NO: 413797 - protein, 11 aa, Influenza virus
SSSSCHDGKSW

SEQ ID NO: 413798 - protein, 11 aa, Influenza virus
SSSCHDGKSWL

SEQ ID NO: 413799 - protein, 11 aa, Influenza virus
SSCHDGKSWLH

SEQ ID NO: 413800 - protein, 11 aa, Influenza virus
SCHDGKSWLHV

SEQ ID NO: 413801 - protein, 11 aa, Influenza virus
CHDGKSWLHVC

SEQ ID NO: 413802 - protein, 11 aa, Influenza virus
LRTHESECVCI

SEQ ID NO: 413803 - protein, 11 aa, Influenza virus
TCAVVMTDGSA

SEQ ID NO: 413804 - protein, 11 aa, Influenza virus
CTVVMTDGSVS

SEQ ID NO: 413805 - protein, 11 aa, Influenza virus
GNAQHVEECSC

SEQ ID NO: 413806 - protein, 11 aa, Influenza virus
NAQHVEECSCY

SEQ ID NO: 413807 - protein, 11 aa, Influenza virus
HVEECSCYPRS

SEQ ID NO: 413808 - protein, 11 aa, Influenza virus
VEECSCYPRSP

SEQ ID NO: 413809 - protein, 11 aa, Influenza virus
VRCICRDNWRG

SEQ ID NO: 413810 - protein, 11 aa, Influenza virus
ICRDNWRGSNR

SEQ ID NO: 413811 - protein, 11 aa, Influenza virus
DNWRGSNRPIV

SEQ ID NO: 413812 - protein, 11 aa, Influenza virus
NWRGSNRPIVD

SEQ ID NO: 413813 - protein, 11 aa, Influenza virus
WRGSNRPIVDI

SEQ ID NO: 413814 - protein, 11 aa, Influenza virus
GDHGVKGWAFD

SEQ ID NO: 413815 - protein, 11 aa, Influenza virus
SCVNRCFYVEL

SEQ ID NO: 413816 - protein, 11 aa, Influenza virus
CFYVELIRGRP

SEQ ID NO: 413817 - protein, 11 aa, Influenza virus
ILWTSNSIVVF

SEQ ID NO: 413818 - protein, 11 aa, Influenza virus
WWTSNSIVAFC

SEQ ID NO: 413819 - protein, 11 aa, Influenza virus
TSNSIVVFCGA

SEQ ID NO: 413820 - protein, 11 aa, Influenza virus
SNSIVVFCGAS

SEQ ID NO: 413821 - protein, 11 aa, Influenza virus
NSIVVFCGASG

SEQ ID NO: 413822 - protein, 11 aa, Influenza virus
SIVVFCGTPGT

SEQ ID NO: 413823 - protein, 11 aa, Influenza virus
VVFCGASGTYG

SEQ ID NO: 413824 - protein, 11 aa, Influenza virus
MDNQTKKMTIT

SEQ ID NO: 413825 - protein, 11 aa, Influenza virus
DNQTKKMTITF

SEQ ID NO: 413826 - protein, 11 aa, Influenza virus
KQTKTMTITFL

SEQ ID NO: 413827 - protein, 11 aa, Influenza virus
GDRICIGYHAN

SEQ ID NO: 413828 - protein, 11 aa, Influenza virus
DRICIGYHANN

SEQ ID NO: 413829 - protein, 11 aa, Influenza virus
RICIGYHANNS

SEQ ID NO: 413830 - protein, 11 aa, Influenza virus
CIGYHSNNSTK

SEQ ID NO: 413831 - protein, 11 aa, Influenza virus
LEKNVTVTHAQ

SEQ ID NO: 413832 - protein, 11 aa, Influenza virus
NITVTHAKDIL

SEQ ID NO: 413833 - protein, 11 aa, Influenza virus
VTVTHAQNILE

SEQ ID NO: 413834 - protein, 11 aa, Influenza virus
TVTHAQDILER

SEQ ID NO: 413835 - protein, 11 aa, Influenza virus
DILERTHNGKL

SEQ ID NO: 413836 - protein, 11 aa, Influenza virus
ILEKMHNGKLC

SEQ ID NO: 413837 - protein, 11 aa, Influenza virus
GVPPLELGDCS

SEQ ID NO: 413838 - protein, 11 aa, Influenza virus
VPPLELGDCSI

SEQ ID NO: 413839 - protein, 11 aa, Influenza virus
SPLELGDCSIA

SEQ ID NO: 413840 - protein, 11 aa, Influenza virus
GWLLGNPKCDR

SEQ ID NO: 413841 - protein, 11 aa, Influenza virus
WLLGNPECDLF

SEQ ID NO: 413842 - protein, 11 aa, Influenza virus
LLGNPECDLFL

SEQ ID NO: 413843 - protein, 11 aa, Influenza virus
VPEWSYIIEKE

SEQ ID NO: 413844 - protein, 11 aa, Influenza virus
SYNNTSGKQML

SEQ ID NO: 413845 - protein, 11 aa, Influenza virus
ISFESTGNLVA

SEQ ID NO: 413846 - protein, 11 aa, Influenza virus
SFESTGNLVAP

SEQ ID NO: 413847 - protein, 11 aa, Influenza virus
EYGFKISKRGN

SEQ ID NO: 413848 - protein, 11 aa, Influenza virus
YGFKISKRGNS

SEQ ID NO: 413849 - protein, 11 aa, Influenza virus
GFKISKRGNSG

SEQ ID NO: 413850 - protein, 11 aa, Influenza virus
FKISKRGNSGI

SEQ ID NO: 413851 - protein, 11 aa, Influenza virus
ISKRGNSGIMK

SEQ ID NO: 413852 - protein, 11 aa, Influenza virus
SKRGNSGIMKT

SEQ ID NO: 413853 - protein, 11 aa, Influenza virus
CETKCQSPLGA

SEQ ID NO: 413854 - protein, 11 aa, Influenza virus
TKCQTPLGALN

SEQ ID NO: 413855 - protein, 11 aa, Influenza virus
KCQTPLGALNT

SEQ ID NO: 413856 - protein, 11 aa, Influenza virus
MPFHNVHPLTI

SEQ ID NO: 413857 - protein, 11 aa, Influenza virus
IHPLTMGECPK

SEQ ID NO: 413858 - protein, 11 aa, Influenza virus
LTIGECPKYVR

SEQ ID NO: 413859 - protein, 11 aa, Influenza virus
TIGECPKYVRS

SEQ ID NO: 413860 - protein, 11 aa, Influenza virus
PQIEARGLFGA

SEQ ID NO: 413861 - protein, 11 aa, Influenza virus
QTESRGLFGAI

SEQ ID NO: 413862 - protein, 11 aa, Influenza virus
TESRGLFGAIA

SEQ ID NO: 413863 - protein, 11 aa, Influenza virus
NLEKRLGNLNK

SEQ ID NO: 413864 - protein, 11 aa, Influenza virus
LERRLENLSKR

SEQ ID NO: 413865 - protein, 11 aa, Influenza virus
RLENLDKKMED

SEQ ID NO: 413866 - protein, 11 aa, Influenza virus
LENLNKRMEDG

SEQ ID NO: 413867 - protein, 11 aa, Influenza virus
ENLNKKMEDGL

SEQ ID NO: 413868 - protein, 11 aa, Influenza virus
MWTYNAELLVL

SEQ ID NO: 413869 - protein, 11 aa, Influenza virus
AELLVLMENEM

SEQ ID NO: 413870 - protein, 11 aa, Influenza virus
VLMENERTLGF

SEQ ID NO: 413871 - protein, 11 aa, Influenza virus
LMENERTLEFH

SEQ ID NO: 413872 - protein, 11 aa, Influenza virus
MENERILDFHD

SEQ ID NO: 413873 - protein, 11 aa, Influenza virus
ENERTLEFHDS

SEQ ID NO: 413874 - protein, 11 aa, Influenza virus
NERTLEFHDSN

SEQ ID NO: 413875 - protein, 11 aa, Influenza virus
ERILDFHDSNV

SEQ ID NO: 413876 - protein, 11 aa, Influenza virus
LDYHDSNVKNL

SEQ ID NO: 413877 - protein, 11 aa, Influenza virus
DYHDSNVKNLY

SEQ ID NO: 413878 - protein, 11 aa, Influenza virus
LYDKVRMQLKD

SEQ ID NO: 413879 - protein, 11 aa, Influenza virus
YDRVRMQLRDN

SEQ ID NO: 413880 - protein, 11 aa, Influenza virus
KVRMQLKDNAK

SEQ ID NO: 413881 - protein, 11 aa, Influenza virus
VKMQLRDNAKE

SEQ ID NO: 413882 - protein, 11 aa, Influenza virus
MQLRDNAKETG

SEQ ID NO: 413883 - protein, 11 aa, Influenza virus
DNAKETGNGCF

SEQ ID NO: 413884 - protein, 11 aa, Influenza virus
NAKEVGNGCFE

SEQ ID NO: 413885 - protein, 11 aa, Influenza virus
AKETGNGCFEF

SEQ ID NO: 413886 - protein, 11 aa, Influenza virus
KEVGNGCFEFY

SEQ ID NO: 413887 - protein, 11 aa, Influenza virus
ETGNGCFEFYH

SEQ ID NO: 413888 - protein, 11 aa, Influenza virus
TGNGCFEFYHK

SEQ ID NO: 413889 - protein, 11 aa, Influenza virus
FYHKCDDECMS

SEQ ID NO: 413890 - protein, 11 aa, Influenza virus
YHKCDDECMSS

SEQ ID NO: 413891 - protein, 11 aa, Influenza virus
GTYYYPKYEEE

SEQ ID NO: 413892 - protein, 11 aa, Influenza virus
TYYYPKYEEES

SEQ ID NO: 413893 - protein, 11 aa, Influenza virus
YPKYEEESRLN

SEQ ID NO: 413894 - protein, 11 aa, Influenza virus
PKYEEESRLNR

SEQ ID NO: 413895 - protein, 11 aa, Influenza virus
KYEEESRLNRN

SEQ ID NO: 413896 - protein, 11 aa, Influenza virus
YEEESRLNRNE

SEQ ID NO: 413897 - protein, 11 aa, Influenza virus
EEESRLNRNEI

SEQ ID NO: 413898 - protein, 11 aa, Influenza virus
ESRLNRNEIKG

SEQ ID NO: 413899 - protein, 11 aa, Influenza virus
LSLAIMIAGIF

SEQ ID NO: 413900 - protein, 11 aa, Influenza virus
AGIFLWMCSNG

SEQ ID NO: 413901 - protein, 11 aa, Influenza virus
GIFLWMCSNGS

SEQ ID NO: 413902 - protein, 11 aa, Influenza virus
IFLWMCSNGSL

SEQ ID NO: 413903 - protein, 11 aa, Influenza virus
FLWMCSNGSLQ

SEQ ID NO: 413904 - protein, 11 aa, Influenza virus
VKGDRICIGYH

SEQ ID NO: 413905 - protein, 11 aa, Influenza virus
RGDQICVGYHS

SEQ ID NO: 413906 - protein, 11 aa, Influenza virus
GDRICIGYHAN

SEQ ID NO: 413907 - protein, 11 aa, Influenza virus
DRICIGYHANN

SEQ ID NO: 413908 - protein, 11 aa, Influenza virus
RICIGYHANNS

SEQ ID NO: 413909 - protein, 11 aa, Influenza virus
VGYHSNNSTEK

SEQ ID NO: 413910 - protein, 11 aa, Influenza virus
KVDTNLERNVT

SEQ ID NO: 413911 - protein, 11 aa, Influenza virus
TVTHAQNILEK

SEQ ID NO: 413912 - protein, 11 aa, Influenza virus
VTHAKDILEKA

SEQ ID NO: 413913 - protein, 11 aa, Influenza virus
THAQDILERTH

SEQ ID NO: 413914 - protein, 11 aa, Influenza virus
HAQNILEKTHN

SEQ ID NO: 413915 - protein, 11 aa, Influenza virus
AKDILEKAHNG

SEQ ID NO: 413916 - protein, 11 aa, Influenza virus
DILEKAHNGKL

SEQ ID NO: 413917 - protein, 11 aa, Influenza virus
LERTHNGKLCK

SEQ ID NO: 413918 - protein, 11 aa, Influenza virus
EKTHNGRLCKL

SEQ ID NO: 413919 - protein, 11 aa, Influenza virus
KTHNGRLCKLN

SEQ ID NO: 413920 - protein, 11 aa, Influenza virus
AHNGKLCRLSG

SEQ ID NO: 413921 - protein, 11 aa, Influenza virus
LGNPECDRLLN

SEQ ID NO: 413922 - protein, 11 aa, Influenza virus
VPEWSYIIEKE

SEQ ID NO: 413923 - protein, 11 aa, Influenza virus
PEWSYIVEKEN

SEQ ID NO: 413924 - protein, 11 aa, Influenza virus
EWSYIVEKENP

SEQ ID NO: 413925 - protein, 11 aa, Influenza virus
LCYPGNFNDYE

SEQ ID NO: 413926 - protein, 11 aa, Influenza virus
CYPGSLNDYEE

SEQ ID NO: 413927 - protein, 11 aa, Influenza virus
YPGNFNDYEEL

SEQ ID NO: 413928 - protein, 11 aa, Influenza virus
PGNFNDYEELK

SEQ ID NO: 413929 - protein, 11 aa, Influenza virus
HFEKVKILARN

SEQ ID NO: 413930 - protein, 11 aa, Influenza virus
AKGSYNNTNGE

SEQ ID NO: 413931 - protein, 11 aa, Influenza virus
KGSYNNTNGEQ

SEQ ID NO: 413932 - protein, 11 aa, Influenza virus
GSYNNTSGKQM

SEQ ID NO: 413933 - protein, 11 aa, Influenza virus
YNNTSGEQVLV

SEQ ID NO: 413934 - protein, 11 aa, Influenza virus
NNTSGKQMLII

SEQ ID NO: 413935 - protein, 11 aa, Influenza virus
NTSGKQMLIIW

SEQ ID NO: 413936 - protein, 11 aa, Influenza virus
TSGKQMLIIWG

SEQ ID NO: 413937 - protein, 11 aa, Influenza virus
LDTINFESTGN

SEQ ID NO: 413938 - protein, 11 aa, Influenza virus
DTISFESTGNL

SEQ ID NO: 413939 - protein, 11 aa, Influenza virus
VISFESTGNLI

SEQ ID NO: 413940 - protein, 11 aa, Influenza virus
ISFESTGNLVA

SEQ ID NO: 413941 - protein, 11 aa, Influenza virus
SFESTGNLVAP

SEQ ID NO: 413942 - protein, 11 aa, Influenza virus
IAPEYGFKISR

SEQ ID NO: 413943 - protein, 11 aa, Influenza virus
FRISKRGSSGI

SEQ ID NO: 413944 - protein, 11 aa, Influenza virus
RISKRGSSGIM

SEQ ID NO: 413945 - protein, 11 aa, Influenza virus
KRGSSGVMKTE

SEQ ID NO: 413946 - protein, 11 aa, Influenza virus
NCDTKCQTPLG

SEQ ID NO: 413947 - protein, 11 aa, Influenza virus
CETQCQTPLGA

SEQ ID NO: 413948 - protein, 11 aa, Influenza virus
DTKCQTPLGAI

SEQ ID NO: 413949 - protein, 11 aa, Influenza virus
IKCQTPLGAIN

SEQ ID NO: 413950 - protein, 11 aa, Influenza virus
VHPLTIGECPR

SEQ ID NO: 413951 - protein, 11 aa, Influenza virus
LTIGECPRYVK

SEQ ID NO: 413952 - protein, 11 aa, Influenza virus
TIGECPRYVKS

SEQ ID NO: 413953 - protein, 11 aa, Influenza virus
MGECPKYVKSD

SEQ ID NO: 413954 - protein, 11 aa, Influenza virus
GECPKYVRSEK

SEQ ID NO: 413955 - protein, 11 aa, Influenza virus
ECPKYVRSEKL

SEQ ID NO: 413956 - protein, 11 aa, Influenza virus
CPKYVRSEKLV

SEQ ID NO: 413957 - protein, 11 aa, Influenza virus
PKYVRSEKLVL

SEQ ID NO: 413958 - protein, 11 aa, Influenza virus
KYVRSEKLVLA

SEQ ID NO: 413959 - protein, 11 aa, Influenza virus
YVRSEKLVLAT

SEQ ID NO: 413960 - protein, 11 aa, Influenza virus
VRSEKLVLATG

SEQ ID NO: 413961 - protein, 11 aa, Influenza virus
SEKLVLATGPR

SEQ ID NO: 413962 - protein, 11 aa, Influenza virus
EKLVLATGPRN

SEQ ID NO: 413963 - protein, 11 aa, Influenza virus
KLVLATGPRNV

SEQ ID NO: 413964 - protein, 11 aa, Influenza virus
LVLATGLRNAH

SEQ ID NO: 413965 - protein, 11 aa, Influenza virus
VLAIGLRNVPQ

SEQ ID NO: 413966 - protein, 11 aa, Influenza virus
LATGLRNVPQM

SEQ ID NO: 413967 - protein, 11 aa, Influenza virus
ATGPRNVPQIE

SEQ ID NO: 413968 - protein, 11 aa, Influenza virus
RNVPQIEPRGL

SEQ ID NO: 413969 - protein, 11 aa, Influenza virus
NVPQIEARGLF

SEQ ID NO: 413970 - protein, 11 aa, Influenza virus
VPQIEPRGLFG

SEQ ID NO: 413971 - protein, 11 aa, Influenza virus
HKMESRGLFGA

SEQ ID NO: 413972 - protein, 11 aa, Influenza virus
QIEPRGLFGAI

SEQ ID NO: 413973 - protein, 11 aa, Influenza virus
EQGSGYAADKE

SEQ ID NO: 413974 - protein, 11 aa, Influenza virus
AADKESTQRAF

SEQ ID NO: 413975 - protein, 11 aa, Influenza virus
KEFNNLEKRLE

SEQ ID NO: 413976 - protein, 11 aa, Influenza virus
EFNNLEKRLEN

SEQ ID NO: 413977 - protein, 11 aa, Influenza virus
FNNLEKRLENL

SEQ ID NO: 413978 - protein, 11 aa, Influenza virus
NLEKRLGNLNK

SEQ ID NO: 413979 - protein, 11 aa, Influenza virus
LEKRLENLDKK

SEQ ID NO: 413980 - protein, 11 aa, Influenza virus
RLENLSKRMED

SEQ ID NO: 413981 - protein, 11 aa, Influenza virus
LENLSKRMEDG

SEQ ID NO: 413982 - protein, 11 aa, Influenza virus
MEDGLLDVWTY

SEQ ID NO: 413983 - protein, 11 aa, Influenza virus
EDGLLDVWTYN

SEQ ID NO: 413984 - protein, 11 aa, Influenza virus
DGFRDVWTYNA

SEQ ID NO: 413985 - protein, 11 aa, Influenza virus
GFLGVWTYNAE

SEQ ID NO: 413986 - protein, 11 aa, Influenza virus
LLDVWTYNAEL

SEQ ID NO: 413987 - protein, 11 aa, Influenza virus
RDVWTYNAELL

SEQ ID NO: 413988 - protein, 11 aa, Influenza virus
NERTLGFHDSN

SEQ ID NO: 413989 - protein, 11 aa, Influenza virus
ERTLGFHDSNV

SEQ ID NO: 413990 - protein, 11 aa, Influenza virus
RTLDFHDSSVK

SEQ ID NO: 413991 - protein, 11 aa, Influenza virus
ILDFHDSNVKN

SEQ ID NO: 413992 - protein, 11 aa, Influenza virus
LDFHDSSVKNL

SEQ ID NO: 413993 - protein, 11 aa, Influenza virus
GFHDSNVKNLY

SEQ ID NO: 413994 - protein, 11 aa, Influenza virus
FHDSNVKNLYE

SEQ ID NO: 413995 - protein, 11 aa, Influenza virus
VKNLYEKVRMQ

SEQ ID NO: 413996 - protein, 11 aa, Influenza virus
KNLYEKVRMQL

SEQ ID NO: 413997 - protein, 11 aa, Influenza virus
NLYEKVRMQLR

SEQ ID NO: 413998 - protein, 11 aa, Influenza virus
LYDKVRMQLKD

SEQ ID NO: 413999 - protein, 11 aa, Influenza virus
YDRVRMQLRDN

SEQ ID NO: 414000 - protein, 11 aa, Influenza virus
EKVRMQLRDNV

SEQ ID NO: 414001 - protein, 11 aa, Influenza virus
QLKDNAKEIGN

SEQ ID NO: 414002 - protein, 11 aa, Influenza virus
LKDNAKEIGNG

SEQ ID NO: 414003 - protein, 11 aa, Influenza virus
RDNVKELGDGC

SEQ ID NO: 414004 - protein, 11 aa, Influenza virus
KNGTYDYSKYE

SEQ ID NO: 414005 - protein, 11 aa, Influenza virus
TGTYDYPKYEE

SEQ ID NO: 414006 - protein, 11 aa, Influenza virus
GTYDYPKYEKE

SEQ ID NO: 414007 - protein, 11 aa, Influenza virus
TYNYPKYEEES

SEQ ID NO: 414008 - protein, 11 aa, Influenza virus
YDYSKYEEESK

SEQ ID NO: 414009 - protein, 11 aa, Influenza virus
DYPKYEKESKL

SEQ ID NO: 414010 - protein, 11 aa, Influenza virus
YSKYEEESKLN

SEQ ID NO: 414011 - protein, 11 aa, Influenza virus
PKYEKESKLNR

SEQ ID NO: 414012 - protein, 11 aa, Influenza virus
KYEKESKLNRN

SEQ ID NO: 414013 - protein, 11 aa, Influenza virus
YEKESKLNRNE

SEQ ID NO: 414014 - protein, 11 aa, Influenza virus
EKESKLNRNEI

SEQ ID NO: 414015 - protein, 11 aa, Influenza virus
KESKLNRNEIK

SEQ ID NO: 414016 - protein, 11 aa, Influenza virus
SRLNRNEIKGI

SEQ ID NO: 414017 - protein, 11 aa, Influenza virus
KLKRNEIKGVE

SEQ ID NO: 414018 - protein, 11 aa, Influenza virus
LNKNEIKGVKL

SEQ ID NO: 414019 - protein, 11 aa, Influenza virus
NKNEIKGVKLS

SEQ ID NO: 414020 - protein, 11 aa, Influenza virus
RNEIKGIKLSN

SEQ ID NO: 414021 - protein, 11 aa, Influenza virus
IKGVKLSSMGI

SEQ ID NO: 414022 - protein, 11 aa, Influenza virus
KGVKLSSMGIY

SEQ ID NO: 414023 - protein, 11 aa, Influenza virus
GVKLSSMGIYQ

SEQ ID NO: 414024 - protein, 11 aa, Influenza virus
VKLSSMGIYQI

SEQ ID NO: 414025 - protein, 11 aa, Influenza virus
KLSSMGIYQIL

SEQ ID NO: 414026 - protein, 11 aa, Influenza virus
LSSMGIYQILA

SEQ ID NO: 414027 - protein, 11 aa, Influenza virus
SSMGIYQILAI

SEQ ID NO: 414028 - protein, 11 aa, Influenza virus
SMGIYQILAIY

SEQ ID NO: 414029 - protein, 11 aa, Influenza virus
LSLAIMIAGIF

SEQ ID NO: 414030 - protein, 11 aa, Influenza virus
AGIFFWMCSNG

SEQ ID NO: 414031 - protein, 11 aa, Influenza virus
GIFFWMCSNGS

SEQ ID NO: 414032 - protein, 11 aa, Influenza virus
IFFWMCSNGSL

SEQ ID NO: 414033 - protein, 11 aa, Influenza virus
FFWMCSNGSLQ

SEQ ID NO: 414034 - protein, 11 aa, Influenza virus
NPNQKIITIDS

SEQ ID NO: 414035 - protein, 11 aa, Influenza virus
NQKIITMGSVS

SEQ ID NO: 414036 - protein, 11 aa, Influenza virus
QKIITMGSVSL

SEQ ID NO: 414037 - protein, 11 aa, Influenza virus
QIAILATTITL

SEQ ID NO: 414038 - protein, 11 aa, Influenza virus
IAILAATVTLH

SEQ ID NO: 414039 - protein, 11 aa, Influenza virus
AILAATVTLHF

SEQ ID NO: 414040 - protein, 11 aa, Influenza virus
ILATTITLHFK

SEQ ID NO: 414041 - protein, 11 aa, Influenza virus
LATTITLHFKQ

SEQ ID NO: 414042 - protein, 11 aa, Influenza virus
ATTITLHFKQN

SEQ ID NO: 414043 - protein, 11 aa, Influenza virus
TVTLHFKQHDC

SEQ ID NO: 414044 - protein, 11 aa, Influenza virus
WSKPQCQIAGF

SEQ ID NO: 414045 - protein, 11 aa, Influenza virus
SKPQCQIAGFA

SEQ ID NO: 414046 - protein, 11 aa, Influenza virus
KPQCHITGFAP

SEQ ID NO: 414047 - protein, 11 aa, Influenza virus
PQCQIAGFAPF

SEQ ID NO: 414048 - protein, 11 aa, Influenza virus
IRLSGGGDIWV

SEQ ID NO: 414049 - protein, 11 aa, Influenza virus
RLSGGGDIWVT

SEQ ID NO: 414050 - protein, 11 aa, Influenza virus
LSADGDIWVTR

SEQ ID NO: 414051 - protein, 11 aa, Influenza virus
SAGGDIWVMRE

SEQ ID NO: 414052 - protein, 11 aa, Influenza virus
AGGDIWVMREP

SEQ ID NO: 414053 - protein, 11 aa, Influenza virus
DGDIWVTREPY

SEQ ID NO: 414054 - protein, 11 aa, Influenza virus
WVMREPYVSCN

SEQ ID NO: 414055 - protein, 11 aa, Influenza virus
NKCYQFALGQG

SEQ ID NO: 414056 - protein, 11 aa, Influenza virus
GTTLNNKHSNG

SEQ ID NO: 414057 - protein, 11 aa, Influenza virus
TTLENKHSNGT

SEQ ID NO: 414058 - protein, 11 aa, Influenza virus
TLNNKHSNGTI

SEQ ID NO: 414059 - protein, 11 aa, Influenza virus
LNNKHSNGTIH

SEQ ID NO: 414060 - protein, 11 aa, Influenza virus
NNKHSNGTIHD

SEQ ID NO: 414061 - protein, 11 aa, Influenza virus
NKHSNGTKHDR

SEQ ID NO: 414062 - protein, 11 aa, Influenza virus
TKHDRIPHRTL

SEQ ID NO: 414063 - protein, 11 aa, Influenza virus
IHDRSPHRTLL

SEQ ID NO: 414064 - protein, 11 aa, Influenza virus
FHLGTRQVCVA

SEQ ID NO: 414065 - protein, 11 aa, Influenza virus
HLGTRQVCVAW

SEQ ID NO: 414066 - protein, 11 aa, Influenza virus
LGTRQVCVAWS

SEQ ID NO: 414067 - protein, 11 aa, Influenza virus
GTRQVCVAWSS

SEQ ID NO: 414068 - protein, 11 aa, Influenza virus
TRQVCVAWSSS

SEQ ID NO: 414069 - protein, 11 aa, Influenza virus
RQVCVAWSSSS

SEQ ID NO: 414070 - protein, 11 aa, Influenza virus
HDGKAWLHICV

SEQ ID NO: 414071 - protein, 11 aa, Influenza virus
DGKAWLHICVT

SEQ ID NO: 414072 - protein, 11 aa, Influenza virus
GKAWLHICVTG

SEQ ID NO: 414073 - protein, 11 aa, Influenza virus
KAWLHICVTGD

SEQ ID NO: 414074 - protein, 11 aa, Influenza virus
AWLHVCVTGYE

SEQ ID NO: 414075 - protein, 11 aa, Influenza virus
CITGDDRNATA

SEQ ID NO: 414076 - protein, 11 aa, Influenza virus
ITGDDRNATAS

SEQ ID NO: 414077 - protein, 11 aa, Influenza virus
TGYEKNATASF

SEQ ID NO: 414078 - protein, 11 aa, Influenza virus
GYEKNATASFI

SEQ ID NO: 414079 - protein, 11 aa, Influenza virus
DDRNATASFVY

SEQ ID NO: 414080 - protein, 11 aa, Influenza virus
DSIGSWSHNIL

SEQ ID NO: 414081 - protein, 11 aa, Influenza virus
SIGSWSHNILR

SEQ ID NO: 414082 - protein, 11 aa, Influenza virus
VGSWSQNILRT

SEQ ID NO: 414083 - protein, 11 aa, Influenza virus
GSWSQNILRTH

SEQ ID NO: 414084 - protein, 11 aa, Influenza virus
QESECVCISGT

SEQ ID NO: 414085 - protein, 11 aa, Influenza virus
ESECVCISGTC

SEQ ID NO: 414086 - protein, 11 aa, Influenza virus
SECVCISGTCA

SEQ ID NO: 414087 - protein, 11 aa, Influenza virus
ECVCISGTCAV

SEQ ID NO: 414088 - protein, 11 aa, Influenza virus
CVCISGTCAVV

SEQ ID NO: 414089 - protein, 11 aa, Influenza virus
VCISGTCAVVM

SEQ ID NO: 414090 - protein, 11 aa, Influenza virus
CISGTCAVVMT

SEQ ID NO: 414091 - protein, 11 aa, Influenza virus
ISGTCAVVMTD

SEQ ID NO: 414092 - protein, 11 aa, Influenza virus
SGTCAVVMTDG

SEQ ID NO: 414093 - protein, 11 aa, Influenza virus
GTCAVVMTDGS

SEQ ID NO: 414094 - protein, 11 aa, Influenza virus
TCAVVMTDGSA

SEQ ID NO: 414095 - protein, 11 aa, Influenza virus
SGRADTKILFI

SEQ ID NO: 414096 - protein, 11 aa, Influenza virus
ADTKILFIEEG

SEQ ID NO: 414097 - protein, 11 aa, Influenza virus
DTKILFIEEGK

SEQ ID NO: 414098 - protein, 11 aa, Influenza virus
VHISPLAGSAQ

SEQ ID NO: 414099 - protein, 11 aa, Influenza virus
HVSPLSGSAQH

SEQ ID NO: 414100 - protein, 11 aa, Influenza virus
ISPLAGSAQHV

SEQ ID NO: 414101 - protein, 11 aa, Influenza virus
SPLAGSAQHVE

SEQ ID NO: 414102 - protein, 11 aa, Influenza virus
EECSCYPQYPD

SEQ ID NO: 414103 - protein, 11 aa, Influenza virus
ECSCYPQYPDV

SEQ ID NO: 414104 - protein, 11 aa, Influenza virus
CSCYSRYPNVR

SEQ ID NO: 414105 - protein, 11 aa, Influenza virus
SCYSRYPNVRC

SEQ ID NO: 414106 - protein, 11 aa, Influenza virus
YPDVRCVCRDN

SEQ ID NO: 414107 - protein, 11 aa, Influenza virus
PDVRCVCRDNW

SEQ ID NO: 414108 - protein, 11 aa, Influenza virus
VRCTCRDNWKG

SEQ ID NO: 414109 - protein, 11 aa, Influenza virus
RCTCRDNWKGS

SEQ ID NO: 414110 - protein, 11 aa, Influenza virus
CTCRDNWKGSN

SEQ ID NO: 414111 - protein, 11 aa, Influenza virus
ICKDNWKGSNR

SEQ ID NO: 414112 - protein, 11 aa, Influenza virus
DINIAEYSIDS

SEQ ID NO: 414113 - protein, 11 aa, Influenza virus
DYSIDSNYVCS

SEQ ID NO: 414114 - protein, 11 aa, Influenza virus
YSIDSNYVCSG

SEQ ID NO: 414115 - protein, 11 aa, Influenza virus
SIDSGYVCSGL

SEQ ID NO: 414116 - protein, 11 aa, Influenza virus
IDSNYVCSGLV

SEQ ID NO: 414117 - protein, 11 aa, Influenza virus
DSNYVCSGLVG

SEQ ID NO: 414118 - protein, 11 aa, Influenza virus
SNYVCSGLVGD

SEQ ID NO: 414119 - protein, 11 aa, Influenza virus
GYVCSGLVGDT

SEQ ID NO: 414120 - protein, 11 aa, Influenza virus
LVGDTPRSDDS

SEQ ID NO: 414121 - protein, 11 aa, Influenza virus
VGDTPRNDDRF

SEQ ID NO: 414122 - protein, 11 aa, Influenza virus
GDTPRNGDSSS

SEQ ID NO: 414123 - protein, 11 aa, Influenza virus
SNSNCKDPNNE

SEQ ID NO: 414124 - protein, 11 aa, Influenza virus
SNCKDPNNERG

SEQ ID NO: 414125 - protein, 11 aa, Influenza virus
PNNERGTQGVK

SEQ ID NO: 414126 - protein, 11 aa, Influenza virus
NNERGTQGVKG

SEQ ID NO: 414127 - protein, 11 aa, Influenza virus
NERGTQGVKGW

SEQ ID NO: 414128 - protein, 11 aa, Influenza virus
ERGTQGVKGWA

SEQ ID NO: 414129 - protein, 11 aa, Influenza virus
RGTQGVKGWAF

SEQ ID NO: 414130 - protein, 11 aa, Influenza virus
GNHGVKGWAFD

SEQ ID NO: 414131 - protein, 11 aa, Influenza virus
PGVKGWAFDDG

SEQ ID NO: 414132 - protein, 11 aa, Influenza virus
RDSRSGYETFK

SEQ ID NO: 414133 - protein, 11 aa, Influenza virus
ESRSGYETFKV

SEQ ID NO: 414134 - protein, 11 aa, Influenza virus
SRSGYETFRVT

SEQ ID NO: 414135 - protein, 11 aa, Influenza virus
YETFRVIGGWT

SEQ ID NO: 414136 - protein, 11 aa, Influenza virus
ETFRVIGGWTT

SEQ ID NO: 414137 - protein, 11 aa, Influenza virus
SNNRSGYSGIF

SEQ ID NO: 414138 - protein, 11 aa, Influenza virus
KNCINRCFYVE

SEQ ID NO: 414139 - protein, 11 aa, Influenza virus
SCVNRCFYVEL

SEQ ID NO: 414140 - protein, 11 aa, Influenza virus
CFYVELIRGRS

SEQ ID NO: 414141 - protein, 11 aa, Influenza virus
FYVELIRGRSQ

SEQ ID NO: 414142 - protein, 11 aa, Influenza virus
YVELIRGRSQE

SEQ ID NO: 414143 - protein, 11 aa, Influenza virus
KGSWPDGANIN

SEQ ID NO: 414144 - protein, 11 aa, Influenza virus
GSWPDGANIDF

SEQ ID NO: 414145 - protein, 11 aa, Influenza virus
SWPDGANIDFM

SEQ ID NO: 414146 - protein, 11 aa, Influenza virus
WPDGANIDFMP

SEQ ID NO: 414147 - protein, 11 aa, Influenza virus
PDGANIDFMPV

SEQ ID NO: 414148 - protein, 11 aa, Influenza virus
TAMLCLGHHAV

SEQ ID NO: 414149 - protein, 11 aa, Influenza virus
ATLCLGHHAVS

SEQ ID NO: 414150 - protein, 11 aa, Influenza virus
TLCLGHHAVSN

SEQ ID NO: 414151 - protein, 11 aa, Influenza virus
LCLGHHAVSNG

SEQ ID NO: 414152 - protein, 11 aa, Influenza virus
CLGHHAVSNGT

SEQ ID NO: 414153 - protein, 11 aa, Influenza virus
DRIEVTNATEL

SEQ ID NO: 414154 - protein, 11 aa, Influenza virus
RIEVTNATELV

SEQ ID NO: 414155 - protein, 11 aa, Influenza virus
EVTNATELVQG

SEQ ID NO: 414156 - protein, 11 aa, Influenza virus
CTLVDALLGDP

SEQ ID NO: 414157 - protein, 11 aa, Influenza virus
TLRSLVASSGN

SEQ ID NO: 414158 - protein, 11 aa, Influenza virus
LRSIVASSGTV

SEQ ID NO: 414159 - protein, 11 aa, Influenza virus
SDKLYIWGVHH

SEQ ID NO: 414160 - protein, 11 aa, Influenza virus
DKLYVWGIHHP

SEQ ID NO: 414161 - protein, 11 aa, Influenza virus
CTGNLIAPRGY

SEQ ID NO: 414162 - protein, 11 aa, Influenza virus
NGNLIAPRGYY

SEQ ID NO: 414163 - protein, 11 aa, Influenza virus
GCITPNGSIPN

SEQ ID NO: 414164 - protein, 11 aa, Influenza virus
CITPNGSIPNN

SEQ ID NO: 414165 - protein, 11 aa, Influenza virus
RPFQNVNKITY

SEQ ID NO: 414166 - protein, 11 aa, Influenza virus
LATGMRNVPET

SEQ ID NO: 414167 - protein, 11 aa, Influenza virus
FIENGWEGMVN

SEQ ID NO: 414168 - protein, 11 aa, Influenza virus
IENGWEGMVNG

SEQ ID NO: 414169 - protein, 11 aa, Influenza virus
ENGWEGMVNGW

SEQ ID NO: 414170 - protein, 11 aa, Influenza virus
NGWEGMVNGWY

SEQ ID NO: 414171 - protein, 11 aa, Influenza virus
GWEGMVNGWYG

SEQ ID NO: 414172 - protein, 11 aa, Influenza virus
WEGMVNGWYGF

SEQ ID NO: 414173 - protein, 11 aa, Influenza virus
EGMVNGWYGFR

SEQ ID NO: 414174 - protein, 11 aa, Influenza virus
GMVDGWYGFRY

SEQ ID NO: 414175 - protein, 11 aa, Influenza virus
DGWYGFRHLNS

SEQ ID NO: 414176 - protein, 11 aa, Influenza virus
GWYGFRHHNSE

SEQ ID NO: 414177 - protein, 11 aa, Influenza virus
WYGFRHLNSEG

SEQ ID NO: 414178 - protein, 11 aa, Influenza virus
NSEGMGQAADL

SEQ ID NO: 414179 - protein, 11 aa, Influenza virus
SEGMGQAADLK

SEQ ID NO: 414180 - protein, 11 aa, Influenza virus
EGMGQAADLKS

SEQ ID NO: 414181 - protein, 11 aa, Influenza virus
GMGQAADLKST

SEQ ID NO: 414182 - protein, 11 aa, Influenza virus
MGQAADLKSTQ

SEQ ID NO: 414183 - protein, 11 aa, Influenza virus
AADLKSTQAAV

SEQ ID NO: 414184 - protein, 11 aa, Influenza virus
DLKSTQAAVNQ

SEQ ID NO: 414185 - protein, 11 aa, Influenza virus
IKKTNEKFHQI

SEQ ID NO: 414186 - protein, 11 aa, Influenza virus
KKTNEKFHQIE

SEQ ID NO: 414187 - protein, 11 aa, Influenza virus
SEVEGRIQNLE

SEQ ID NO: 414188 - protein, 11 aa, Influenza virus
DLEKYIEDTKI

SEQ ID NO: 414189 - protein, 11 aa, Influenza virus
KIDLWSYNADV

SEQ ID NO: 414190 - protein, 11 aa, Influenza virus
IDLWSYNADVL

SEQ ID NO: 414191 - protein, 11 aa, Influenza virus
LWSYNAELLIA

SEQ ID NO: 414192 - protein, 11 aa, Influenza virus
WSYNAEFLVAL

SEQ ID NO: 414193 - protein, 11 aa, Influenza virus
SYNAEFLVALE

SEQ ID NO: 414194 - protein, 11 aa, Influenza virus
YNAEFLVALEN

SEQ ID NO: 414195 - protein, 11 aa, Influenza virus
NAEFLVALENQ

SEQ ID NO: 414196 - protein, 11 aa, Influenza virus
FLVALENQHTI

SEQ ID NO: 414197 - protein, 11 aa, Influenza virus
VALENQHTIDM

SEQ ID NO: 414198 - protein, 11 aa, Influenza virus
ALENQHTIDLA

SEQ ID NO: 414199 - protein, 11 aa, Influenza virus
LENQHTIDLAD

SEQ ID NO: 414200 - protein, 11 aa, Influenza virus
ENQHTIDLADS

SEQ ID NO: 414201 - protein, 11 aa, Influenza virus
NQHTIDLADSE

SEQ ID NO: 414202 - protein, 11 aa, Influenza virus
QHTIDLADSEM

SEQ ID NO: 414203 - protein, 11 aa, Influenza virus
TKRQLRENAED

SEQ ID NO: 414204 - protein, 11 aa, Influenza virus
RQLRENAEDIG

SEQ ID NO: 414205 - protein, 11 aa, Influenza virus
QLRENAEDIGN

SEQ ID NO: 414206 - protein, 11 aa, Influenza virus
LRENAEDIGNG

SEQ ID NO: 414207 - protein, 11 aa, Influenza virus
RENAEDIGNGC

SEQ ID NO: 414208 - protein, 11 aa, Influenza virus
ENAEDMGDGCF

SEQ ID NO: 414209 - protein, 11 aa, Influenza virus
GCFRIYHKCDN

SEQ ID NO: 414210 - protein, 11 aa, Influenza virus
GYKNWILWISF

SEQ ID NO: 414211 - protein, 11 aa, Influenza virus
KDWILWISFAM

SEQ ID NO: 414212 - protein, 11 aa, Influenza virus
DWILWISFAMS

SEQ ID NO: 414213 - protein, 11 aa, Influenza virus
WILWISFAMSC

SEQ ID NO: 414214 - protein, 11 aa, Influenza virus
ILWISFAMSCF

SEQ ID NO: 414215 - protein, 11 aa, Influenza virus
LWISFAISCLL

SEQ ID NO: 414216 - protein, 11 aa, Influenza virus
GFIMWTCQKGN

SEQ ID NO: 414217 - protein, 11 aa, Influenza virus
VWACQRGNIRC

SEQ ID NO: 414218 - protein, 11 aa, Influenza virus
WACQKGNIRCD

SEQ ID NO: 414219 - protein, 11 aa, Influenza virus
ACQKGNIRCDI

SEQ ID NO: 414220 - protein, 11 aa, Influenza virus
CQKGNIRCDIC

SEQ ID NO: 414221 - protein, 11 aa, Influenza virus
QKGNIRCDICI

SEQ ID NO: 414222 - protein, 11 aa, Influenza virus
TAMLCLGHHAV

SEQ ID NO: 414223 - protein, 11 aa, Influenza virus
LGHHAVPNGTM

SEQ ID NO: 414224 - protein, 11 aa, Influenza virus
HHAVPNGTIVR

SEQ ID NO: 414225 - protein, 11 aa, Influenza virus
HAVPNGTIVRT

SEQ ID NO: 414226 - protein, 11 aa, Influenza virus
AVPNGTIVRTI

SEQ ID NO: 414227 - protein, 11 aa, Influenza virus
VPNGTIVRTIT

SEQ ID NO: 414228 - protein, 11 aa, Influenza virus
DNIEVTNATEL

SEQ ID NO: 414229 - protein, 11 aa, Influenza virus
NIEVTNATELV

SEQ ID NO: 414230 - protein, 11 aa, Influenza virus
TLVDALLGDPH

SEQ ID NO: 414231 - protein, 11 aa, Influenza virus
LVDALLGDPHC

SEQ ID NO: 414232 - protein, 11 aa, Influenza virus
VDALLGDPHCD

SEQ ID NO: 414233 - protein, 11 aa, Influenza virus
TLRSLVASSGN

SEQ ID NO: 414234 - protein, 11 aa, Influenza virus
LRSLVASSGNL

SEQ ID NO: 414235 - protein, 11 aa, Influenza virus
RSLVASSGNLE

SEQ ID NO: 414236 - protein, 11 aa, Influenza virus
SLVASSGNLEF

SEQ ID NO: 414237 - protein, 11 aa, Influenza virus
FDKLYIWGIHH

SEQ ID NO: 414238 - protein, 11 aa, Influenza virus
SIYWTVVKPGD

SEQ ID NO: 414239 - protein, 11 aa, Influenza virus
NLIAPRGYYKM

SEQ ID NO: 414240 - protein, 11 aa, Influenza virus
GCITPNGSIPN

SEQ ID NO: 414241 - protein, 11 aa, Influenza virus
CITPNGSIPNG

SEQ ID NO: 414242 - protein, 11 aa, Influenza virus
TPNGSIPNGKP

SEQ ID NO: 414243 - protein, 11 aa, Influenza virus
NGSIPNNKPFQ

SEQ ID NO: 414244 - protein, 11 aa, Influenza virus
GSIPNNKPFQN

SEQ ID NO: 414245 - protein, 11 aa, Influenza virus
FQNVNRITYGV

SEQ ID NO: 414246 - protein, 11 aa, Influenza virus
QNVNRITYGVC

SEQ ID NO: 414247 - protein, 11 aa, Influenza virus
NVNRITYGVCP

SEQ ID NO: 414248 - protein, 11 aa, Influenza virus
YVKQKTLKLAT

SEQ ID NO: 414249 - protein, 11 aa, Influenza virus
VKQKTLKLATG

SEQ ID NO: 414250 - protein, 11 aa, Influenza virus
LATGMRNVPER

SEQ ID NO: 414251 - protein, 11 aa, Influenza virus
ATGMRNVPERQ

SEQ ID NO: 414252 - protein, 11 aa, Influenza virus
TGMRNIPEKQT

SEQ ID NO: 414253 - protein, 11 aa, Influenza virus
GMRNIPEKQTR

SEQ ID NO: 414254 - protein, 11 aa, Influenza virus
MRNIPEKQTRG

SEQ ID NO: 414255 - protein, 11 aa, Influenza virus
PERQTRGIFGA

SEQ ID NO: 414256 - protein, 11 aa, Influenza virus
ERQTRGIFGAI

SEQ ID NO: 414257 - protein, 11 aa, Influenza virus
RQTRGIFGAIA

SEQ ID NO: 414258 - protein, 11 aa, Influenza virus
FIENGWEGMVN

SEQ ID NO: 414259 - protein, 11 aa, Influenza virus
IENGWEGMVNG

SEQ ID NO: 414260 - protein, 11 aa, Influenza virus
ENGWEGMVNGW

SEQ ID NO: 414261 - protein, 11 aa, Influenza virus
NGWEGMVNGWY

SEQ ID NO: 414262 - protein, 11 aa, Influenza virus
GWEGMVNGWYG

SEQ ID NO: 414263 - protein, 11 aa, Influenza virus
WEGMVNGWYGF

SEQ ID NO: 414264 - protein, 11 aa, Influenza virus
EGMVNGWYGFR

SEQ ID NO: 414265 - protein, 11 aa, Influenza virus
GMVNGWYGFRH

SEQ ID NO: 414266 - protein, 11 aa, Influenza virus
MVNGWYGFRHQ

SEQ ID NO: 414267 - protein, 11 aa, Influenza virus
VNGWYGFRHQN

SEQ ID NO: 414268 - protein, 11 aa, Influenza virus
DGWYGFRHLNS

SEQ ID NO: 414269 - protein, 11 aa, Influenza virus
NSEGMGQAADL

SEQ ID NO: 414270 - protein, 11 aa, Influenza virus
SEGMGQAADLK

SEQ ID NO: 414271 - protein, 11 aa, Influenza virus
ADLKSTQAAIT

SEQ ID NO: 414272 - protein, 11 aa, Influenza virus
DFKSTQAAINQ

SEQ ID NO: 414273 - protein, 11 aa, Influenza virus
VEKTNEKFHQI

SEQ ID NO: 414274 - protein, 11 aa, Influenza virus
DLEKYIEDTKI

SEQ ID NO: 414275 - protein, 11 aa, Influenza virus
LEKYIEDTKID

SEQ ID NO: 414276 - protein, 11 aa, Influenza virus
WSYNAEILVAL

SEQ ID NO: 414277 - protein, 11 aa, Influenza virus
SYNAEILVALE

SEQ ID NO: 414278 - protein, 11 aa, Influenza virus
YNAEILVALEN

SEQ ID NO: 414279 - protein, 11 aa, Influenza virus
NAEILVALENQ

SEQ ID NO: 414280 - protein, 11 aa, Influenza virus
VLVALENQHTI

SEQ ID NO: 414281 - protein, 11 aa, Influenza virus
VALENQHTIDM

SEQ ID NO: 414282 - protein, 11 aa, Influenza virus
ALENQHTIDMT

SEQ ID NO: 414283 - protein, 11 aa, Influenza virus
NTIDLTDSEMN

SEQ ID NO: 414284 - protein, 11 aa, Influenza virus
TIDMTDSEMNK

SEQ ID NO: 414285 - protein, 11 aa, Influenza virus
IDLADSEMNKL

SEQ ID NO: 414286 - protein, 11 aa, Influenza virus
DMTDSEMNKLF

SEQ ID NO: 414287 - protein, 11 aa, Influenza virus
MTDSEMNKLFE

SEQ ID NO: 414288 - protein, 11 aa, Influenza virus
TDSEMSKLFEK

SEQ ID NO: 414289 - protein, 11 aa, Influenza virus
DSEMSKLFEKT

SEQ ID NO: 414290 - protein, 11 aa, Influenza virus
KQLRENAEEMG

SEQ ID NO: 414291 - protein, 11 aa, Influenza virus
NAEDMGNGCFR

SEQ ID NO: 414292 - protein, 11 aa, Influenza virus
AEDMGNGCFRI

SEQ ID NO: 414293 - protein, 11 aa, Influenza virus
EDMGNGCFRIY

SEQ ID NO: 414294 - protein, 11 aa, Influenza virus
MGNGCFRIYHK

SEQ ID NO: 414295 - protein, 11 aa, Influenza virus
NGCFKIYHKCN

SEQ ID NO: 414296 - protein, 11 aa, Influenza virus
GCFRIYHKCDN

SEQ ID NO: 414297 - protein, 11 aa, Influenza virus
IGSIRNGTYNH

SEQ ID NO: 414298 - protein, 11 aa, Influenza virus
YRDEALNNRSQ

SEQ ID NO: 414299 - protein, 11 aa, Influenza virus
GYKDWFLWISF

SEQ ID NO: 414300 - protein, 11 aa, Influenza virus
YKDWFLWISFA

SEQ ID NO: 414301 - protein, 11 aa, Influenza virus
KDWILWISFAM

SEQ ID NO: 414302 - protein, 11 aa, Influenza virus
WILWISFAMSC

SEQ ID NO: 414303 - protein, 11 aa, Influenza virus
ILWISFAMSCF

SEQ ID NO: 414304 - protein, 11 aa, Influenza virus
LWISFAISCLL

SEQ ID NO: 414305 - protein, 11 aa, Influenza virus
WISFAISCLLL

SEQ ID NO: 414306 - protein, 11 aa, Influenza virus
ISFAISCLLLC

SEQ ID NO: 414307 - protein, 11 aa, Influenza virus
LGFIVWACQRG

SEQ ID NO: 414308 - protein, 11 aa, Influenza virus
GFIVWACQRGN

SEQ ID NO: 414309 - protein, 11 aa, Influenza virus
FIVWACQRGNI

SEQ ID NO: 414310 - protein, 11 aa, Influenza virus
IVWACQRGNIR

SEQ ID NO: 414311 - protein, 11 aa, Influenza virus
VWACQRGNIRC

SEQ ID NO: 414312 - protein, 11 aa, Influenza virus
WACQKGNIRCD

SEQ ID NO: 414313 - protein, 11 aa, Influenza virus
ACQKGNIRCDI

SEQ ID NO: 414314 - protein, 11 aa, Influenza virus
CQKGNIRCDIC

SEQ ID NO: 414315 - protein, 11 aa, Influenza virus
QKGNIRCDICI

SEQ ID NO: 414316 - protein, 11 aa, Influenza virus
DNSIRLAAGGA

SEQ ID NO: 414317 - protein, 11 aa, Influenza virus
NSIRLAAGGAI

SEQ ID NO: 414318 - protein, 11 aa, Influenza virus
SIRLAAGGAIW

SEQ ID NO: 414319 - protein, 11 aa, Influenza virus
IRLAAGGAIWV

SEQ ID NO: 414320 - protein, 11 aa, Influenza virus
RLAAGGAIWVT

SEQ ID NO: 414321 - protein, 11 aa, Influenza virus
LAAGGAIWVTR

SEQ ID NO: 414322 - protein, 11 aa, Influenza virus
AAGGAIWVTRE

SEQ ID NO: 414323 - protein, 11 aa, Influenza virus
AGGDIWVTREH

SEQ ID NO: 414324 - protein, 11 aa, Influenza virus
GGDIWVTREHY

SEQ ID NO: 414325 - protein, 11 aa, Influenza virus
GDIWVTREHYV

SEQ ID NO: 414326 - protein, 11 aa, Influenza virus
DIWVTRVPYVS

SEQ ID NO: 414327 - protein, 11 aa, Influenza virus
WVTREPYVSCG

SEQ ID NO: 414328 - protein, 11 aa, Influenza virus
NKCYQFALGQG

SEQ ID NO: 414329 - protein, 11 aa, Influenza virus
PFHLGTKQVCM

SEQ ID NO: 414330 - protein, 11 aa, Influenza virus
FHLGTKQVCMA

SEQ ID NO: 414331 - protein, 11 aa, Influenza virus
HLGTKQVCMAW

SEQ ID NO: 414332 - protein, 11 aa, Influenza virus
DILRTQESECV

SEQ ID NO: 414333 - protein, 11 aa, Influenza virus
SECVCISGTCA

SEQ ID NO: 414334 - protein, 11 aa, Influenza virus
ECVCISGTCAV

SEQ ID NO: 414335 - protein, 11 aa, Influenza virus
CVCISGTCAVV

SEQ ID NO: 414336 - protein, 11 aa, Influenza virus
CINGTCTVIMT

SEQ ID NO: 414337 - protein, 11 aa, Influenza virus
INGTCTVIMTD

SEQ ID NO: 414338 - protein, 11 aa, Influenza virus
NGTCTVIMTDG

SEQ ID NO: 414339 - protein, 11 aa, Influenza virus
GTCTVIMTDGS

SEQ ID NO: 414340 - protein, 11 aa, Influenza virus
TCTVIMTDGSA

SEQ ID NO: 414341 - protein, 11 aa, Influenza virus
TVVMTDGSASD

SEQ ID NO: 414342 - protein, 11 aa, Influenza virus
LSGNAQHVEEC

SEQ ID NO: 414343 - protein, 11 aa, Influenza virus
SGNAQHVEECS

SEQ ID NO: 414344 - protein, 11 aa, Influenza virus
VEECSCYPRFP

SEQ ID NO: 414345 - protein, 11 aa, Influenza virus
EECSCYPRFPG

SEQ ID NO: 414346 - protein, 11 aa, Influenza virus
VRCVCRDNWRG

SEQ ID NO: 414347 - protein, 11 aa, Influenza virus
DNWKGSNRPII

SEQ ID NO: 414348 - protein, 11 aa, Influenza virus
NWKGSNRPIID

SEQ ID NO: 414349 - protein, 11 aa, Influenza virus
WKGSNRPIIDI

SEQ ID NO: 414350 - protein, 11 aa, Influenza virus
SSYLCSGLVGD

SEQ ID NO: 414351 - protein, 11 aa, Influenza virus
SYLCSGLVGDT

SEQ ID NO: 414352 - protein, 11 aa, Influenza virus
RSGYSGVFSVE

SEQ ID NO: 414353 - protein, 11 aa, Influenza virus
SGYSGVFSVEG

SEQ ID NO: 414354 - protein, 11 aa, Influenza virus
GYSGVFSVEGK

SEQ ID NO: 414355 - protein, 11 aa, Influenza virus
YGTGSWPDGAE

SEQ ID NO: 414356 - protein, 11 aa, Influenza virus
YIGNPVICMGH

SEQ ID NO: 414357 - protein, 11 aa, Influenza virus
TGNPVMCLGHH

SEQ ID NO: 414358 - protein, 11 aa, Influenza virus
ENPVICLGHHA

SEQ ID NO: 414359 - protein, 11 aa, Influenza virus
VEVVAAQELVE

SEQ ID NO: 414360 - protein, 11 aa, Influenza virus
EVITAQELVES

SEQ ID NO: 414361 - protein, 11 aa, Influenza virus
CDIVNAALGSP

SEQ ID NO: 414362 - protein, 11 aa, Influenza virus
DIVNAALGSPG

SEQ ID NO: 414363 - protein, 11 aa, Influenza virus
IVNAALGSPGC

SEQ ID NO: 414364 - protein, 11 aa, Influenza virus
VNAALGSPGCD

SEQ ID NO: 414365 - protein, 11 aa, Influenza virus
NAALGSPGCDH

SEQ ID NO: 414366 - protein, 11 aa, Influenza virus
AALGSPGCDHL

SEQ ID NO: 414367 - protein, 11 aa, Influenza virus
CYPFDVPGYQS

SEQ ID NO: 414368 - protein, 11 aa, Influenza virus
VPDYQSIRSIL

SEQ ID NO: 414369 - protein, 11 aa, Influenza virus
PDYQSIRSILA

SEQ ID NO: 414370 - protein, 11 aa, Influenza virus
NYQSLRSILAN

SEQ ID NO: 414371 - protein, 11 aa, Influenza virus
LANNGKLEFIA

SEQ ID NO: 414372 - protein, 11 aa, Influenza virus
ANNGKLEFIAE

SEQ ID NO: 414373 - protein, 11 aa, Influenza virus
NNGKFEFIVEK

SEQ ID NO: 414374 - protein, 11 aa, Influenza virus
NGKLEFIAEEF

SEQ ID NO: 414375 - protein, 11 aa, Influenza virus
TIKQNGKSGAC

SEQ ID NO: 414376 - protein, 11 aa, Influenza virus
IKQNGKSGACK

SEQ ID NO: 414377 - protein, 11 aa, Influenza virus
EQNGKSGACKR

SEQ ID NO: 414378 - protein, 11 aa, Influenza virus
NGKSGACKRAD

SEQ ID NO: 414379 - protein, 11 aa, Influenza virus
QNLTKVNNGNY

SEQ ID NO: 414380 - protein, 11 aa, Influenza virus
NNGNYARLYIW

SEQ ID NO: 414381 - protein, 11 aa, Influenza virus
NGNYARLYIWG

SEQ ID NO: 414382 - protein, 11 aa, Influenza virus
IWGVHHPSTST

SEQ ID NO: 414383 - protein, 11 aa, Influenza virus
VRGLSSRISFY

SEQ ID NO: 414384 - protein, 11 aa, Influenza virus
RGLSSRISFYW

SEQ ID NO: 414385 - protein, 11 aa, Influenza virus
GLSSRISFYWT

SEQ ID NO: 414386 - protein, 11 aa, Influenza virus
SRISFYWTIVE

SEQ ID NO: 414387 - protein, 11 aa, Influenza virus
RISVYWTIVEP

SEQ ID NO: 414388 - protein, 11 aa, Influenza virus
ISFYWTIVEPE

SEQ ID NO: 414389 - protein, 11 aa, Influenza virus
SFYWTIVEPED

SEQ ID NO: 414390 - protein, 11 aa, Influenza virus
PGNLIVFNTIG

SEQ ID NO: 414391 - protein, 11 aa, Influenza virus
GNLIVFNTIGN

SEQ ID NO: 414392 - protein, 11 aa, Influenza virus
NLIVFNTIGNL

SEQ ID NO: 414393 - protein, 11 aa, Influenza virus
LILFNTIGNLI

SEQ ID NO: 414394 - protein, 11 aa, Influenza virus
GDCPRYVKQGS

SEQ ID NO: 414395 - protein, 11 aa, Influenza virus
DCPRYVKQGSL

SEQ ID NO: 414396 - protein, 11 aa, Influenza virus
CPKYVKQGSLR

SEQ ID NO: 414397 - protein, 11 aa, Influenza virus
PKYVKQGSLRL

SEQ ID NO: 414398 - protein, 11 aa, Influenza virus
KYVKQGSLRLA

SEQ ID NO: 414399 - protein, 11 aa, Influenza virus
LKSTQAAINQI

SEQ ID NO: 414400 - protein, 11 aa, Influenza virus
TQAAINQINGK

SEQ ID NO: 414401 - protein, 11 aa, Influenza virus
QAAIDQISGKL

SEQ ID NO: 414402 - protein, 11 aa, Influenza virus
AAINQINGKLN

SEQ ID NO: 414403 - protein, 11 aa, Influenza virus
AIDQVNGKLNR

SEQ ID NO: 414404 - protein, 11 aa, Influenza virus
IDKINGKLNRL

SEQ ID NO: 414405 - protein, 11 aa, Influenza virus
DQVNGKLNRLI

SEQ ID NO: 414406 - protein, 11 aa, Influenza virus
KINGKLNRLIE

SEQ ID NO: 414407 - protein, 11 aa, Influenza virus
VNGKLNRLIEK

SEQ ID NO: 414408 - protein, 11 aa, Influenza virus
EFEQVEGRTQD

SEQ ID NO: 414409 - protein, 11 aa, Influenza virus
FEQVEGRIQYL

SEQ ID NO: 414410 - protein, 11 aa, Influenza virus
QDLEEYVEDTK

SEQ ID NO: 414411 - protein, 11 aa, Influenza virus
YLEKYVEDTKI

SEQ ID NO: 414412 - protein, 11 aa, Influenza virus
LEEYVEDTKID

SEQ ID NO: 414413 - protein, 11 aa, Influenza virus
EEYVEDTKIDL

SEQ ID NO: 414414 - protein, 11 aa, Influenza virus
HIIDVTDSEMN

SEQ ID NO: 414415 - protein, 11 aa, Influenza virus
TDSEMSKLFER

SEQ ID NO: 414416 - protein, 11 aa, Influenza virus
DSEMSKLFERV

SEQ ID NO: 414417 - protein, 11 aa, Influenza virus
RLFERVRRQLR

SEQ ID NO: 414418 - protein, 11 aa, Influenza virus
KRQLRENAEDK

SEQ ID NO: 414419 - protein, 11 aa, Influenza virus
RGNGCFEIFHK

SEQ ID NO: 414420 - protein, 11 aa, Influenza virus
GCFEIFHQCNN

SEQ ID NO: 414421 - protein, 11 aa, Influenza virus
CDNTCIESIRN

SEQ ID NO: 414422 - protein, 11 aa, Influenza virus
NTCIESIRNGT

SEQ ID NO: 414423 - protein, 11 aa, Influenza virus
TCIESIRNGTY

SEQ ID NO: 414424 - protein, 11 aa, Influenza virus
ESIRNGTYNHN

SEQ ID NO: 414425 - protein, 11 aa, Influenza virus
YRDEAINSRFQ

SEQ ID NO: 414426 - protein, 11 aa, Influenza virus
RDEAINSRFQI

SEQ ID NO: 414427 - protein, 11 aa, Influenza virus
DAINNRFQIQG

SEQ ID NO: 414428 - protein, 11 aa, Influenza virus
AINNRFQIQGI

SEQ ID NO: 414429 - protein, 11 aa, Influenza virus
RFQIQGVKLIQ

SEQ ID NO: 414430 - protein, 11 aa, Influenza virus
FQIQGVKLIQG

SEQ ID NO: 414431 - protein, 11 aa, Influenza virus
QIQGVKLIQGY

SEQ ID NO: 414432 - protein, 11 aa, Influenza virus
IQGVKLIQGYK

SEQ ID NO: 414433 - protein, 11 aa, Influenza virus
QGVKLIQGYKD

SEQ ID NO: 414434 - protein, 11 aa, Influenza virus
KLIQGYKDIIL

SEQ ID NO: 414435 - protein, 11 aa, Influenza virus
LTQGYKDVILW

SEQ ID NO: 414436 - protein, 11 aa, Influenza virus
KDVILWISFSI

SEQ ID NO: 414437 - protein, 11 aa, Influenza virus
DIILWISFSMS

SEQ ID NO: 414438 - protein, 11 aa, Influenza virus
IILWISFSMSC

SEQ ID NO: 414439 - protein, 11 aa, Influenza virus
VSFSISCFLLV

SEQ ID NO: 414440 - protein, 11 aa, Influenza virus
SISCFLLIALL

SEQ ID NO: 414441 - protein, 11 aa, Influenza virus
ISCFLLVALFL

SEQ ID NO: 414442 - protein, 11 aa, Influenza virus
ALLLAFMLWAC

SEQ ID NO: 414443 - protein, 11 aa, Influenza virus
LLLAFVLWACQ

SEQ ID NO: 414444 - protein, 11 aa, Influenza virus
LWACQTGNIRC

SEQ ID NO: 414445 - protein, 11 aa, Influenza virus
WACQTGNIRCQ

SEQ ID NO: 414446 - protein, 11 aa, Influenza virus
GDRICIGYHAN

SEQ ID NO: 414447 - protein, 11 aa, Influenza virus
DQICVGYHANN

SEQ ID NO: 414448 - protein, 11 aa, Influenza virus
QICVGYHANNS

SEQ ID NO: 414449 - protein, 11 aa, Influenza virus
CIGYHANNSTV

SEQ ID NO: 414450 - protein, 11 aa, Influenza virus
VDTIMEKNITV

SEQ ID NO: 414451 - protein, 11 aa, Influenza virus
IMEKNVAVTHA

SEQ ID NO: 414452 - protein, 11 aa, Influenza virus
EKNVTVTHAKD

SEQ ID NO: 414453 - protein, 11 aa, Influenza virus
SVSGWLLGNPM

SEQ ID NO: 414454 - protein, 11 aa, Influenza virus
VSGWLLGNPMC

SEQ ID NO: 414455 - protein, 11 aa, Influenza virus
GWLLGNPMCDA

SEQ ID NO: 414456 - protein, 11 aa, Influenza virus
WLLGNPTCDEF

SEQ ID NO: 414457 - protein, 11 aa, Influenza virus
FESNGNFITPE

SEQ ID NO: 414458 - protein, 11 aa, Influenza virus
DSNGNFIAPEY

SEQ ID NO: 414459 - protein, 11 aa, Influenza virus
SNGNFITPEYA

SEQ ID NO: 414460 - protein, 11 aa, Influenza virus
NGNFITPEYAY

SEQ ID NO: 414461 - protein, 11 aa, Influenza virus
GNFITPEYAYK

SEQ ID NO: 414462 - protein, 11 aa, Influenza virus
NFITPEYAYKI

SEQ ID NO: 414463 - protein, 11 aa, Influenza virus
PLHNIHPLTIG

SEQ ID NO: 414464 - protein, 11 aa, Influenza virus
HPLTIGKCPKY

SEQ ID NO: 414465 - protein, 11 aa, Influenza virus
AIGECPKYVKS

SEQ ID NO: 414466 - protein, 11 aa, Influenza virus
QGSGYAADRES

SEQ ID NO: 414467 - protein, 11 aa, Influenza virus
GSGYAADREST

SEQ ID NO: 414468 - protein, 11 aa, Influenza virus
GYAADKKSTQK

SEQ ID NO: 414469 - protein, 11 aa, Influenza virus
YAADKKSTQKA

SEQ ID NO: 414470 - protein, 11 aa, Influenza virus
DVWTYNAEILV

SEQ ID NO: 414471 - protein, 11 aa, Influenza virus
FHDSNVRNLYD

SEQ ID NO: 414472 - protein, 11 aa, Influenza virus
HDSNVKNLYDR

SEQ ID NO: 414473 - protein, 11 aa, Influenza virus
VRHQLRDNAKE

SEQ ID NO: 414474 - protein, 11 aa, Influenza virus
RHQLRDNAKEL

SEQ ID NO: 414475 - protein, 11 aa, Influenza virus
HQLRDNAKELG

SEQ ID NO: 414476 - protein, 11 aa, Influenza virus
QLRDNARELGN

SEQ ID NO: 414477 - protein, 11 aa, Influenza virus
GCFEFYHKCNN

SEQ ID NO: 414478 - protein, 11 aa, Influenza virus
LSIYSTVTSSL

SEQ ID NO: 414479 - protein, 11 aa, Influenza virus
LWMCSNGSYNA

SEQ ID NO: 414480 - protein, 11 aa, Influenza virus
MCFNGSLQCRI

SEQ ID NO: 414481 - protein, 11 aa, Influenza virus
FNGSLQCRICI

SEQ ID NO: 414482 - protein, 11 aa, Influenza virus
ICIKICESRLR

SEQ ID NO: 414483 - protein, 11 aa, Influenza virus
SDQICVGYHAN

SEQ ID NO: 414484 - protein, 11 aa, Influenza virus
CVGYHANNSTE

SEQ ID NO: 414485 - protein, 11 aa, Influenza virus
ANNSTERVDTI

SEQ ID NO: 414486 - protein, 11 aa, Influenza virus
NNSTERVDTIM

SEQ ID NO: 414487 - protein, 11 aa, Influenza virus
HVDTIMEKNVT

SEQ ID NO: 414488 - protein, 11 aa, Influenza virus
MEKNITVTHAQ

SEQ ID NO: 414489 - protein, 11 aa, Influenza virus
EKNVTVTHAKD

SEQ ID NO: 414490 - protein, 11 aa, Influenza virus
KNVTVTHAKDI

SEQ ID NO: 414491 - protein, 11 aa, Influenza virus
NITVTHAQDIL

SEQ ID NO: 414492 - protein, 11 aa, Influenza virus
ITVTHAQDILE

SEQ ID NO: 414493 - protein, 11 aa, Influenza virus
TVTHAKDILEK

SEQ ID NO: 414494 - protein, 11 aa, Influenza virus
RPLILKDCSVA

SEQ ID NO: 414495 - protein, 11 aa, Influenza virus
KVPEWSYIVEK

SEQ ID NO: 414496 - protein, 11 aa, Influenza virus
YEELKHLLNRI

SEQ ID NO: 414497 - protein, 11 aa, Influenza virus
TYVSIGTSTLN

SEQ ID NO: 414498 - protein, 11 aa, Influenza virus
VSVGTSTLNQR

SEQ ID NO: 414499 - protein, 11 aa, Influenza virus
SVGTSTLNQRS

SEQ ID NO: 414500 - protein, 11 aa, Influenza virus
NFDSNGNFIAP

SEQ ID NO: 414501 - protein, 11 aa, Influenza virus
ESNGNFITPEY

SEQ ID NO: 414502 - protein, 11 aa, Influenza virus
GNFITPEYAYK

SEQ ID NO: 414503 - protein, 11 aa, Influenza virus
NFITPEYAYKI

SEQ ID NO: 414504 - protein, 11 aa, Influenza virus
GAINTSMPFHN

SEQ ID NO: 414505 - protein, 11 aa, Influenza virus
AINSSMPLHNI

SEQ ID NO: 414506 - protein, 11 aa, Influenza virus
INSSMPLHNIH

SEQ ID NO: 414507 - protein, 11 aa, Influenza virus
SSSMPFHNIHP

SEQ ID NO: 414508 - protein, 11 aa, Influenza virus
SSMPFHNIHPF

SEQ ID NO: 414509 - protein, 11 aa, Influenza virus
SMPFHNIHPHT

SEQ ID NO: 414510 - protein, 11 aa, Influenza virus
LHNIHPLTIGE

SEQ ID NO: 414511 - protein, 11 aa, Influenza virus
IGECPKYVKST

SEQ ID NO: 414512 - protein, 11 aa, Influenza virus
MVDGWYGYHHN

SEQ ID NO: 414513 - protein, 11 aa, Influenza virus
VDGWYGYHHNN

SEQ ID NO: 414514 - protein, 11 aa, Influenza virus
HSKEQGSGYAA

SEQ ID NO: 414515 - protein, 11 aa, Influenza virus
SKEQGSGYAAD

SEQ ID NO: 414516 - protein, 11 aa, Influenza virus
NEQGSGYAADR

SEQ ID NO: 414517 - protein, 11 aa, Influenza virus
GSGYAADKESS

SEQ ID NO: 414518 - protein, 11 aa, Influenza virus
SGYAADKESSQ

SEQ ID NO: 414519 - protein, 11 aa, Influenza virus
GYAADRESTQK

SEQ ID NO: 414520 - protein, 11 aa, Influenza virus
YAADRESTQKA

SEQ ID NO: 414521 - protein, 11 aa, Influenza virus
STQKAINGVTN

SEQ ID NO: 414522 - protein, 11 aa, Influenza virus
TQKAINGVTNK

SEQ ID NO: 414523 - protein, 11 aa, Influenza virus
AIDGITNKINS

SEQ ID NO: 414524 - protein, 11 aa, Influenza virus
IDGITNKINSI

SEQ ID NO: 414525 - protein, 11 aa, Influenza virus
GVTNKVNSIIG

SEQ ID NO: 414526 - protein, 11 aa, Influenza virus
VTNKVNSIIGK

SEQ ID NO: 414527 - protein, 11 aa, Influenza virus
TNKINSIIDKM

SEQ ID NO: 414528 - protein, 11 aa, Influenza virus
NKVNSIIGKMN

SEQ ID NO: 414529 - protein, 11 aa, Influenza virus
KVNSIIGKMNT

SEQ ID NO: 414530 - protein, 11 aa, Influenza virus
INSIIDKMNTQ

SEQ ID NO: 414531 - protein, 11 aa, Influenza virus
SIIDKMNTRFE

SEQ ID NO: 414532 - protein, 11 aa, Influenza virus
IIDKMNTQFET

SEQ ID NO: 414533 - protein, 11 aa, Influenza virus
KMNIQFEAVGR

SEQ ID NO: 414534 - protein, 11 aa, Influenza virus
MNIQFEAVGRE

SEQ ID NO: 414535 - protein, 11 aa, Influenza virus
NTQFETVGKEF

SEQ ID NO: 414536 - protein, 11 aa, Influenza virus
LERRIENLNRK

SEQ ID NO: 414537 - protein, 11 aa, Influenza virus
ERRIENLNRKM

SEQ ID NO: 414538 - protein, 11 aa, Influenza virus
RRIENLNRKME

SEQ ID NO: 414539 - protein, 11 aa, Influenza virus
RVENLNKKMED

SEQ ID NO: 414540 - protein, 11 aa, Influenza virus
VENLNKKMEDG

SEQ ID NO: 414541 - protein, 11 aa, Influenza virus
NKKMEDGFLDI

SEQ ID NO: 414542 - protein, 11 aa, Influenza virus
HDSNVKNLYDR

SEQ ID NO: 414543 - protein, 11 aa, Influenza virus
DSNVKNLYDRV

SEQ ID NO: 414544 - protein, 11 aa, Influenza virus
SNVKNLYDRVR

SEQ ID NO: 414545 - protein, 11 aa, Influenza virus
NVKNLYDRVRL

SEQ ID NO: 414546 - protein, 11 aa, Influenza virus
VKNLYDRVRLQ

SEQ ID NO: 414547 - protein, 11 aa, Influenza virus
KNLYDRVRLQL

SEQ ID NO: 414548 - protein, 11 aa, Influenza virus
NLYDRVRLQLR

SEQ ID NO: 414549 - protein, 11 aa, Influenza virus
LYDRVRLQLRD

SEQ ID NO: 414550 - protein, 11 aa, Influenza virus
YDRVRLQLRDN

SEQ ID NO: 414551 - protein, 11 aa, Influenza virus
DRVRLQLRDNA

SEQ ID NO: 414552 - protein, 11 aa, Influenza virus
KIRLQLRDNAK

SEQ ID NO: 414553 - protein, 11 aa, Influenza virus
GCFEFYHKCNN

SEQ ID NO: 414554 - protein, 11 aa, Influenza virus
GVYQILSIYST

SEQ ID NO: 414555 - protein, 11 aa, Influenza virus
YQILSIYSTVT

SEQ ID NO: 414556 - protein, 11 aa, Influenza virus
QILSIYSTVTS

SEQ ID NO: 414557 - protein, 11 aa, Influenza virus
ILSIYSTVVSS

SEQ ID NO: 414558 - protein, 11 aa, Influenza virus
LSIYSTVTSSL

SEQ ID NO: 414559 - protein, 11 aa, Influenza virus
YSTVASSLTLA

SEQ ID NO: 414560 - protein, 11 aa, Influenza virus
STVASSLTLAI

SEQ ID NO: 414561 - protein, 11 aa, Influenza virus
AGLLLWMCSNG

SEQ ID NO: 414562 - protein, 11 aa, Influenza virus
GLLLWMCSNGS

SEQ ID NO: 414563 - protein, 11 aa, Influenza virus
LWMCSNGSYNA

SEQ ID NO: 414564 - protein, 11 aa, Influenza virus
MCFNGSLQCRI

SEQ ID NO: 414565 - protein, 11 aa, Influenza virus
CSNGSLQCKIC

SEQ ID NO: 414566 - protein, 11 aa, Influenza virus
FNGSLQCRICI

SEQ ID NO: 414567 - protein, 11 aa, Influenza virus
ICIKICESRLR

SEQ ID NO: 414568 - protein, 11 aa, Influenza virus
YENNTWGNQTY

SEQ ID NO: 414569 - protein, 11 aa, Influenza virus
HSKDNNIRIGS

SEQ ID NO: 414570 - protein, 11 aa, Influenza virus
SKDNNIRIGSK

SEQ ID NO: 414571 - protein, 11 aa, Influenza virus
KDNNIRIGSKG

SEQ ID NO: 414572 - protein, 11 aa, Influenza virus
DNNIRIGSKGD

SEQ ID NO: 414573 - protein, 11 aa, Influenza virus
NNIRIGSKGDV

SEQ ID NO: 414574 - protein, 11 aa, Influenza virus
NIRIGSKGDVF

SEQ ID NO: 414575 - protein, 11 aa, Influenza virus
IRIGSKGDVFA

SEQ ID NO: 414576 - protein, 11 aa, Influenza virus
EPFVSCSHLEC

SEQ ID NO: 414577 - protein, 11 aa, Influenza virus
PFVSCSHLECR

SEQ ID NO: 414578 - protein, 11 aa, Influenza virus
ISCSHSECRTF

SEQ ID NO: 414579 - protein, 11 aa, Influenza virus
SCSYLECRTFF

SEQ ID NO: 414580 - protein, 11 aa, Influenza virus
CSYLECRTFFL

SEQ ID NO: 414581 - protein, 11 aa, Influenza virus
SYLECRTFFLT

SEQ ID NO: 414582 - protein, 11 aa, Influenza virus
LECRTFFLTHG

SEQ ID NO: 414583 - protein, 11 aa, Influenza virus
ECKTFFLTQGA

SEQ ID NO: 414584 - protein, 11 aa, Influenza virus
ALLNDKHSNGS

SEQ ID NO: 414585 - protein, 11 aa, Influenza virus
LLNDKHSNGTA

SEQ ID NO: 414586 - protein, 11 aa, Influenza virus
HSNETVKDRSP

SEQ ID NO: 414587 - protein, 11 aa, Influenza virus
NDRSPHRTLMS

SEQ ID NO: 414588 - protein, 11 aa, Influenza virus
DRSPQRTLMSC

SEQ ID NO: 414589 - protein, 11 aa, Influenza virus
RSPQRTLMSCP

SEQ ID NO: 414590 - protein, 11 aa, Influenza virus
GVAPSPYNSRF

SEQ ID NO: 414591 - protein, 11 aa, Influenza virus
VAPSPYNSRFE

SEQ ID NO: 414592 - protein, 11 aa, Influenza virus
WSASACHDGSS

SEQ ID NO: 414593 - protein, 11 aa, Influenza virus
SASACHDGSSW

SEQ ID NO: 414594 - protein, 11 aa, Influenza virus
ASACHDGSSWL

SEQ ID NO: 414595 - protein, 11 aa, Influenza virus
GWLTIGISGPD

SEQ ID NO: 414596 - protein, 11 aa, Influenza virus
WLIIGISGPDN

SEQ ID NO: 414597 - protein, 11 aa, Influenza virus
IGVSGPDNGAV

SEQ ID NO: 414598 - protein, 11 aa, Influenza virus
GVSGPDNGAVA

SEQ ID NO: 414599 - protein, 11 aa, Influenza virus
VSGPDNGAVAV

SEQ ID NO: 414600 - protein, 11 aa, Influenza virus
SGPDNGAVAVV

SEQ ID NO: 414601 - protein, 11 aa, Influenza virus
GPDNGAVAVVK

SEQ ID NO: 414602 - protein, 11 aa, Influenza virus
PDNGAVAVVKY

SEQ ID NO: 414603 - protein, 11 aa, Influenza virus
VLRTQESECAC

SEQ ID NO: 414604 - protein, 11 aa, Influenza virus
TQESECVCVNG

SEQ ID NO: 414605 - protein, 11 aa, Influenza virus
GYCFTVMTDGP

SEQ ID NO: 414606 - protein, 11 aa, Influenza virus
ALNYHYEECSC

SEQ ID NO: 414607 - protein, 11 aa, Influenza virus
LNYHYEECSCY

SEQ ID NO: 414608 - protein, 11 aa, Influenza virus
YYEECSCYPDA

SEQ ID NO: 414609 - protein, 11 aa, Influenza virus
YEECSCYPNAG

SEQ ID NO: 414610 - protein, 11 aa, Influenza virus
TCVCRDSWHGS

SEQ ID NO: 414611 - protein, 11 aa, Influenza virus
HGSNRPWVSFD

SEQ ID NO: 414612 - protein, 11 aa, Influenza virus
GYICSGVFGDS

SEQ ID NO: 414613 - protein, 11 aa, Influenza virus
YICSGVFGDSP

SEQ ID NO: 414614 - protein, 11 aa, Influenza virus
ICSGVFGDSPR

SEQ ID NO: 414615 - protein, 11 aa, Influenza virus
CSGVFGDSPRP

SEQ ID NO: 414616 - protein, 11 aa, Influenza virus
FKYGNGAWIGR

SEQ ID NO: 414617 - protein, 11 aa, Influenza virus
KYGNGAWIGRT

SEQ ID NO: 414618 - protein, 11 aa, Influenza virus
GKGVWIGRTKS

SEQ ID NO: 414619 - protein, 11 aa, Influenza virus
SRRGFEMIWDP

SEQ ID NO: 414620 - protein, 11 aa, Influenza virus
RSGFEIIWDPN

SEQ ID NO: 414621 - protein, 11 aa, Influenza virus
SGFEIIWDPNG

SEQ ID NO: 414622 - protein, 11 aa, Influenza virus
ITEWSGYSGSF

SEQ ID NO: 414623 - protein, 11 aa, Influenza virus
SFVQHPELTGV

SEQ ID NO: 414624 - protein, 11 aa, Influenza virus
FVQHPEMTGLD

SEQ ID NO: 414625 - protein, 11 aa, Influenza virus
VQHPEMTGLDC

SEQ ID NO: 414626 - protein, 11 aa, Influenza virus
NCMRPCFWVEL

SEQ ID NO: 414627 - protein, 11 aa, Influenza virus
CIKPCFWVELI

SEQ ID NO: 414628 - protein, 11 aa, Influenza virus
IKPCFWVELIR

SEQ ID NO: 414629 - protein, 11 aa, Influenza virus
PCFWIELIRGR

SEQ ID NO: 414630 - protein, 11 aa, Influenza virus
CFWIELIRGRP

SEQ ID NO: 414631 - protein, 11 aa, Influenza virus
FWVELIRGRPE

SEQ ID NO: 414632 - protein, 11 aa, Influenza virus
WVELIRGRPEE

SEQ ID NO: 414633 - protein, 11 aa, Influenza virus
IWASGSSISFC

SEQ ID NO: 414634 - protein, 11 aa, Influenza virus
SGSIISFCGVN

SEQ ID NO: 414635 - protein, 11 aa, Influenza virus
WSWPDGAEVPF

SEQ ID NO: 414636 - protein, 11 aa, Influenza virus
DQICIGHHANN

SEQ ID NO: 414637 - protein, 11 aa, Influenza virus
RICVGYHANNS

SEQ ID NO: 414638 - protein, 11 aa, Influenza virus
ICVGYHANNST

SEQ ID NO: 414639 - protein, 11 aa, Influenza virus
CIGYHANNSKK

SEQ ID NO: 414640 - protein, 11 aa, Influenza virus
IGYHANNSKKQ

SEQ ID NO: 414641 - protein, 11 aa, Influenza virus
GYHANNSKKQI

SEQ ID NO: 414642 - protein, 11 aa, Influenza virus
HHANNSTEQVD

SEQ ID NO: 414643 - protein, 11 aa, Influenza virus
HANNSKKQIDT

SEQ ID NO: 414644 - protein, 11 aa, Influenza virus
ANNSKKQIDTI

SEQ ID NO: 414645 - protein, 11 aa, Influenza virus
DTIIEKNVTVT

SEQ ID NO: 414646 - protein, 11 aa, Influenza virus
PEWSYIVEKDK

SEQ ID NO: 414647 - protein, 11 aa, Influenza virus
SFYRNVVWLIK

SEQ ID NO: 414648 - protein, 11 aa, Influenza virus
FYRNVVWLIKK

SEQ ID NO: 414649 - protein, 11 aa, Influenza virus
YGNCDAKCQTP

SEQ ID NO: 414650 - protein, 11 aa, Influenza virus
ETKGLFGAIAG

SEQ ID NO: 414651 - protein, 11 aa, Influenza virus
VDGWYGYHHTN

SEQ ID NO: 414652 - protein, 11 aa, Influenza virus
GSGYAADKAST

SEQ ID NO: 414653 - protein, 11 aa, Influenza virus
SGYGEDNESTQ

SEQ ID NO: 414654 - protein, 11 aa, Influenza virus
GYAADRKSTQK

SEQ ID NO: 414655 - protein, 11 aa, Influenza virus
YAADRKSTQKA

SEQ ID NO: 414656 - protein, 11 aa, Influenza virus
WTYNTELLVLM

SEQ ID NO: 414657 - protein, 11 aa, Influenza virus
TYNTELLVLME

SEQ ID NO: 414658 - protein, 11 aa, Influenza virus
YNAELFVLMEN

SEQ ID NO: 414659 - protein, 11 aa, Influenza virus
NAELLVLIENE

SEQ ID NO: 414660 - protein, 11 aa, Influenza virus
ELLVLMENEIT

SEQ ID NO: 414661 - protein, 11 aa, Influenza virus
LLVLMENEITL

SEQ ID NO: 414662 - protein, 11 aa, Influenza virus
LVLIENERTLD

SEQ ID NO: 414663 - protein, 11 aa, Influenza virus
VLMENEITLDF

SEQ ID NO: 414664 - protein, 11 aa, Influenza virus
LIENERTLDLH

SEQ ID NO: 414665 - protein, 11 aa, Influenza virus
MENERILDFHD

SEQ ID NO: 414666 - protein, 11 aa, Influenza virus
VNERTLDFHDS

SEQ ID NO: 414667 - protein, 11 aa, Influenza virus
RTLYFHDSNVK

SEQ ID NO: 414668 - protein, 11 aa, Influenza virus
TLYFHDSNVKN

SEQ ID NO: 414669 - protein, 11 aa, Influenza virus
LYFHDSNVKNL

SEQ ID NO: 414670 - protein, 11 aa, Influenza virus
YFHDSNVKNLY

SEQ ID NO: 414671 - protein, 11 aa, Influenza virus
FHDSNVKNLYN

SEQ ID NO: 414672 - protein, 11 aa, Influenza virus
SNVKKLYDRVR

SEQ ID NO: 414673 - protein, 11 aa, Influenza virus
NNAKELGNGCF

SEQ ID NO: 414674 - protein, 11 aa, Influenza virus
NAKEWGNGCFE

SEQ ID NO: 414675 - protein, 11 aa, Influenza virus
AKEWGNGCFEF

SEQ ID NO: 414676 - protein, 11 aa, Influenza virus
KEWGNGCFEFY

SEQ ID NO: 414677 - protein, 11 aa, Influenza virus
WGNGCFEFYHK

SEQ ID NO: 414678 - protein, 11 aa, Influenza virus
VCMESVRNGTY

SEQ ID NO: 414679 - protein, 11 aa, Influenza virus
ILSVYSTVASS

SEQ ID NO: 414680 - protein, 11 aa, Influenza virus
LSVYSTVASSL

SEQ ID NO: 414681 - protein, 11 aa, Influenza virus
LAIMIAGLFFW

SEQ ID NO: 414682 - protein, 11 aa, Influenza virus
IAGLFFWMCSN

SEQ ID NO: 414683 - protein, 11 aa, Influenza virus
LSFWMCSNGPL

SEQ ID NO: 414684 - protein, 11 aa, Influenza virus
KPQCEITGFAP

SEQ ID NO: 414685 - protein, 11 aa, Influenza virus
PQCEITGFAPF

SEQ ID NO: 414686 - protein, 11 aa, Influenza virus
WVTREPYVSCG

SEQ ID NO: 414687 - protein, 11 aa, Influenza virus
SHRTLLMNELG

SEQ ID NO: 414688 - protein, 11 aa, Influenza virus
YRTLLMNELGV

SEQ ID NO: 414689 - protein, 11 aa, Influenza virus
LMTELGVPFHL

SEQ ID NO: 414690 - protein, 11 aa, Influenza virus
MNELGVPFHMG

SEQ ID NO: 414691 - protein, 11 aa, Influenza virus
TELGVPFHLGT

SEQ ID NO: 414692 - protein, 11 aa, Influenza virus
PFHLGTKQVCV

SEQ ID NO: 414693 - protein, 11 aa, Influenza virus
FHLGTKQVCVA

SEQ ID NO: 414694 - protein, 11 aa, Influenza virus
HLGTKQVCVAW

SEQ ID NO: 414695 - protein, 11 aa, Influenza virus
LGTKQVCVAWS

SEQ ID NO: 414696 - protein, 11 aa, Influenza virus
GTKQVCVAWSS

SEQ ID NO: 414697 - protein, 11 aa, Influenza virus
TKQVCVAWSSS

SEQ ID NO: 414698 - protein, 11 aa, Influenza virus
KQVCVAWSSSS

SEQ ID NO: 414699 - protein, 11 aa, Influenza virus
VCIAWSRSSCH

SEQ ID NO: 414700 - protein, 11 aa, Influenza virus
CIAWSRSSCHD

SEQ ID NO: 414701 - protein, 11 aa, Influenza virus
IAWSSSSCYDG

SEQ ID NO: 414702 - protein, 11 aa, Influenza virus
AWSSSSCYDGK

SEQ ID NO: 414703 - protein, 11 aa, Influenza virus
WSSSSCYDGKA

SEQ ID NO: 414704 - protein, 11 aa, Influenza virus
SSSSCYDGKAW

SEQ ID NO: 414705 - protein, 11 aa, Influenza virus
SSSCYDGKAWL

SEQ ID NO: 414706 - protein, 11 aa, Influenza virus
SSCYDGKAWLH

SEQ ID NO: 414707 - protein, 11 aa, Influenza virus
CHDGKAWLHIC

SEQ ID NO: 414708 - protein, 11 aa, Influenza virus
AWLHVCVTGHD

SEQ ID NO: 414709 - protein, 11 aa, Influenza virus
SSPQNILRTQE

SEQ ID NO: 414710 - protein, 11 aa, Influenza virus
SPQNILRTQES

SEQ ID NO: 414711 - protein, 11 aa, Influenza virus
RTQESECVCVN

SEQ ID NO: 414712 - protein, 11 aa, Influenza virus
CAVVMTDGNAS

SEQ ID NO: 414713 - protein, 11 aa, Influenza virus
SAQATEECSRY

SEQ ID NO: 414714 - protein, 11 aa, Influenza virus
VRCVCRDNWMG

SEQ ID NO: 414715 - protein, 11 aa, Influenza virus
TCVCRDNWKSS

SEQ ID NO: 414716 - protein, 11 aa, Influenza virus
RDNWKSSNRPV

SEQ ID NO: 414717 - protein, 11 aa, Influenza virus
SHYVCSGLVGD

SEQ ID NO: 414718 - protein, 11 aa, Influenza virus
HYVCSGLVGDT

SEQ ID NO: 414719 - protein, 11 aa, Influenza virus
LVGDTPRNDDI

SEQ ID NO: 414720 - protein, 11 aa, Influenza virus
SSSNCKDPNNE

SEQ ID NO: 414721 - protein, 11 aa, Influenza virus
GSPGVKGWAFD

SEQ ID NO: 414722 - protein, 11 aa, Influenza virus
KEDSRSGYETF

SEQ ID NO: 414723 - protein, 11 aa, Influenza virus
RDSRSGYETFR

SEQ ID NO: 414724 - protein, 11 aa, Influenza virus
SRSGYETFRVL

SEQ ID NO: 414725 - protein, 11 aa, Influenza virus
NRSGYSGIFSV

SEQ ID NO: 414726 - protein, 11 aa, Influenza virus
RSGYSGIFSVE

SEQ ID NO: 414727 - protein, 11 aa, Influenza virus
NCINRCFYVEL

SEQ ID NO: 414728 - protein, 11 aa, Influenza virus
RVWWTSNSIIV

SEQ ID NO: 414729 - protein, 11 aa, Influenza virus
WTSNSIVVFCA

SEQ ID NO: 414730 - protein, 11 aa, Influenza virus
TSNSIVVFCAT

SEQ ID NO: 414731 - protein, 11 aa, Influenza virus
WPDGADINFMP

SEQ ID NO: 414732 - protein, 11 aa, Influenza virus
RSHKICIGYHA

SEQ ID NO: 414733 - protein, 11 aa, Influenza virus
YHANNSTTQID

SEQ ID NO: 414734 - protein, 11 aa, Influenza virus
HANNSTTQIDT

SEQ ID NO: 414735 - protein, 11 aa, Influenza virus
ANNSTTQVNTI

SEQ ID NO: 414736 - protein, 11 aa, Influenza virus
VDTILEKNITV

SEQ ID NO: 414737 - protein, 11 aa, Influenza virus
DTILEKNITVT

SEQ ID NO: 414738 - protein, 11 aa, Influenza virus
TILEKNITVTH

SEQ ID NO: 414739 - protein, 11 aa, Influenza virus
ILEKNITVTHS

SEQ ID NO: 414740 - protein, 11 aa, Influenza virus
LEKNITVTHSV

SEQ ID NO: 414741 - protein, 11 aa, Influenza virus
EKNITVTHSVE

SEQ ID NO: 414742 - protein, 11 aa, Influenza virus
KNITVTHSVEL

SEQ ID NO: 414743 - protein, 11 aa, Influenza virus
TVTHSIELLES

SEQ ID NO: 414744 - protein, 11 aa, Influenza virus
LKPGETLNIES

SEQ ID NO: 414745 - protein, 11 aa, Influenza virus
KPGETLNIESN

SEQ ID NO: 414746 - protein, 11 aa, Influenza virus
TLNIESNGNLI

SEQ ID NO: 414747 - protein, 11 aa, Influenza virus
LNIESNGNLIA

SEQ ID NO: 414748 - protein, 11 aa, Influenza virus
NIESNGNLIAP

SEQ ID NO: 414749 - protein, 11 aa, Influenza virus
GNLIAPWYAFR

SEQ ID NO: 414750 - protein, 11 aa, Influenza virus
NKTFQNVSPIW

SEQ ID NO: 414751 - protein, 11 aa, Influenza virus
NLKLATGLRNV

SEQ ID NO: 414752 - protein, 11 aa, Influenza virus
RLATGLRNVPK

SEQ ID NO: 414753 - protein, 11 aa, Influenza virus
ARGLFGAIAGF

SEQ ID NO: 414754 - protein, 11 aa, Influenza virus
GYAADKESTQR

SEQ ID NO: 414755 - protein, 11 aa, Influenza virus
YAADKESTQRA

SEQ ID NO: 414756 - protein, 11 aa, Influenza virus
NGFLDVWTYNA

SEQ ID NO: 414757 - protein, 11 aa, Influenza virus
GLLDVWTYNAE

SEQ ID NO: 414758 - protein, 11 aa, Influenza virus
LLDVWTYNAEL

SEQ ID NO: 414759 - protein, 11 aa, Influenza virus
LGVWTYNAELL

SEQ ID NO: 414760 - protein, 11 aa, Influenza virus
GVWTYNAELLV

SEQ ID NO: 414761 - protein, 11 aa, Influenza virus
NAELLVLLEDE

SEQ ID NO: 414762 - protein, 11 aa, Influenza virus
AELLVLLEDER

SEQ ID NO: 414763 - protein, 11 aa, Influenza virus
ELLVLLEDERT

SEQ ID NO: 414764 - protein, 11 aa, Influenza virus
LLVLLEDERTL

SEQ ID NO: 414765 - protein, 11 aa, Influenza virus
LVLLEDERTLD

SEQ ID NO: 414766 - protein, 11 aa, Influenza virus
ENERTLDMHDV

SEQ ID NO: 414767 - protein, 11 aa, Influenza virus
NERTLDQHDAN

SEQ ID NO: 414768 - protein, 11 aa, Influenza virus
ERTLDQHDANV

SEQ ID NO: 414769 - protein, 11 aa, Influenza virus
LKDNANDLGNG

SEQ ID NO: 414770 - protein, 11 aa, Influenza virus
KDNANDLGNGC

SEQ ID NO: 414771 - protein, 11 aa, Influenza virus
CFEFWHKCNNE

SEQ ID NO: 414772 - protein, 11 aa, Influenza virus
FEFWHKCNNEC

SEQ ID NO: 414773 - protein, 11 aa, Influenza virus
GVYQILSIYST

SEQ ID NO: 414774 - protein, 11 aa, Influenza virus
VYQILAIYSTI

SEQ ID NO: 414775 - protein, 11 aa, Influenza virus
YSTVSSGLVLV

SEQ ID NO: 414776 - protein, 11 aa, Influenza virus
TISSSLVLVGL

SEQ ID NO: 414777 - protein, 11 aa, Influenza virus
VSSGLVLVGLI

SEQ ID NO: 414778 - protein, 11 aa, Influenza virus
WMCSNSSMQCR

SEQ ID NO: 414779 - protein, 11 aa, Influenza virus
KSRGYKMNIQI

SEQ ID NO: 414780 - protein, 11 aa, Influenza virus
SRGYKMNTKIL

SEQ ID NO: 414781 - protein, 11 aa, Influenza virus
LTERGVEVVDA

SEQ ID NO: 414782 - protein, 11 aa, Influenza virus
TERGVEVVDAT

SEQ ID NO: 414783 - protein, 11 aa, Influenza virus
ERGVEVVDATE

SEQ ID NO: 414784 - protein, 11 aa, Influenza virus
RGVEVVDATET

SEQ ID NO: 414785 - protein, 11 aa, Influenza virus
EVVDATETVER

SEQ ID NO: 414786 - protein, 11 aa, Influenza virus
GPPQCDKFLEF

SEQ ID NO: 414787 - protein, 11 aa, Influenza virus
FYAEMKWLLSD

SEQ ID NO: 414788 - protein, 11 aa, Influenza virus
FNGAFVAPDRV

SEQ ID NO: 414789 - protein, 11 aa, Influenza virus
NGAFVAPDRVS

SEQ ID NO: 414790 - protein, 11 aa, Influenza virus
GAFVAPDRVSF

SEQ ID NO: 414791 - protein, 11 aa, Influenza virus
SLLLATGMRNI

SEQ ID NO: 414792 - protein, 11 aa, Influenza virus
LLLATGMRNIP

SEQ ID NO: 414793 - protein, 11 aa, Influenza virus
LLATGMRNIPE

SEQ ID NO: 414794 - protein, 11 aa, Influenza virus
QMTRGLFGAIA

SEQ ID NO: 414795 - protein, 11 aa, Influenza virus
ARGLFGAIAGF

SEQ ID NO: 414796 - protein, 11 aa, Influenza virus
WEGLIDGWYGY

SEQ ID NO: 414797 - protein, 11 aa, Influenza virus
EGLIDGWYGYR

SEQ ID NO: 414798 - protein, 11 aa, Influenza virus
GLIDGWYGYRH

SEQ ID NO: 414799 - protein, 11 aa, Influenza virus
LIDGWYGYRHQ

SEQ ID NO: 414800 - protein, 11 aa, Influenza virus
IDGWYGYRHQN

SEQ ID NO: 414801 - protein, 11 aa, Influenza virus
GWYGFKHQNAQ

SEQ ID NO: 414802 - protein, 11 aa, Influenza virus
WYGFKHQNAQG

SEQ ID NO: 414803 - protein, 11 aa, Influenza virus
YGFKHQNAQGE

SEQ ID NO: 414804 - protein, 11 aa, Influenza virus
GFKHQNAQGEG

SEQ ID NO: 414805 - protein, 11 aa, Influenza virus
RHQNSQGEGTA

SEQ ID NO: 414806 - protein, 11 aa, Influenza virus
YKSTQSAVDQI

SEQ ID NO: 414807 - protein, 11 aa, Influenza virus
KSTQSAVDQIT

SEQ ID NO: 414808 - protein, 11 aa, Influenza virus
STQSAVDQITG

SEQ ID NO: 414809 - protein, 11 aa, Influenza virus
TQSAVDQITGK

SEQ ID NO: 414810 - protein, 11 aa, Influenza virus
QSAVDQITGKL

SEQ ID NO: 414811 - protein, 11 aa, Influenza virus
SAVDQITGKLN

SEQ ID NO: 414812 - protein, 11 aa, Influenza virus
AVDQITGKLNR

SEQ ID NO: 414813 - protein, 11 aa, Influenza virus
NQITGKLNRII

SEQ ID NO: 414814 - protein, 11 aa, Influenza virus
EKQLGNVINWT

SEQ ID NO: 414815 - protein, 11 aa, Influenza virus
LGNVINWTRDS

SEQ ID NO: 414816 - protein, 11 aa, Influenza virus
LLVALENQHTI

SEQ ID NO: 414817 - protein, 11 aa, Influenza virus
LVALENQHTID

SEQ ID NO: 414818 - protein, 11 aa, Influenza virus
VALENQHTIDL

SEQ ID NO: 414819 - protein, 11 aa, Influenza virus
ALENQHTIDLA

SEQ ID NO: 414820 - protein, 11 aa, Influenza virus
GNQHTIDLADS

SEQ ID NO: 414821 - protein, 11 aa, Influenza virus
QHTIDQADSEM

SEQ ID NO: 414822 - protein, 11 aa, Influenza virus
VKRQLRENAEE

SEQ ID NO: 414823 - protein, 11 aa, Influenza virus
KRQLRENAEED

SEQ ID NO: 414824 - protein, 11 aa, Influenza virus
CMASIRNSTYD

SEQ ID NO: 414825 - protein, 11 aa, Influenza virus
MASIRNNTYNH

SEQ ID NO: 414826 - protein, 11 aa, Influenza virus
GGYKDIILWFS

SEQ ID NO: 414827 - protein, 11 aa, Influenza virus
LWFSFGASCFT

SEQ ID NO: 414828 - protein, 11 aa, Influenza virus
WFSFGASCLIL

SEQ ID NO: 414829 - protein, 11 aa, Influenza virus
TKGDKICLGHH

SEQ ID NO: 414830 - protein, 11 aa, Influenza virus
TKINTLTERGV

SEQ ID NO: 414831 - protein, 11 aa, Influenza virus
KINTLTERGVE

SEQ ID NO: 414832 - protein, 11 aa, Influenza virus
INTLTERGVEV

SEQ ID NO: 414833 - protein, 11 aa, Influenza virus
VVNATETVETV

SEQ ID NO: 414834 - protein, 11 aa, Influenza virus
CGLLGILIGPP

SEQ ID NO: 414835 - protein, 11 aa, Influenza virus
IGPPHCDQFLE

SEQ ID NO: 414836 - protein, 11 aa, Influenza virus
DLIIERKEGTD

SEQ ID NO: 414837 - protein, 11 aa, Influenza virus
LRQILRKSGGI

SEQ ID NO: 414838 - protein, 11 aa, Influenza virus
GFIYSGIRTNG

SEQ ID NO: 414839 - protein, 11 aa, Influenza virus
RSSSSFYAEMK

SEQ ID NO: 414840 - protein, 11 aa, Influenza virus
SSSSFYAEMKW

SEQ ID NO: 414841 - protein, 11 aa, Influenza virus
YAEMKWLLSST

SEQ ID NO: 414842 - protein, 11 aa, Influenza virus
AEMKWLLSSTD

SEQ ID NO: 414843 - protein, 11 aa, Influenza virus
EMKWLLSSTDN

SEQ ID NO: 414844 - protein, 11 aa, Influenza virus
TKLYGNGNKLI

SEQ ID NO: 414845 - protein, 11 aa, Influenza virus
ARRIDFHWLFL

SEQ ID NO: 414846 - protein, 11 aa, Influenza virus
RRIDFNWLLLD

SEQ ID NO: 414847 - protein, 11 aa, Influenza virus
QFGRIDFHWLM

SEQ ID NO: 414848 - protein, 11 aa, Influenza virus
FGRIDFHWLML

SEQ ID NO: 414849 - protein, 11 aa, Influenza virus
GRIDFHWLILS

SEQ ID NO: 414850 - protein, 11 aa, Influenza virus
NDTVTFNFNGA

SEQ ID NO: 414851 - protein, 11 aa, Influenza virus
DTITFSFNGAF

SEQ ID NO: 414852 - protein, 11 aa, Influenza virus
TVTFNFNGAFI

SEQ ID NO: 414853 - protein, 11 aa, Influenza virus
ITFSFNGAFIA

SEQ ID NO: 414854 - protein, 11 aa, Influenza virus
FIFNGAFIAPD

SEQ ID NO: 414855 - protein, 11 aa, Influenza virus
IFNGAFIAPDR

SEQ ID NO: 414856 - protein, 11 aa, Influenza virus
FIAPDRASFFK

SEQ ID NO: 414857 - protein, 11 aa, Influenza virus
IAPDRASFFKG

SEQ ID NO: 414858 - protein, 11 aa, Influenza virus
WGTIVSSLPFQ

SEQ ID NO: 414859 - protein, 11 aa, Influenza virus
GTIISSLPFQN

SEQ ID NO: 414860 - protein, 11 aa, Influenza virus
TIISSLPFQNI

SEQ ID NO: 414861 - protein, 11 aa, Influenza virus
IISSLPFQNIN

SEQ ID NO: 414862 - protein, 11 aa, Influenza virus
TVGKCPRYIKQ

SEQ ID NO: 414863 - protein, 11 aa, Influenza virus
VKQESLMLATG

SEQ ID NO: 414864 - protein, 11 aa, Influenza virus
KQESLMLATGM

SEQ ID NO: 414865 - protein, 11 aa, Influenza virus
QESLMLATGMK

SEQ ID NO: 414866 - protein, 11 aa, Influenza virus
ESLMLATGMKN

SEQ ID NO: 414867 - protein, 11 aa, Influenza virus
SLMLATGMKNV

SEQ ID NO: 414868 - protein, 11 aa, Influenza virus
LMLATGMKNVP

SEQ ID NO: 414869 - protein, 11 aa, Influenza virus
MLATGMKNVPE

SEQ ID NO: 414870 - protein, 11 aa, Influenza virus
LATGMRNIPEN

SEQ ID NO: 414871 - protein, 11 aa, Influenza virus
ATGMRNIPENP

SEQ ID NO: 414872 - protein, 11 aa, Influenza virus
TGMRNIPENPK

SEQ ID NO: 414873 - protein, 11 aa, Influenza virus
PKGRGLFGAIA

SEQ ID NO: 414874 - protein, 11 aa, Influenza virus
KGRGLFGAIAG

SEQ ID NO: 414875 - protein, 11 aa, Influenza virus
GRGLFGAIAGF

SEQ ID NO: 414876 - protein, 11 aa, Influenza virus
QITGKLNRLIE

SEQ ID NO: 414877 - protein, 11 aa, Influenza virus
ITGKLNRLIEK

SEQ ID NO: 414878 - protein, 11 aa, Influenza virus
TGKLNRLIEKT

SEQ ID NO: 414879 - protein, 11 aa, Influenza virus
GKLNRLIEKTN

SEQ ID NO: 414880 - protein, 11 aa, Influenza virus
KLNRLIEKTNQ

SEQ ID NO: 414881 - protein, 11 aa, Influenza virus
LNRLIEKTNQQ

SEQ ID NO: 414882 - protein, 11 aa, Influenza virus
NRLISKTNQQF

SEQ ID NO: 414883 - protein, 11 aa, Influenza virus
LIEKTNQQFEL

SEQ ID NO: 414884 - protein, 11 aa, Influenza virus
IEKTNQQFELI

SEQ ID NO: 414885 - protein, 11 aa, Influenza virus
TNKQFELIDNE

SEQ ID NO: 414886 - protein, 11 aa, Influenza virus
NQQFELIGNEF

SEQ ID NO: 414887 - protein, 11 aa, Influenza virus
NEFSEIEQQIG

SEQ ID NO: 414888 - protein, 11 aa, Influenza virus
EFSEIEQQIGN

SEQ ID NO: 414889 - protein, 11 aa, Influenza virus
FSEIEQQIGNV

SEQ ID NO: 414890 - protein, 11 aa, Influenza virus
SEIEQQIGNVI

SEQ ID NO: 414891 - protein, 11 aa, Influenza virus
GNVINWTRDSI

SEQ ID NO: 414892 - protein, 11 aa, Influenza virus
NVINWTRDSIT

SEQ ID NO: 414893 - protein, 11 aa, Influenza virus
VINWTRDSITE

SEQ ID NO: 414894 - protein, 11 aa, Influenza virus
INWTRDAMTEV

SEQ ID NO: 414895 - protein, 11 aa, Influenza virus
NWTRDAMTEVW

SEQ ID NO: 414896 - protein, 11 aa, Influenza virus
WTRDAMTEVWS

SEQ ID NO: 414897 - protein, 11 aa, Influenza virus
TRDAMTEVWSY

SEQ ID NO: 414898 - protein, 11 aa, Influenza virus
RDAMTEVWSYN

SEQ ID NO: 414899 - protein, 11 aa, Influenza virus
DSITEVWSYNA

SEQ ID NO: 414900 - protein, 11 aa, Influenza virus
SITEVWSYNAE

SEQ ID NO: 414901 - protein, 11 aa, Influenza virus
AIENQHTIDLA

SEQ ID NO: 414902 - protein, 11 aa, Influenza virus
IENQHTIDLAD

SEQ ID NO: 414903 - protein, 11 aa, Influenza virus
IDLTDSEMNKL

SEQ ID NO: 414904 - protein, 11 aa, Influenza virus
DLTDSEMNKLY

SEQ ID NO: 414905 - protein, 11 aa, Influenza virus
DSEMSKLYGRV

SEQ ID NO: 414906 - protein, 11 aa, Influenza virus
SEMNKLYERVK

SEQ ID NO: 414907 - protein, 11 aa, Influenza virus
KLYERVKRQLR

SEQ ID NO: 414908 - protein, 11 aa, Influenza virus
LYERVKRQLRE

SEQ ID NO: 414909 - protein, 11 aa, Influenza virus
YERVKRQLREN

SEQ ID NO: 414910 - protein, 11 aa, Influenza virus
ERVKRQLRENA

SEQ ID NO: 414911 - protein, 11 aa, Influenza virus
RVKRQLRENAE

SEQ ID NO: 414912 - protein, 11 aa, Influenza virus
VKRQLRENAEE

SEQ ID NO: 414913 - protein, 11 aa, Influenza virus
KRQLRENAEED

SEQ ID NO: 414914 - protein, 11 aa, Influenza virus
CFEIFHKCDNQ

SEQ ID NO: 414915 - protein, 11 aa, Influenza virus
FEIFHKCDNQC

SEQ ID NO: 414916 - protein, 11 aa, Influenza virus
EIFHKCDNQCM

SEQ ID NO: 414917 - protein, 11 aa, Influenza virus
IFHKCDNQCME

SEQ ID NO: 414918 - protein, 11 aa, Influenza virus
FHKCDNQCMES

SEQ ID NO: 414919 - protein, 11 aa, Influenza virus
HKCDNQCMESI

SEQ ID NO: 414920 - protein, 11 aa, Influenza virus
KCDNQCMESIR

SEQ ID NO: 414921 - protein, 11 aa, Influenza virus
CDNQCMESIRN

SEQ ID NO: 414922 - protein, 11 aa, Influenza virus
DNQCMESIRNN

SEQ ID NO: 414923 - protein, 11 aa, Influenza virus
NQCMESIRNNT

SEQ ID NO: 414924 - protein, 11 aa, Influenza virus
SIRNNTYNHTQ

SEQ ID NO: 414925 - protein, 11 aa, Influenza virus
IRNNTYDHTKY

SEQ ID NO: 414926 - protein, 11 aa, Influenza virus
RNNTYNHTQYR

SEQ ID NO: 414927 - protein, 11 aa, Influenza virus
RYREEAMQNRI

SEQ ID NO: 414928 - protein, 11 aa, Influenza virus
AESLQNRIQID

SEQ ID NO: 414929 - protein, 11 aa, Influenza virus
ESLQNRIQIDQ

SEQ ID NO: 414930 - protein, 11 aa, Influenza virus
SLQNRIQIDQV

SEQ ID NO: 414931 - protein, 11 aa, Influenza virus
LQNRIQIDQVK

SEQ ID NO: 414932 - protein, 11 aa, Influenza virus
RIQIDPVKLSG

SEQ ID NO: 414933 - protein, 11 aa, Influenza virus
IQIDPVKLSGG

SEQ ID NO: 414934 - protein, 11 aa, Influenza virus
QIDPVKLSGGY

SEQ ID NO: 414935 - protein, 11 aa, Influenza virus
IDPVKLSGGYK

SEQ ID NO: 414936 - protein, 11 aa, Influenza virus
DPVKLSGGYKD

SEQ ID NO: 414937 - protein, 11 aa, Influenza virus
QVKLSSGYKDI

SEQ ID NO: 414938 - protein, 11 aa, Influenza virus
GASCFLLLAVV

SEQ ID NO: 414939 - protein, 11 aa, Influenza virus
AMGLVFICVKN

SEQ ID NO: 414940 - protein, 11 aa, Influenza virus
MGLVFICMKNG

SEQ ID NO: 414941 - protein, 11 aa, Influenza virus
GLVFICMKNGN

SEQ ID NO: 414942 - protein, 11 aa, Influenza virus
LVFICIKNGNV

SEQ ID NO: 414943 - protein, 11 aa, Influenza virus
VFICVKNGNMR

SEQ ID NO: 414944 - protein, 11 aa, Influenza virus
FMCVKNGNMRC

SEQ ID NO: 414945 - protein, 11 aa, Influenza virus
ICVKNGNMRCT

SEQ ID NO: 414946 - protein, 11 aa, Influenza virus
CIKNGNVRCTI

SEQ ID NO: 414947 - protein, 11 aa, Influenza virus
MKNGNMQCTIC

SEQ ID NO: 414948 - protein, 11 aa, Influenza virus
TIGSVSLIIAT

SEQ ID NO: 414949 - protein, 11 aa, Influenza virus
EKNITKIVYLN

SEQ ID NO: 414950 - protein, 11 aa, Influenza virus
NITEIVYLNST

SEQ ID NO: 414951 - protein, 11 aa, Influenza virus
YRIWSKPQCQI

SEQ ID NO: 414952 - protein, 11 aa, Influenza virus
DNSVRLSASGD

SEQ ID NO: 414953 - protein, 11 aa, Influenza virus
NSVRLSAGGDI

SEQ ID NO: 414954 - protein, 11 aa, Influenza virus
SVRLSAGGDIW

SEQ ID NO: 414955 - protein, 11 aa, Influenza virus
RLSASGDIWIT

SEQ ID NO: 414956 - protein, 11 aa, Influenza virus
LSASGDIWITR

SEQ ID NO: 414957 - protein, 11 aa, Influenza virus
SAGGNIWITRE

SEQ ID NO: 414958 - protein, 11 aa, Influenza virus
ASGDIWITREP

SEQ ID NO: 414959 - protein, 11 aa, Influenza virus
SGDIWITREPY

SEQ ID NO: 414960 - protein, 11 aa, Influenza virus
GNIWITREPYV

SEQ ID NO: 414961 - protein, 11 aa, Influenza virus
NIWITREPYVS

SEQ ID NO: 414962 - protein, 11 aa, Influenza virus
WVTREPYVSCG

SEQ ID NO: 414963 - protein, 11 aa, Influenza virus
DKCYQFALGQG

SEQ ID NO: 414964 - protein, 11 aa, Influenza virus
QFALGQGTTLN

SEQ ID NO: 414965 - protein, 11 aa, Influenza virus
FALGQGTTLNN

SEQ ID NO: 414966 - protein, 11 aa, Influenza virus
ALGQGTTLENK

SEQ ID NO: 414967 - protein, 11 aa, Influenza virus
LGQGTTLENKH

SEQ ID NO: 414968 - protein, 11 aa, Influenza virus
GQGTTLENKHS

SEQ ID NO: 414969 - protein, 11 aa, Influenza virus
QGTTLENKHSN

SEQ ID NO: 414970 - protein, 11 aa, Influenza virus
GTTLENKHSNG

SEQ ID NO: 414971 - protein, 11 aa, Influenza virus
TTLENKHSNGT

SEQ ID NO: 414972 - protein, 11 aa, Influenza virus
EHSNGTTHDRI

SEQ ID NO: 414973 - protein, 11 aa, Influenza virus
HDRISHRTLLM

SEQ ID NO: 414974 - protein, 11 aa, Influenza virus
DRISHRTLLMN

SEQ ID NO: 414975 - protein, 11 aa, Influenza virus
RISHRTLLMNE

SEQ ID NO: 414976 - protein, 11 aa, Influenza virus
ISHRTLLMNEL

SEQ ID NO: 414977 - protein, 11 aa, Influenza virus
WLHVCVTGDDK

SEQ ID NO: 414978 - protein, 11 aa, Influenza virus
LHVCVTGDDKN

SEQ ID NO: 414979 - protein, 11 aa, Influenza virus
HVCVTGDDKNA

SEQ ID NO: 414980 - protein, 11 aa, Influenza virus
ICVTGDDRNAT

SEQ ID NO: 414981 - protein, 11 aa, Influenza virus
SECVCINGTCA

SEQ ID NO: 414982 - protein, 11 aa, Influenza virus
ECVCINGTCAV

SEQ ID NO: 414983 - protein, 11 aa, Influenza virus
CVCINGTCAVV

SEQ ID NO: 414984 - protein, 11 aa, Influenza virus
VCINGTCAVVM

SEQ ID NO: 414985 - protein, 11 aa, Influenza virus
CINGTCAVVMT

SEQ ID NO: 414986 - protein, 11 aa, Influenza virus
INGTCAVVMTD

SEQ ID NO: 414987 - protein, 11 aa, Influenza virus
NGTCAVVMTDG

SEQ ID NO: 414988 - protein, 11 aa, Influenza virus
GSCAVVMTDGS

SEQ ID NO: 414989 - protein, 11 aa, Influenza virus
TCAVVMTDGSA

SEQ ID NO: 414990 - protein, 11 aa, Influenza virus
CIVVMTDGSAS

SEQ ID NO: 414991 - protein, 11 aa, Influenza virus
IVVMTDGSASG

SEQ ID NO: 414992 - protein, 11 aa, Influenza virus
VVMTDGSASRK

SEQ ID NO: 414993 - protein, 11 aa, Influenza virus
VMTDGSASRKA

SEQ ID NO: 414994 - protein, 11 aa, Influenza virus
MTDGSASGRAD

SEQ ID NO: 414995 - protein, 11 aa, Influenza virus
TDGSASGRADT

SEQ ID NO: 414996 - protein, 11 aa, Influenza virus
EGKISHISPLS

SEQ ID NO: 414997 - protein, 11 aa, Influenza virus
GKISHISPLSG

SEQ ID NO: 414998 - protein, 11 aa, Influenza virus
ISHISPLSGSA

SEQ ID NO: 414999 - protein, 11 aa, Influenza virus
SHISPLSGSAQ

SEQ ID NO: 415000 - protein, 11 aa, Influenza virus
WKGSNRPVVDI

SEQ ID NO: 415001 - protein, 11 aa, Influenza virus
KGSNRPVVDIN

SEQ ID NO: 415002 - protein, 11 aa, Influenza virus
GSNRPVVDINM

SEQ ID NO: 415003 - protein, 11 aa, Influenza virus
IDSSYLCSGLV

SEQ ID NO: 415004 - protein, 11 aa, Influenza virus
DSGYVCSGLVG

SEQ ID NO: 415005 - protein, 11 aa, Influenza virus
DTPRNEDSSSN

SEQ ID NO: 415006 - protein, 11 aa, Influenza virus
TPRNDDSSSNS

SEQ ID NO: 415007 - protein, 11 aa, Influenza virus
PRNDDSSSNSN

SEQ ID NO: 415008 - protein, 11 aa, Influenza virus
RNEDSSSNSNC

SEQ ID NO: 415009 - protein, 11 aa, Influenza virus
DPNNEKGNPGV

SEQ ID NO: 415010 - protein, 11 aa, Influenza virus
PNNEKGNPGVK

SEQ ID NO: 415011 - protein, 11 aa, Influenza virus
NNEKGNPGVKG

SEQ ID NO: 415012 - protein, 11 aa, Influenza virus
NEKGNPGVKGW

SEQ ID NO: 415013 - protein, 11 aa, Influenza virus
SPGVKGWAFDS

SEQ ID NO: 415014 - protein, 11 aa, Influenza virus
GVKGWAFDYGS

SEQ ID NO: 415015 - protein, 11 aa, Influenza virus
VKGWAFDYGSD

SEQ ID NO: 415016 - protein, 11 aa, Influenza virus
YGSDVWMGRTI

SEQ ID NO: 415017 - protein, 11 aa, Influenza virus
NDVWMGRTISK

SEQ ID NO: 415018 - protein, 11 aa, Influenza virus
RDSRSGYETFK

SEQ ID NO: 415019 - protein, 11 aa, Influenza virus
RSGYETFKVIG

SEQ ID NO: 415020 - protein, 11 aa, Influenza virus
SGYETFKVIGG

SEQ ID NO: 415021 - protein, 11 aa, Influenza virus
GYETFKVIGGW

SEQ ID NO: 415022 - protein, 11 aa, Influenza virus
YETFRVIDGWT

SEQ ID NO: 415023 - protein, 11 aa, Influenza virus
VISGWTTANSK

SEQ ID NO: 415024 - protein, 11 aa, Influenza virus
ISGWTTANSKS

SEQ ID NO: 415025 - protein, 11 aa, Influenza virus
VDNNSWSGYSG

SEQ ID NO: 415026 - protein, 11 aa, Influenza virus
NNSWSGYSGIF

SEQ ID NO: 415027 - protein, 11 aa, Influenza virus
NSWSGYSGIFS

SEQ ID NO: 415028 - protein, 11 aa, Influenza virus
SWSGYSGIFSV

SEQ ID NO: 415029 - protein, 11 aa, Influenza virus
KNCINRCFYVE

SEQ ID NO: 415030 - protein, 11 aa, Influenza virus
NCINRCFYVEL

SEQ ID NO: 415031 - protein, 11 aa, Influenza virus
PQETRVWWTSS

SEQ ID NO: 415032 - protein, 11 aa, Influenza virus
QEARVWWTSNS

SEQ ID NO: 415033 - protein, 11 aa, Influenza virus
ETRVWWTSSSI

SEQ ID NO: 415034 - protein, 11 aa, Influenza virus
GVWWTSNSIVV

SEQ ID NO: 415035 - protein, 11 aa, Influenza virus
NSIVVFCGTSA

SEQ ID NO: 415036 - protein, 11 aa, Influenza virus
SIVVFWGTSGT

SEQ ID NO: 415037 - protein, 11 aa, Influenza virus
LVVFCGTSGTY

SEQ ID NO: 415038 - protein, 11 aa, Influenza virus
GSWPDGANINL

SEQ ID NO: 415039 - protein, 11 aa, Influenza virus
SWPDGANINLM

SEQ ID NO: 415040 - protein, 11 aa, Influenza virus
RGYKMNTQILI

SEQ ID NO: 415041 - protein, 11 aa, Influenza virus
GYKMNTQILIF

SEQ ID NO: 415042 - protein, 11 aa, Influenza virus
YKMNTQILIFT

SEQ ID NO: 415043 - protein, 11 aa, Influenza virus
KMNTQILIFTL

SEQ ID NO: 415044 - protein, 11 aa, Influenza virus
DKICLGHHAVT

SEQ ID NO: 415045 - protein, 11 aa, Influenza virus
KICLGHHAVTN

SEQ ID NO: 415046 - protein, 11 aa, Influenza virus
ICLGHHAVTNG

SEQ ID NO: 415047 - protein, 11 aa, Influenza virus
CLGHHAVTNGT

SEQ ID NO: 415048 - protein, 11 aa, Influenza virus
LGHHAVANGTR

SEQ ID NO: 415049 - protein, 11 aa, Influenza virus
GHHAVANGTRV

SEQ ID NO: 415050 - protein, 11 aa, Influenza virus
VDTLTEKGIEV

SEQ ID NO: 415051 - protein, 11 aa, Influenza virus
TLTERGVEVVD

SEQ ID NO: 415052 - protein, 11 aa, Influenza virus
LTERGVEVVDA

SEQ ID NO: 415053 - protein, 11 aa, Influenza virus
TERGVEVVDAT

SEQ ID NO: 415054 - protein, 11 aa, Influenza virus
ERGVEVVDATE

SEQ ID NO: 415055 - protein, 11 aa, Influenza virus
RGVEVVDATET

SEQ ID NO: 415056 - protein, 11 aa, Influenza virus
EVVNATETVEQ

SEQ ID NO: 415057 - protein, 11 aa, Influenza virus
CGILGILTGPP

SEQ ID NO: 415058 - protein, 11 aa, Influenza virus
GILGILTGPPQ

SEQ ID NO: 415059 - protein, 11 aa, Influenza virus
ILGILTGPPQC

SEQ ID NO: 415060 - protein, 11 aa, Influenza virus
LGILTGPPQCD

SEQ ID NO: 415061 - protein, 11 aa, Influenza virus
IGPPQCDRFLE

SEQ ID NO: 415062 - protein, 11 aa, Influenza virus
LRQVLRESGGI

SEQ ID NO: 415063 - protein, 11 aa, Influenza virus
GSSSFYAEMKW

SEQ ID NO: 415064 - protein, 11 aa, Influenza virus
YAEMKWLLSNA

SEQ ID NO: 415065 - protein, 11 aa, Influenza virus
AEMKWLLSNAD

SEQ ID NO: 415066 - protein, 11 aa, Influenza virus
EMKWLLSNADN

SEQ ID NO: 415067 - protein, 11 aa, Influenza virus
PALIVWGVHHS

SEQ ID NO: 415068 - protein, 11 aa, Influenza virus
LYGSGNKLVTV

SEQ ID NO: 415069 - protein, 11 aa, Influenza virus
SPKYQQSFTPS

SEQ ID NO: 415070 - protein, 11 aa, Influenza virus
SKYLQSFTPSP

SEQ ID NO: 415071 - protein, 11 aa, Influenza virus
KYQQSFTPSPE

SEQ ID NO: 415072 - protein, 11 aa, Influenza virus
VDGQSGRIDFH

SEQ ID NO: 415073 - protein, 11 aa, Influenza virus
NGQSGRINFHW

SEQ ID NO: 415074 - protein, 11 aa, Influenza virus
GQSGRIDFHWM

SEQ ID NO: 415075 - protein, 11 aa, Influenza virus
GSFNGAFIAPD

SEQ ID NO: 415076 - protein, 11 aa, Influenza virus
SSNGAFIAPDR

SEQ ID NO: 415077 - protein, 11 aa, Influenza virus
NGAFVAPDRVS

SEQ ID NO: 415078 - protein, 11 aa, Influenza virus
GAFVAPDRVSF

SEQ ID NO: 415079 - protein, 11 aa, Influenza virus
GGTITSNLPFQ

SEQ ID NO: 415080 - protein, 11 aa, Influenza virus
GTITSNLPFQN

SEQ ID NO: 415081 - protein, 11 aa, Influenza virus
TITSNLPFQNV

SEQ ID NO: 415082 - protein, 11 aa, Influenza virus
ITSNLPFQNVN

SEQ ID NO: 415083 - protein, 11 aa, Influenza virus
LATGMRNVPEK

SEQ ID NO: 415084 - protein, 11 aa, Influenza virus
ATGMRNVPEKP

SEQ ID NO: 415085 - protein, 11 aa, Influenza virus
TGMRNVPEKPK

SEQ ID NO: 415086 - protein, 11 aa, Influenza virus
SPLSRCRKTRG

SEQ ID NO: 415087 - protein, 11 aa, Influenza virus
AYQKRMTRGLF

SEQ ID NO: 415088 - protein, 11 aa, Influenza virus
YQKRMTRGLFG

SEQ ID NO: 415089 - protein, 11 aa, Influenza virus
QKRMTRGLFGA

SEQ ID NO: 415090 - protein, 11 aa, Influenza virus
KQMTRGLFGAI

SEQ ID NO: 415091 - protein, 11 aa, Influenza virus
QMTRGLFGAIA

SEQ ID NO: 415092 - protein, 11 aa, Influenza virus
EGLIDGWYGFK

SEQ ID NO: 415093 - protein, 11 aa, Influenza virus
GLIDGWYGFKH

SEQ ID NO: 415094 - protein, 11 aa, Influenza virus
LIDGWYGFKHQ

SEQ ID NO: 415095 - protein, 11 aa, Influenza virus
IDGWYGFKHQN

SEQ ID NO: 415096 - protein, 11 aa, Influenza virus
ADYKSTPSAID

SEQ ID NO: 415097 - protein, 11 aa, Influenza virus
DYKSTPSAIDQ

SEQ ID NO: 415098 - protein, 11 aa, Influenza virus
YKSTPSAIDQI

SEQ ID NO: 415099 - protein, 11 aa, Influenza virus
KSTPSAIDQIT

SEQ ID NO: 415100 - protein, 11 aa, Influenza virus
STPSAIDQITG

SEQ ID NO: 415101 - protein, 11 aa, Influenza virus
TPSAIDQITGK

SEQ ID NO: 415102 - protein, 11 aa, Influenza virus
PSAIDQITGKL

SEQ ID NO: 415103 - protein, 11 aa, Influenza virus
VDQITGKLNRL

SEQ ID NO: 415104 - protein, 11 aa, Influenza virus
QITGKLNRFIE

SEQ ID NO: 415105 - protein, 11 aa, Influenza virus
ITGKLNRFIEK

SEQ ID NO: 415106 - protein, 11 aa, Influenza virus
TGKLNRLIDRT

SEQ ID NO: 415107 - protein, 11 aa, Influenza virus
GKLNRLIDRTN

SEQ ID NO: 415108 - protein, 11 aa, Influenza virus
KLNRFIEKTNQ

SEQ ID NO: 415109 - protein, 11 aa, Influenza virus
LNRFIEKTNQQ

SEQ ID NO: 415110 - protein, 11 aa, Influenza virus
NRLIDRTNHQF

SEQ ID NO: 415111 - protein, 11 aa, Influenza virus
IEKTNQQFKLI

SEQ ID NO: 415112 - protein, 11 aa, Influenza virus
EKTNQQFKLID

SEQ ID NO: 415113 - protein, 11 aa, Influenza virus
RTNHQFELIDN

SEQ ID NO: 415114 - protein, 11 aa, Influenza virus
TNHQFELIDNE

SEQ ID NO: 415115 - protein, 11 aa, Influenza virus
NHQFELIDNEF

SEQ ID NO: 415116 - protein, 11 aa, Influenza virus
GNVIDWTRDSV

SEQ ID NO: 415117 - protein, 11 aa, Influenza virus
NVINWTRDAMT

SEQ ID NO: 415118 - protein, 11 aa, Influenza virus
VIDWTRDSVTE

SEQ ID NO: 415119 - protein, 11 aa, Influenza virus
INWTRDSVTEL

SEQ ID NO: 415120 - protein, 11 aa, Influenza virus
WTRDSVTELWS

SEQ ID NO: 415121 - protein, 11 aa, Influenza virus
TRDSVTELWSY

SEQ ID NO: 415122 - protein, 11 aa, Influenza virus
RDSVTELWSYN

SEQ ID NO: 415123 - protein, 11 aa, Influenza virus
DSVTELWSYNA

SEQ ID NO: 415124 - protein, 11 aa, Influenza virus
SVTELWSYNAE

SEQ ID NO: 415125 - protein, 11 aa, Influenza virus
VTELWSYNAEL

SEQ ID NO: 415126 - protein, 11 aa, Influenza virus
EVWSYNAEFLV

SEQ ID NO: 415127 - protein, 11 aa, Influenza virus
VMVVYAELLVA

SEQ ID NO: 415128 - protein, 11 aa, Influenza virus
TIDQADSEMNK

SEQ ID NO: 415129 - protein, 11 aa, Influenza virus
IDLADSEMNNL

SEQ ID NO: 415130 - protein, 11 aa, Influenza virus
DLADSEMNNLY

SEQ ID NO: 415131 - protein, 11 aa, Influenza virus
ADSEMDKLYTR

SEQ ID NO: 415132 - protein, 11 aa, Influenza virus
DSEMDKLYTRV

SEQ ID NO: 415133 - protein, 11 aa, Influenza virus
NLYERVRKQLR

SEQ ID NO: 415134 - protein, 11 aa, Influenza virus
LYTRVKRQLRE

SEQ ID NO: 415135 - protein, 11 aa, Influenza virus
YERVKKQLREN

SEQ ID NO: 415136 - protein, 11 aa, Influenza virus
TRVKRQLRENA

SEQ ID NO: 415137 - protein, 11 aa, Influenza virus
VKKQLRENAEE

SEQ ID NO: 415138 - protein, 11 aa, Influenza virus
KRQLRENAEKD

SEQ ID NO: 415139 - protein, 11 aa, Influenza virus
ASIRNNTYDHT

SEQ ID NO: 415140 - protein, 11 aa, Influenza virus
QNRMQINPVKL

SEQ ID NO: 415141 - protein, 11 aa, Influenza virus
SGGYKDIILWF

SEQ ID NO: 415142 - protein, 11 aa, Influenza virus
GGYKDIILWFS

SEQ ID NO: 415143 - protein, 11 aa, Influenza virus
WFSFGASCFIF

SEQ ID NO: 415144 - protein, 11 aa, Influenza virus
FSFGASCFLFL

SEQ ID NO: 415145 - protein, 11 aa, Influenza virus
SFGASCFLFLA

SEQ ID NO: 415146 - protein, 11 aa, Influenza virus
FGASCFLFLAI

SEQ ID NO: 415147 - protein, 11 aa, Influenza virus
FICIKNGNMQC

SEQ ID NO: 415148 - protein, 11 aa, Influenza virus
ICIKDGNMRCT

SEQ ID NO: 415149 - protein, 11 aa, Influenza virus
GVVNTALSTIA

SEQ ID NO: 415150 - protein, 11 aa, Influenza virus
VVNTILSTKAL

SEQ ID NO: 415151 - protein, 11 aa, Influenza virus
VNTILSTKALL

SEQ ID NO: 415152 - protein, 11 aa, Influenza virus
NTALSTIALLI

SEQ ID NO: 415153 - protein, 11 aa, Influenza virus
TILSTKALLIG

SEQ ID NO: 415154 - protein, 11 aa, Influenza virus
LSTIALFIGVG

SEQ ID NO: 415155 - protein, 11 aa, Influenza virus
STIALFIGVGN

SEQ ID NO: 415156 - protein, 11 aa, Influenza virus
TIALFIGVGNL

SEQ ID NO: 415157 - protein, 11 aa, Influenza virus
IGIGNLIFNTV

SEQ ID NO: 415158 - protein, 11 aa, Influenza virus
GIGNLIFNTVI

SEQ ID NO: 415159 - protein, 11 aa, Influenza virus
IGNLAFNAVIH

SEQ ID NO: 415160 - protein, 11 aa, Influenza virus
GNLAFNAVIHG

SEQ ID NO: 415161 - protein, 11 aa, Influenza virus
TYNKTVINNIT

SEQ ID NO: 415162 - protein, 11 aa, Influenza virus
YNKTVINNITT

SEQ ID NO: 415163 - protein, 11 aa, Influenza virus
NKTVINNITTT

SEQ ID NO: 415164 - protein, 11 aa, Influenza virus
KTVINNITTTI

SEQ ID NO: 415165 - protein, 11 aa, Influenza virus
TVINNITTTIT

SEQ ID NO: 415166 - protein, 11 aa, Influenza virus
PLPLCPFKGFF

SEQ ID NO: 415167 - protein, 11 aa, Influenza virus
PVQGFFPFHKD

SEQ ID NO: 415168 - protein, 11 aa, Influenza virus
VQGFFPFHKDN

SEQ ID NO: 415169 - protein, 11 aa, Influenza virus
KGNSARLIHHT

SEQ ID NO: 415170 - protein, 11 aa, Influenza virus
VLVTREPYISC

SEQ ID NO: 415171 - protein, 11 aa, Influenza virus
IVTREPCVSCD

SEQ ID NO: 415172 - protein, 11 aa, Influenza virus
ITREPYVSCDN

SEQ ID NO: 415173 - protein, 11 aa, Influenza virus
GCWSFALAQGA

SEQ ID NO: 415174 - protein, 11 aa, Influenza virus
ALAQGALLGTR

SEQ ID NO: 415175 - protein, 11 aa, Influenza virus
LAQGALLGTRH

SEQ ID NO: 415176 - protein, 11 aa, Influenza virus
AQGALLGTRHS

SEQ ID NO: 415177 - protein, 11 aa, Influenza virus
QGALLGTRHSN

SEQ ID NO: 415178 - protein, 11 aa, Influenza virus
GALLGTRHSNG

SEQ ID NO: 415179 - protein, 11 aa, Influenza virus
ALLGTRHSNGT

SEQ ID NO: 415180 - protein, 11 aa, Influenza virus
DKTPYRSLIRF

SEQ ID NO: 415181 - protein, 11 aa, Influenza virus
KTPYRSLIRFP

SEQ ID NO: 415182 - protein, 11 aa, Influenza virus
TPYRSLIRFPV

SEQ ID NO: 415183 - protein, 11 aa, Influenza virus
SYRSLIRFPIG

SEQ ID NO: 415184 - protein, 11 aa, Influenza virus
YRSLIQFPIGT

SEQ ID NO: 415185 - protein, 11 aa, Influenza virus
RSLIQFPIGTA

SEQ ID NO: 415186 - protein, 11 aa, Influenza virus
SLIQFPIGTAP

SEQ ID NO: 415187 - protein, 11 aa, Influenza virus
FPIGTAPILGN

SEQ ID NO: 415188 - protein, 11 aa, Influenza virus
PIGTAPILGNY

SEQ ID NO: 415189 - protein, 11 aa, Influenza virus
GTAPILGNYKE

SEQ ID NO: 415190 - protein, 11 aa, Influenza virus
APVLGNYKEMC

SEQ ID NO: 415191 - protein, 11 aa, Influenza virus
LGNYKEIRIAW

SEQ ID NO: 415192 - protein, 11 aa, Influenza virus
GNYKEIRIAWS

SEQ ID NO: 415193 - protein, 11 aa, Influenza virus
NYKEMCAAWSS

SEQ ID NO: 415194 - protein, 11 aa, Influenza virus
EVCIAWSSSSC

SEQ ID NO: 415195 - protein, 11 aa, Influenza virus
MCAAWSSSSCF

SEQ ID NO: 415196 - protein, 11 aa, Influenza virus
RIAWSSSSCFD

SEQ ID NO: 415197 - protein, 11 aa, Influenza virus
FDGKEWMHVSM

SEQ ID NO: 415198 - protein, 11 aa, Influenza virus
DGKEWLHVCIT

SEQ ID NO: 415199 - protein, 11 aa, Influenza virus
GKEWMHVCMAG

SEQ ID NO: 415200 - protein, 11 aa, Influenza virus
GRMADSIKSWR

SEQ ID NO: 415201 - protein, 11 aa, Influenza virus
MADSIKSWRKD

SEQ ID NO: 415202 - protein, 11 aa, Influenza virus
SDSIKSWRKDI

SEQ ID NO: 415203 - protein, 11 aa, Influenza virus
RTQESECQRID

SEQ ID NO: 415204 - protein, 11 aa, Influenza virus
TQESECLCIDG

SEQ ID NO: 415205 - protein, 11 aa, Influenza virus
GTCIVAVTDGP

SEQ ID NO: 415206 - protein, 11 aa, Influenza virus
TCIVAVTDGPA

SEQ ID NO: 415207 - protein, 11 aa, Influenza virus
CVVSVTDGPAA

SEQ ID NO: 415208 - protein, 11 aa, Influenza virus
VVAVTDGPADN

SEQ ID NO: 415209 - protein, 11 aa, Influenza virus
VSVTDGPAANS

SEQ ID NO: 415210 - protein, 11 aa, Influenza virus
AVTDGPADNKA

SEQ ID NO: 415211 - protein, 11 aa, Influenza virus
GPADNKADHRI

SEQ ID NO: 415212 - protein, 11 aa, Influenza virus
PAANSAHHRVY

SEQ ID NO: 415213 - protein, 11 aa, Influenza virus
ADNKADHRIYW

SEQ ID NO: 415214 - protein, 11 aa, Influenza virus
ANNADHRVYWI

SEQ ID NO: 415215 - protein, 11 aa, Influenza virus
NNADHRVYWIR

SEQ ID NO: 415216 - protein, 11 aa, Influenza virus
KADHRIYWIKE

SEQ ID NO: 415217 - protein, 11 aa, Influenza virus
AHHRVYWIREG

SEQ ID NO: 415218 - protein, 11 aa, Influenza virus
KIRHLEECSCY

SEQ ID NO: 415219 - protein, 11 aa, Influenza virus
IRHLEECSCYV

SEQ ID NO: 415220 - protein, 11 aa, Influenza virus
RHLEECSCYVD

SEQ ID NO: 415221 - protein, 11 aa, Influenza virus
HLEECSCYVDT

SEQ ID NO: 415222 - protein, 11 aa, Influenza virus
LEECSCYVDVD

SEQ ID NO: 415223 - protein, 11 aa, Influenza virus
EECSCYVDTDV

SEQ ID NO: 415224 - protein, 11 aa, Influenza virus
ECSCYVDTDVY

SEQ ID NO: 415225 - protein, 11 aa, Influenza virus
CSCYVDVDVYC

SEQ ID NO: 415226 - protein, 11 aa, Influenza virus
DTDVYCICRDN

SEQ ID NO: 415227 - protein, 11 aa, Influenza virus
TDVYCICRDNW

SEQ ID NO: 415228 - protein, 11 aa, Influenza virus
KGSNRPWVRMN

SEQ ID NO: 415229 - protein, 11 aa, Influenza virus
GSNRPWVRMNN

SEQ ID NO: 415230 - protein, 11 aa, Influenza virus
SNRPWVRMNNE

SEQ ID NO: 415231 - protein, 11 aa, Influenza virus
NRPWVRMNNET

SEQ ID NO: 415232 - protein, 11 aa, Influenza virus
RPWVRINNETI

SEQ ID NO: 415233 - protein, 11 aa, Influenza virus
PWMRINNETIV

SEQ ID NO: 415234 - protein, 11 aa, Influenza virus
WVRINNETILE

SEQ ID NO: 415235 - protein, 11 aa, Influenza virus
MRINNETIVET

SEQ ID NO: 415236 - protein, 11 aa, Influenza virus
RMNNETILETG

SEQ ID NO: 415237 - protein, 11 aa, Influenza virus
MNNETILETGY

SEQ ID NO: 415238 - protein, 11 aa, Influenza virus
NNETILETGYI

SEQ ID NO: 415239 - protein, 11 aa, Influenza virus
SKFHSDTPRPT

SEQ ID NO: 415240 - protein, 11 aa, Influenza virus
KFHSDTPRPVD

SEQ ID NO: 415241 - protein, 11 aa, Influenza virus
FHSDTPRPVDP

SEQ ID NO: 415242 - protein, 11 aa, Influenza virus
HSDTPRPVDPS

SEQ ID NO: 415243 - protein, 11 aa, Influenza virus
DPSIMSCDSPS

SEQ ID NO: 415244 - protein, 11 aa, Influenza virus
PSIMSCDSPSN

SEQ ID NO: 415245 - protein, 11 aa, Influenza virus
SCDSPSNVKGG

SEQ ID NO: 415246 - protein, 11 aa, Influenza virus
KGGPGVKGFGF

SEQ ID NO: 415247 - protein, 11 aa, Influenza virus
SDVWLGRTVST

SEQ ID NO: 415248 - protein, 11 aa, Influenza virus
DVWLGRTVSIS

SEQ ID NO: 415249 - protein, 11 aa, Influenza virus
VWLGRTVSISG

SEQ ID NO: 415250 - protein, 11 aa, Influenza virus
WLGRTVSISGR

SEQ ID NO: 415251 - protein, 11 aa, Influenza virus
LGRTVSISGRS

SEQ ID NO: 415252 - protein, 11 aa, Influenza virus
DGWINSPNHAK

SEQ ID NO: 415253 - protein, 11 aa, Influenza virus
GWIDSPNHAKS

SEQ ID NO: 415254 - protein, 11 aa, Influenza virus
VKSVTQTLVSN

SEQ ID NO: 415255 - protein, 11 aa, Influenza virus
KSITQTLVSNS

SEQ ID NO: 415256 - protein, 11 aa, Influenza virus
SITQTLVSNDD

SEQ ID NO: 415257 - protein, 11 aa, Influenza virus
LTQTLVSNNDW

SEQ ID NO: 415258 - protein, 11 aa, Influenza virus
NDWSGYSGSFT

SEQ ID NO: 415259 - protein, 11 aa, Influenza virus
PCFYVELTRGV

SEQ ID NO: 415260 - protein, 11 aa, Influenza virus
CFYVELIRGRL

SEQ ID NO: 415261 - protein, 11 aa, Influenza virus
FYVELIRGRLN

SEQ ID NO: 415262 - protein, 11 aa, Influenza virus
DDVSWASNSIV

SEQ ID NO: 415263 - protein, 11 aa, Influenza virus
DVSWASNSIVT

SEQ ID NO: 415264 - protein, 11 aa, Influenza virus
MKSRGYKMNTQ

SEQ ID NO: 415265 - protein, 11 aa, Influenza virus
RGYKMNTQILI

SEQ ID NO: 415266 - protein, 11 aa, Influenza virus
GYKMNTKILVL

SEQ ID NO: 415267 - protein, 11 aa, Influenza virus
YKMNIQILILA

SEQ ID NO: 415268 - protein, 11 aa, Influenza virus
KMNTKILVLAL

SEQ ID NO: 415269 - protein, 11 aa, Influenza virus
ADKISLGHHAV

SEQ ID NO: 415270 - protein, 11 aa, Influenza virus
NGAKVNTLTER

SEQ ID NO: 415271 - protein, 11 aa, Influenza virus
KVNTLTEREVE

SEQ ID NO: 415272 - protein, 11 aa, Influenza virus
VNTLTEKGIEV

SEQ ID NO: 415273 - protein, 11 aa, Influenza virus
NTLTEKGIEVV

SEQ ID NO: 415274 - protein, 11 aa, Influenza virus
TLTEREVEVVN

SEQ ID NO: 415275 - protein, 11 aa, Influenza virus
LTEREVEVVNA

SEQ ID NO: 415276 - protein, 11 aa, Influenza virus
TEREVEVVNAT

SEQ ID NO: 415277 - protein, 11 aa, Influenza virus
EREVEVVNATE

SEQ ID NO: 415278 - protein, 11 aa, Influenza virus
REVEVVNATET

SEQ ID NO: 415279 - protein, 11 aa, Influenza virus
IGPPQCDLFLE

SEQ ID NO: 415280 - protein, 11 aa, Influenza virus
RFTYSGIRTNG

SEQ ID NO: 415281 - protein, 11 aa, Influenza virus
RSGPSFYAEMK

SEQ ID NO: 415282 - protein, 11 aa, Influenza virus
SESSFYAEMEW

SEQ ID NO: 415283 - protein, 11 aa, Influenza virus
ESSFYAEMEWL

SEQ ID NO: 415284 - protein, 11 aa, Influenza virus
FYAEMKWLLSD

SEQ ID NO: 415285 - protein, 11 aa, Influenza virus
RPPVNGQSGRI

SEQ ID NO: 415286 - protein, 11 aa, Influenza virus
PPVNGQSGRID

SEQ ID NO: 415287 - protein, 11 aa, Influenza virus
PVNGQSGRIDF

SEQ ID NO: 415288 - protein, 11 aa, Influenza virus
INGQSGRIDFH

SEQ ID NO: 415289 - protein, 11 aa, Influenza virus
NDTVNFSFNGA

SEQ ID NO: 415290 - protein, 11 aa, Influenza virus
DTVNFSFNGAF

SEQ ID NO: 415291 - protein, 11 aa, Influenza virus
NFSFNGAFIAP

SEQ ID NO: 415292 - protein, 11 aa, Influenza virus
NGAFVAPDRAS

SEQ ID NO: 415293 - protein, 11 aa, Influenza virus
GAFIAPDRAGF

SEQ ID NO: 415294 - protein, 11 aa, Influenza virus
KKKKKKRGLFG

SEQ ID NO: 415295 - protein, 11 aa, Influenza virus
KKRGLFGAIAG

SEQ ID NO: 415296 - protein, 11 aa, Influenza virus
EGLIDGWYGYK

SEQ ID NO: 415297 - protein, 11 aa, Influenza virus
GLIDGWYGYKH

SEQ ID NO: 415298 - protein, 11 aa, Influenza virus
LIDGWYGYKHQ

SEQ ID NO: 415299 - protein, 11 aa, Influenza virus
IDGWYGYKHQN

SEQ ID NO: 415300 - protein, 11 aa, Influenza virus
DGWYGYKHQNA

SEQ ID NO: 415301 - protein, 11 aa, Influenza virus
GWYGFRHQNSQ

SEQ ID NO: 415302 - protein, 11 aa, Influenza virus
WYGYKHQNAQG

SEQ ID NO: 415303 - protein, 11 aa, Influenza virus
YGFRHQNSQGE

SEQ ID NO: 415304 - protein, 11 aa, Influenza virus
GFRHQNSQGEG

SEQ ID NO: 415305 - protein, 11 aa, Influenza virus
RHQNAQGEGIA

SEQ ID NO: 415306 - protein, 11 aa, Influenza virus
STQSAVNQITG

SEQ ID NO: 415307 - protein, 11 aa, Influenza virus
TQAAIDQITGK

SEQ ID NO: 415308 - protein, 11 aa, Influenza virus
QSAVNQITGKL

SEQ ID NO: 415309 - protein, 11 aa, Influenza virus
AAIDQITGKLN

SEQ ID NO: 415310 - protein, 11 aa, Influenza virus
AVNQITGKLNR

SEQ ID NO: 415311 - protein, 11 aa, Influenza virus
VNQITGKLNRL

SEQ ID NO: 415312 - protein, 11 aa, Influenza virus
ITRKLNRLIEK

SEQ ID NO: 415313 - protein, 11 aa, Influenza virus
TRKLNRLIEKT

SEQ ID NO: 415314 - protein, 11 aa, Influenza virus
GTLNRLIDKTN

SEQ ID NO: 415315 - protein, 11 aa, Influenza virus
LIDKTNQQFEM

SEQ ID NO: 415316 - protein, 11 aa, Influenza virus
IDKTNQQFEMI

SEQ ID NO: 415317 - protein, 11 aa, Influenza virus
DKTNQQFEMID

SEQ ID NO: 415318 - protein, 11 aa, Influenza virus
QQFEMIDNEFN

SEQ ID NO: 415319 - protein, 11 aa, Influenza virus
QFEMIDNEFNE

SEQ ID NO: 415320 - protein, 11 aa, Influenza virus
EVERQIGNVIN

SEQ ID NO: 415321 - protein, 11 aa, Influenza virus
VERQIGNVINW

SEQ ID NO: 415322 - protein, 11 aa, Influenza virus
EKQLGNVINWT

SEQ ID NO: 415323 - protein, 11 aa, Influenza virus
KQLGNVINWTR

SEQ ID NO: 415324 - protein, 11 aa, Influenza virus
NVINWTRDSLT

SEQ ID NO: 415325 - protein, 11 aa, Influenza virus
VINWTRDSLTE

SEQ ID NO: 415326 - protein, 11 aa, Influenza virus
TEMWSYNAELL

SEQ ID NO: 415327 - protein, 11 aa, Influenza virus
WSYNADLLVAM

SEQ ID NO: 415328 - protein, 11 aa, Influenza virus
SYNADLLVAME

SEQ ID NO: 415329 - protein, 11 aa, Influenza virus
YNAELLIAMEN

SEQ ID NO: 415330 - protein, 11 aa, Influenza virus
NADLLVAMENQ

SEQ ID NO: 415331 - protein, 11 aa, Influenza virus
ADLLVAMENQH

SEQ ID NO: 415332 - protein, 11 aa, Influenza virus
ELLIAMENQHT

SEQ ID NO: 415333 - protein, 11 aa, Influenza virus
VAMENQHIIDL

SEQ ID NO: 415334 - protein, 11 aa, Influenza virus
AVENQHTIDST

SEQ ID NO: 415335 - protein, 11 aa, Influenza virus
ENQHIIDLADS

SEQ ID NO: 415336 - protein, 11 aa, Influenza virus
NQHIIDLADSE

SEQ ID NO: 415337 - protein, 11 aa, Influenza virus
QHIIDLADSEM

SEQ ID NO: 415338 - protein, 11 aa, Influenza virus
HIIDLADSEMN

SEQ ID NO: 415339 - protein, 11 aa, Influenza virus
TIDSTDSEMNK

SEQ ID NO: 415340 - protein, 11 aa, Influenza virus
IDLAESEMNKL

SEQ ID NO: 415341 - protein, 11 aa, Influenza virus
DSTDSEMNKLY

SEQ ID NO: 415342 - protein, 11 aa, Influenza virus
STDSEMNKLYE

SEQ ID NO: 415343 - protein, 11 aa, Influenza virus
AESEMNKLYER

SEQ ID NO: 415344 - protein, 11 aa, Influenza virus
EMNKLYERVRK

SEQ ID NO: 415345 - protein, 11 aa, Influenza virus
MNKLYERVRKQ

SEQ ID NO: 415346 - protein, 11 aa, Influenza virus
NKLYERVRKQL

SEQ ID NO: 415347 - protein, 11 aa, Influenza virus
KLYERVRKQLR

SEQ ID NO: 415348 - protein, 11 aa, Influenza virus
LYERVRKQLRE

SEQ ID NO: 415349 - protein, 11 aa, Influenza virus
YERVRKQLREN

SEQ ID NO: 415350 - protein, 11 aa, Influenza virus
ERVRKQLRENA

SEQ ID NO: 415351 - protein, 11 aa, Influenza virus
RVRKQLRENAE

SEQ ID NO: 415352 - protein, 11 aa, Influenza virus
LRENAEEDGTA

SEQ ID NO: 415353 - protein, 11 aa, Influenza virus
RENAEEDGTAC

SEQ ID NO: 415354 - protein, 11 aa, Influenza virus
AEEDGTGCFEL

SEQ ID NO: 415355 - protein, 11 aa, Influenza virus
EEDGTACFEIF

SEQ ID NO: 415356 - protein, 11 aa, Influenza virus
EDGTACFEIFH

SEQ ID NO: 415357 - protein, 11 aa, Influenza virus
DGTACFEIFHK

SEQ ID NO: 415358 - protein, 11 aa, Influenza virus
GTACFEIFHKC

SEQ ID NO: 415359 - protein, 11 aa, Influenza virus
CFELFHKCDDD

SEQ ID NO: 415360 - protein, 11 aa, Influenza virus
FELFHKCDDDC

SEQ ID NO: 415361 - protein, 11 aa, Influenza virus
ELFHKCDDDCM

SEQ ID NO: 415362 - protein, 11 aa, Influenza virus
CMASIRNNSYD

SEQ ID NO: 415363 - protein, 11 aa, Influenza virus
MGSIRNNTYDH

SEQ ID NO: 415364 - protein, 11 aa, Influenza virus
IRNNTYDHSTY

SEQ ID NO: 415365 - protein, 11 aa, Influenza virus
RNNTYDHSTYR

SEQ ID NO: 415366 - protein, 11 aa, Influenza virus
IDPVELSSGYK

SEQ ID NO: 415367 - protein, 11 aa, Influenza virus
VKLSSGYKEVI

SEQ ID NO: 415368 - protein, 11 aa, Influenza virus
LSGGYKDVILW

SEQ ID NO: 415369 - protein, 11 aa, Influenza virus
SSGYKEVILWF

SEQ ID NO: 415370 - protein, 11 aa, Influenza virus
GGYKDVILWFS

SEQ ID NO: 415371 - protein, 11 aa, Influenza virus
GYKDVILWFSL

SEQ ID NO: 415372 - protein, 11 aa, Influenza virus
YKDVILWFSLG

SEQ ID NO: 415373 - protein, 11 aa, Influenza virus
KEVILWFSFGA

SEQ ID NO: 415374 - protein, 11 aa, Influenza virus
EVILWFSFGAS

SEQ ID NO: 415375 - protein, 11 aa, Influenza virus
LWFSFGASCFT

SEQ ID NO: 415376 - protein, 11 aa, Influenza virus
WFSLGASCFLL

SEQ ID NO: 415377 - protein, 11 aa, Influenza virus
LAFICIKNGNM

SEQ ID NO: 415378 - protein, 11 aa, Influenza virus
FICVKNGNMQC

SEQ ID NO: 415379 - protein, 11 aa, Influenza virus
ICVKNGNMQCT

SEQ ID NO: 415380 - protein, 11 aa, Influenza virus
CVKNGNMRCTS

SEQ ID NO: 415381 - protein, 11 aa, Influenza virus
VKNGNHAVHYC

SEQ ID NO: 415382 - protein, 11 aa, Influenza virus
KNGNHAVHYCI

SEQ ID NO: 415383 - protein, 11 aa, Influenza virus
MNPNQKLFTLS

SEQ ID NO: 415384 - protein, 11 aa, Influenza virus
NPNQKLFTLSG

SEQ ID NO: 415385 - protein, 11 aa, Influenza virus
PNQKLFTLSGV

SEQ ID NO: 415386 - protein, 11 aa, Influenza virus
NQKLFTLSGVA

SEQ ID NO: 415387 - protein, 11 aa, Influenza virus
KLFTLSGVAIA

SEQ ID NO: 415388 - protein, 11 aa, Influenza virus
LFTLSGVAIAL

SEQ ID NO: 415389 - protein, 11 aa, Influenza virus
FTLSGVAIALS

SEQ ID NO: 415390 - protein, 11 aa, Influenza virus
ASSGIAIALGI

SEQ ID NO: 415391 - protein, 11 aa, Influenza virus
SSGIAIALGII

SEQ ID NO: 415392 - protein, 11 aa, Influenza virus
SGIAIALGIIN

SEQ ID NO: 415393 - protein, 11 aa, Influenza virus
GIAIALGIINL

SEQ ID NO: 415394 - protein, 11 aa, Influenza virus
IAIALGIINLL

SEQ ID NO: 415395 - protein, 11 aa, Influenza virus
AIALGIINLLI

SEQ ID NO: 415396 - protein, 11 aa, Influenza virus
IALGIINLLIG

SEQ ID NO: 415397 - protein, 11 aa, Influenza virus
ALGIINLLIGI

SEQ ID NO: 415398 - protein, 11 aa, Influenza virus
LSVLNLLIGVS

SEQ ID NO: 415399 - protein, 11 aa, Influenza virus
SVLNLLIGVSN

SEQ ID NO: 415400 - protein, 11 aa, Influenza virus
VLNLLIGVSNV

SEQ ID NO: 415401 - protein, 11 aa, Influenza virus
LNLLIGISNVV

SEQ ID NO: 415402 - protein, 11 aa, Influenza virus
NLLIGISNVVL

SEQ ID NO: 415403 - protein, 11 aa, Influenza virus
LLIGISNVVLN

SEQ ID NO: 415404 - protein, 11 aa, Influenza virus
SNIGLNVSLHL

SEQ ID NO: 415405 - protein, 11 aa, Influenza virus
ENKYVNNTTII

SEQ ID NO: 415406 - protein, 11 aa, Influenza virus
NYLLLNKSLCS

SEQ ID NO: 415407 - protein, 11 aa, Influenza virus
YLMLNKSLCKI

SEQ ID NO: 415408 - protein, 11 aa, Influenza virus
LMLNKSLCKIE

SEQ ID NO: 415409 - protein, 11 aa, Influenza virus
MLNKSLCKIEG

SEQ ID NO: 415410 - protein, 11 aa, Influenza virus
LNKSLCKIEGW

SEQ ID NO: 415411 - protein, 11 aa, Influenza virus
NKSLCKIEGWV

SEQ ID NO: 415412 - protein, 11 aa, Influenza virus
KSLCKIEGWVV

SEQ ID NO: 415413 - protein, 11 aa, Influenza virus
SLCSVEGWVVI

SEQ ID NO: 415414 - protein, 11 aa, Influenza virus
IEGWVVVAKDN

SEQ ID NO: 415415 - protein, 11 aa, Influenza virus
EGWVVIEKDNA

SEQ ID NO: 415416 - protein, 11 aa, Influenza virus
GWVVIAQDNAI

SEQ ID NO: 415417 - protein, 11 aa, Influenza virus
WVVIEKDNAVR

SEQ ID NO: 415418 - protein, 11 aa, Influenza virus
VVIEKDNAVRF

SEQ ID NO: 415419 - protein, 11 aa, Influenza virus
VIEKDNAVRFG

SEQ ID NO: 415420 - protein, 11 aa, Influenza virus
IAQDNAIRFGE

SEQ ID NO: 415421 - protein, 11 aa, Influenza virus
AQDNAIRFGES

SEQ ID NO: 415422 - protein, 11 aa, Influenza virus
AIRFGESEQIV

SEQ ID NO: 415423 - protein, 11 aa, Influenza virus
IRFGESEQIVV

SEQ ID NO: 415424 - protein, 11 aa, Influenza virus
TREPYVSCDPI

SEQ ID NO: 415425 - protein, 11 aa, Influenza virus
KHSNGTIHDRA

SEQ ID NO: 415426 - protein, 11 aa, Influenza virus
HSNGTIHDRTT

SEQ ID NO: 415427 - protein, 11 aa, Influenza virus
SNGTIHDRTTF

SEQ ID NO: 415428 - protein, 11 aa, Influenza virus
NGTIHDRTTFR

SEQ ID NO: 415429 - protein, 11 aa, Influenza virus
GTIHDRTTFRG

SEQ ID NO: 415430 - protein, 11 aa, Influenza virus
TIHDRAAFRGL

SEQ ID NO: 415431 - protein, 11 aa, Influenza virus
HDRAAFRGLIS

SEQ ID NO: 415432 - protein, 11 aa, Influenza virus
DRAAFRGLIST

SEQ ID NO: 415433 - protein, 11 aa, Influenza virus
SNSEFICVGWS

SEQ ID NO: 415434 - protein, 11 aa, Influenza virus
NSEFICVGWSS

SEQ ID NO: 415435 - protein, 11 aa, Influenza virus
SEFICVGWSST

SEQ ID NO: 415436 - protein, 11 aa, Influenza virus
DFICVGWSSTS

SEQ ID NO: 415437 - protein, 11 aa, Influenza virus
FICVGWSSTTC

SEQ ID NO: 415438 - protein, 11 aa, Influenza virus
ICVGWSSTTCH

SEQ ID NO: 415439 - protein, 11 aa, Influenza virus
GWSSTTCHDGV

SEQ ID NO: 415440 - protein, 11 aa, Influenza virus
CHDGIARMTIC

SEQ ID NO: 415441 - protein, 11 aa, Influenza virus
QGNNENATATV

SEQ ID NO: 415442 - protein, 11 aa, Influenza virus
GNNENATATVY

SEQ ID NO: 415443 - protein, 11 aa, Influenza virus
NNENATATVYY

SEQ ID NO: 415444 - protein, 11 aa, Influenza virus
NNNATATVYYD

SEQ ID NO: 415445 - protein, 11 aa, Influenza virus
NATATVYYNGR

SEQ ID NO: 415446 - protein, 11 aa, Influenza virus
ATATVYYNGRL

SEQ ID NO: 415447 - protein, 11 aa, Influenza virus
TATVYYNGRLT

SEQ ID NO: 415448 - protein, 11 aa, Influenza virus
ATVYYNGRLTT

SEQ ID NO: 415449 - protein, 11 aa, Influenza virus
TVYYNGRLTTT

SEQ ID NO: 415450 - protein, 11 aa, Influenza virus
VYYNGRLTTTI

SEQ ID NO: 415451 - protein, 11 aa, Influenza virus
RRLTTTVKTWA

SEQ ID NO: 415452 - protein, 11 aa, Influenza virus
RLTTTVKTWAG

SEQ ID NO: 415453 - protein, 11 aa, Influenza virus
LTTTVKTWAGN

SEQ ID NO: 415454 - protein, 11 aa, Influenza virus
TTTIRTWAKNI

SEQ ID NO: 415455 - protein, 11 aa, Influenza virus
TTIRTWAKNIL

SEQ ID NO: 415456 - protein, 11 aa, Influenza virus
TVKTWAGNILR

SEQ ID NO: 415457 - protein, 11 aa, Influenza virus
VKTWAGNILRT

SEQ ID NO: 415458 - protein, 11 aa, Influenza virus
RTWAKNILRTQ

SEQ ID NO: 415459 - protein, 11 aa, Influenza virus
TWARNILRTQD

SEQ ID NO: 415460 - protein, 11 aa, Influenza virus
WARNILRTQDS

SEQ ID NO: 415461 - protein, 11 aa, Influenza virus
ARNILRTQDSE

SEQ ID NO: 415462 - protein, 11 aa, Influenza virus
RNILRTQDSEC

SEQ ID NO: 415463 - protein, 11 aa, Influenza virus
TQESECVRHNG

SEQ ID NO: 415464 - protein, 11 aa, Influenza virus
QDSECVSHNGT

SEQ ID NO: 415465 - protein, 11 aa, Influenza virus
DSECVSHNGTW

SEQ ID NO: 415466 - protein, 11 aa, Influenza virus
SECVSHNGTWA

SEQ ID NO: 415467 - protein, 11 aa, Influenza virus
ECVSHNGTWAV

SEQ ID NO: 415468 - protein, 11 aa, Influenza virus
HNGTCVVVMTD

SEQ ID NO: 415469 - protein, 11 aa, Influenza virus
NGTCVVVMTDG

SEQ ID NO: 415470 - protein, 11 aa, Influenza virus
LKGSARHIEEW

SEQ ID NO: 415471 - protein, 11 aa, Influenza virus
KGSARHIEEWS

SEQ ID NO: 415472 - protein, 11 aa, Influenza virus
HIEEWSCYGHS

SEQ ID NO: 415473 - protein, 11 aa, Influenza virus
VSCVCRDNWQG

SEQ ID NO: 415474 - protein, 11 aa, Influenza virus
ANRPIIEIDMS

SEQ ID NO: 415475 - protein, 11 aa, Influenza virus
MDHTSQYLCTG

SEQ ID NO: 415476 - protein, 11 aa, Influenza virus
YVCTGVLTDTS

SEQ ID NO: 415477 - protein, 11 aa, Influenza virus
VCTGVLTDTSR

SEQ ID NO: 415478 - protein, 11 aa, Influenza virus
TGVLTDTSRPG

SEQ ID NO: 415479 - protein, 11 aa, Influenza virus
GVLTDTSRPGD

SEQ ID NO: 415480 - protein, 11 aa, Influenza virus
VLTDTSRPGDK

SEQ ID NO: 415481 - protein, 11 aa, Influenza virus
DCSNPITGSPC

SEQ ID NO: 415482 - protein, 11 aa, Influenza virus
NPITGSPGSPG

SEQ ID NO: 415483 - protein, 11 aa, Influenza virus
PGVKGFGFLSG

SEQ ID NO: 415484 - protein, 11 aa, Influenza virus
NNTWLGRTISP

SEQ ID NO: 415485 - protein, 11 aa, Influenza virus
LGRTISPRSRN

SEQ ID NO: 415486 - protein, 11 aa, Influenza virus
GRTISPRSRNG

SEQ ID NO: 415487 - protein, 11 aa, Influenza virus
RTISPRSRNGF

SEQ ID NO: 415488 - protein, 11 aa, Influenza virus
TISPRSRNGFE

SEQ ID NO: 415489 - protein, 11 aa, Influenza virus
ISPRSRNGFEM

SEQ ID NO: 415490 - protein, 11 aa, Influenza virus
SPRSRNGFEML

SEQ ID NO: 415491 - protein, 11 aa, Influenza virus
PRSRNGFEMLK

SEQ ID NO: 415492 - protein, 11 aa, Influenza virus
RSRNGFEMLKI

SEQ ID NO: 415493 - protein, 11 aa, Influenza virus
SRNGFEMLKIP

SEQ ID NO: 415494 - protein, 11 aa, Influenza virus
RSGFEMLKIHN

SEQ ID NO: 415495 - protein, 11 aa, Influenza virus
NGFEMLKIPNA

SEQ ID NO: 415496 - protein, 11 aa, Influenza virus
GFEMLKIHNAG

SEQ ID NO: 415497 - protein, 11 aa, Influenza virus
FEMLKIHNAGT

SEQ ID NO: 415498 - protein, 11 aa, Influenza virus
EMLKIHNAGTD

SEQ ID NO: 415499 - protein, 11 aa, Influenza virus
MLRIPNAGIDP

SEQ ID NO: 415500 - protein, 11 aa, Influenza virus
RQEIVDNKNWS

SEQ ID NO: 415501 - protein, 11 aa, Influenza virus
QEIVDNSNWSG

SEQ ID NO: 415502 - protein, 11 aa, Influenza virus
EIVDNKNWSGY

SEQ ID NO: 415503 - protein, 11 aa, Influenza virus
IVDNKNWSGYS

SEQ ID NO: 415504 - protein, 11 aa, Influenza virus
VDNSNWSGYSG

SEQ ID NO: 415505 - protein, 11 aa, Influenza virus
DNSNWSGYSGS

SEQ ID NO: 415506 - protein, 11 aa, Influenza virus
NSNWSGYSGSF

SEQ ID NO: 415507 - protein, 11 aa, Influenza virus
KNWSGYSGSFI

SEQ ID NO: 415508 - protein, 11 aa, Influenza virus
KYVWWASNSLI

SEQ ID NO: 415509 - protein, 11 aa, Influenza virus
YVWWASNSLIA

SEQ ID NO: 415510 - protein, 11 aa, Influenza virus
VWWASNSLIAL

SEQ ID NO: 415511 - protein, 11 aa, Influenza virus
WWASNSLIALC

SEQ ID NO: 415512 - protein, 11 aa, Influenza virus
PIGSGFFPDGP

SEQ ID NO: 415513 - protein, 11 aa, Influenza virus
SGFFPDGPQIQ

SEQ ID NO: 415514 - protein, 11 aa, Influenza virus
ILVSTNAYDRI

SEQ ID NO: 415515 - protein, 11 aa, Influenza virus
LASTNAHDRIC

SEQ ID NO: 415516 - protein, 11 aa, Influenza virus
ASTNAHDRICI

SEQ ID NO: 415517 - protein, 11 aa, Influenza virus
NNSTNTVNTLI

SEQ ID NO: 415518 - protein, 11 aa, Influenza virus
NSTDTVDTLIE

SEQ ID NO: 415519 - protein, 11 aa, Influenza virus
STDTVDTLIEQ

SEQ ID NO: 415520 - protein, 11 aa, Influenza virus
TLTEQNVPVTQ

SEQ ID NO: 415521 - protein, 11 aa, Influenza virus
EQNIPVTQTME

SEQ ID NO: 415522 - protein, 11 aa, Influenza virus
QKVPVTQTMEL

SEQ ID NO: 415523 - protein, 11 aa, Influenza virus
NIPVTQTMELV

SEQ ID NO: 415524 - protein, 11 aa, Influenza virus
VTQAMELVEAE

SEQ ID NO: 415525 - protein, 11 aa, Influenza virus
TQAMELVEAEK

SEQ ID NO: 415526 - protein, 11 aa, Influenza virus
QAMELVEAEKH

SEQ ID NO: 415527 - protein, 11 aa, Influenza virus
EKHLAYCNTDL

SEQ ID NO: 415528 - protein, 11 aa, Influenza virus
KNPAYCNTDLG

SEQ ID NO: 415529 - protein, 11 aa, Influenza virus
SAYCNTDLGAP

SEQ ID NO: 415530 - protein, 11 aa, Influenza virus
GAPLELRDCKV

SEQ ID NO: 415531 - protein, 11 aa, Influenza virus
APLELRDCKVE

SEQ ID NO: 415532 - protein, 11 aa, Influenza virus
YGNPKCDIHLR

SEQ ID NO: 415533 - protein, 11 aa, Influenza virus
GNPKCDIHLRD

SEQ ID NO: 415534 - protein, 11 aa, Influenza virus
NPKCDIHLRDQ

SEQ ID NO: 415535 - protein, 11 aa, Influenza virus
HLKDQAWSYIV

SEQ ID NO: 415536 - protein, 11 aa, Influenza virus
LRDQGWSYIVE

SEQ ID NO: 415537 - protein, 11 aa, Influenza virus
KDQAWSYIVER

SEQ ID NO: 415538 - protein, 11 aa, Influenza virus
DQAWSYIVERP

SEQ ID NO: 415539 - protein, 11 aa, Influenza virus
QAWSYIVERPS

SEQ ID NO: 415540 - protein, 11 aa, Influenza virus
AWSYIVERPSA

SEQ ID NO: 415541 - protein, 11 aa, Influenza virus
VFSIAASYKRI

SEQ ID NO: 415542 - protein, 11 aa, Influenza virus
FSIAASYKRIR

SEQ ID NO: 415543 - protein, 11 aa, Influenza virus
SIAASYKRIRL

SEQ ID NO: 415544 - protein, 11 aa, Influenza virus
SAASYKRVRLF

SEQ ID NO: 415545 - protein, 11 aa, Influenza virus
YKRVRLFDYSR

SEQ ID NO: 415546 - protein, 11 aa, Influenza virus
KRVRLFDYSRW

SEQ ID NO: 415547 - protein, 11 aa, Influenza virus
RVRLFDYSRWN

SEQ ID NO: 415548 - protein, 11 aa, Influenza virus
IRLFDYSGWNV

SEQ ID NO: 415549 - protein, 11 aa, Influenza virus
RLFDYSGWNVT

SEQ ID NO: 415550 - protein, 11 aa, Influenza virus
VSSSGTSKACN

SEQ ID NO: 415551 - protein, 11 aa, Influenza virus
SSSGTSKACNA

SEQ ID NO: 415552 - protein, 11 aa, Influenza virus
RSGTSKACNAL

SEQ ID NO: 415553 - protein, 11 aa, Influenza virus
TSKACNASTGA

SEQ ID NO: 415554 - protein, 11 aa, Influenza virus
SKACNASTGAQ

SEQ ID NO: 415555 - protein, 11 aa, Influenza virus
KACNALTGGQS

SEQ ID NO: 415556 - protein, 11 aa, Influenza virus
ACNALTGGQSF

SEQ ID NO: 415557 - protein, 11 aa, Influenza virus
CNALTGGQSFY

SEQ ID NO: 415558 - protein, 11 aa, Influenza virus
NALTGGQSFYR

SEQ ID NO: 415559 - protein, 11 aa, Influenza virus
ASTGAQSFYRS

SEQ ID NO: 415560 - protein, 11 aa, Influenza virus
STGAQSFYRSI

SEQ ID NO: 415561 - protein, 11 aa, Influenza virus
INWLTKKKPDI

SEQ ID NO: 415562 - protein, 11 aa, Influenza virus
NWLTKKEPDTY

SEQ ID NO: 415563 - protein, 11 aa, Influenza virus
WLTKKEPDTYD

SEQ ID NO: 415564 - protein, 11 aa, Influenza virus
LTKKEPDTYDF

SEQ ID NO: 415565 - protein, 11 aa, Influenza virus
TKKEPDTYDFN

SEQ ID NO: 415566 - protein, 11 aa, Influenza virus
KKKPDIYDFNE

SEQ ID NO: 415567 - protein, 11 aa, Influenza virus
KKPDIYDFNEG

SEQ ID NO: 415568 - protein, 11 aa, Influenza virus
PEAYNFNEGSY

SEQ ID NO: 415569 - protein, 11 aa, Influenza virus
NNENGDIIFLW

SEQ ID NO: 415570 - protein, 11 aa, Influenza virus
NENGDIIFLWG

SEQ ID NO: 415571 - protein, 11 aa, Influenza virus
KDGDIIFLWGI

SEQ ID NO: 415572 - protein, 11 aa, Influenza virus
EGDIIFLWGIH

SEQ ID NO: 415573 - protein, 11 aa, Influenza virus
FLWGIHHPPDE

SEQ ID NO: 415574 - protein, 11 aa, Influenza virus
LWGIHHPPDET

SEQ ID NO: 415575 - protein, 11 aa, Influenza virus
WGIHHPPDETE

SEQ ID NO: 415576 - protein, 11 aa, Influenza virus
GIHHPPDETEQ

SEQ ID NO: 415577 - protein, 11 aa, Influenza virus
IHHPPDETEQT

SEQ ID NO: 415578 - protein, 11 aa, Influenza virus
ETEQTKLYKNT

SEQ ID NO: 415579 - protein, 11 aa, Influenza virus
TTLYKNANTLT

SEQ ID NO: 415580 - protein, 11 aa, Influenza virus
TLYKNANTLTS

SEQ ID NO: 415581 - protein, 11 aa, Influenza virus
YKNANTLTSVT

SEQ ID NO: 415582 - protein, 11 aa, Influenza virus
KNANTLTSVTT

SEQ ID NO: 415583 - protein, 11 aa, Influenza virus
NANTLTSVTTN

SEQ ID NO: 415584 - protein, 11 aa, Influenza virus
ANTLTSVTTNT

SEQ ID NO: 415585 - protein, 11 aa, Influenza virus
TSVTTNTINRN

SEQ ID NO: 415586 - protein, 11 aa, Influenza virus
SVTTNTINRNF

SEQ ID NO: 415587 - protein, 11 aa, Influenza virus
VNTNTINRSFQ

SEQ ID NO: 415588 - protein, 11 aa, Influenza virus
NTNTINRSFQP

SEQ ID NO: 415589 - protein, 11 aa, Influenza virus
TNTINRNFQPN

SEQ ID NO: 415590 - protein, 11 aa, Influenza virus
NTINRNFQPNI

SEQ ID NO: 415591 - protein, 11 aa, Influenza virus
TINRNFQPNIG

SEQ ID NO: 415592 - protein, 11 aa, Influenza virus
INRNFQPNIGP

SEQ ID NO: 415593 - protein, 11 aa, Influenza virus
NRNFQPNIGPR

SEQ ID NO: 415594 - protein, 11 aa, Influenza virus
RNFQPNIGPRP

SEQ ID NO: 415595 - protein, 11 aa, Influenza virus
NFQPNIGPRPL

SEQ ID NO: 415596 - protein, 11 aa, Influenza virus
PRALVRGQQGR

SEQ ID NO: 415597 - protein, 11 aa, Influenza virus
RPLVREQQGRM

SEQ ID NO: 415598 - protein, 11 aa, Influenza virus
PLVRGQQGTMD

SEQ ID NO: 415599 - protein, 11 aa, Influenza virus
LVRGQQGTMDY

SEQ ID NO: 415600 - protein, 11 aa, Influenza virus
VREQQGRMDYY

SEQ ID NO: 415601 - protein, 11 aa, Influenza virus
REQQGRMDYYW

SEQ ID NO: 415602 - protein, 11 aa, Influenza virus
EQQGRMDYYWG

SEQ ID NO: 415603 - protein, 11 aa, Influenza virus
FGYLLKGESHC

SEQ ID NO: 415604 - protein, 11 aa, Influenza virus
GYLLKGESHGK

SEQ ID NO: 415605 - protein, 11 aa, Influenza virus
GESHCRIIQNE

SEQ ID NO: 415606 - protein, 11 aa, Influenza virus
ESHGKIIQNED

SEQ ID NO: 415607 - protein, 11 aa, Influenza virus
SHGKIIQNEDI

SEQ ID NO: 415608 - protein, 11 aa, Influenza virus
HGKIIQNEDIP

SEQ ID NO: 415609 - protein, 11 aa, Influenza virus
GRTIQNEDIPI

SEQ ID NO: 415610 - protein, 11 aa, Influenza virus
RTIQNEDIPIG

SEQ ID NO: 415611 - protein, 11 aa, Influenza virus
TIQNEDIPIGN

SEQ ID NO: 415612 - protein, 11 aa, Influenza virus
CYTKCQTYAGA

SEQ ID NO: 415613 - protein, 11 aa, Influenza virus
QTYTGAINSSR

SEQ ID NO: 415614 - protein, 11 aa, Influenza virus
TYAGAVNSSKP

SEQ ID NO: 415615 - protein, 11 aa, Influenza virus
GAVNSSKPFQN

SEQ ID NO: 415616 - protein, 11 aa, Influenza virus
AINSSKPLQNA

SEQ ID NO: 415617 - protein, 11 aa, Influenza virus
VNSSKPFQNAS

SEQ ID NO: 415618 - protein, 11 aa, Influenza virus
NSSKPFQNTSR

SEQ ID NO: 415619 - protein, 11 aa, Influenza virus
SSKPLQNASRH

SEQ ID NO: 415620 - protein, 11 aa, Influenza virus
PLQNASRHYMG

SEQ ID NO: 415621 - protein, 11 aa, Influenza virus
FQNASRHHMGE

SEQ ID NO: 415622 - protein, 11 aa, Influenza virus
QNASRYYMGEC

SEQ ID NO: 415623 - protein, 11 aa, Influenza virus
NTSRHYMGECP

SEQ ID NO: 415624 - protein, 11 aa, Influenza virus
SRYYMGECPKY

SEQ ID NO: 415625 - protein, 11 aa, Influenza virus
KKESLRLALGL

SEQ ID NO: 415626 - protein, 11 aa, Influenza virus
KESLRLAIGLR

SEQ ID NO: 415627 - protein, 11 aa, Influenza virus
ESLRLAIGLRN

SEQ ID NO: 415628 - protein, 11 aa, Influenza virus
LAIGLRNTPSI

SEQ ID NO: 415629 - protein, 11 aa, Influenza virus
AVGLRNTPSID

SEQ ID NO: 415630 - protein, 11 aa, Influenza virus
LGLRNTPSIEP

SEQ ID NO: 415631 - protein, 11 aa, Influenza virus
GLRNTPSIEPR

SEQ ID NO: 415632 - protein, 11 aa, Influenza virus
LRNTPSIEPRG

SEQ ID NO: 415633 - protein, 11 aa, Influenza virus
RNTPSIEPRGL

SEQ ID NO: 415634 - protein, 11 aa, Influenza virus
NTPSIEPRGLF

SEQ ID NO: 415635 - protein, 11 aa, Influenza virus
TPSIEPRGLFG

SEQ ID NO: 415636 - protein, 11 aa, Influenza virus
PSIEPRGLFGA

SEQ ID NO: 415637 - protein, 11 aa, Influenza virus
SIEPRGLFGAI

SEQ ID NO: 415638 - protein, 11 aa, Influenza virus
IEPRGLFGAIA

SEQ ID NO: 415639 - protein, 11 aa, Influenza virus
ADQKSTQEAIN

SEQ ID NO: 415640 - protein, 11 aa, Influenza virus
DQKSTQEAINK

SEQ ID NO: 415641 - protein, 11 aa, Influenza virus
QKSTQEAIGKI

SEQ ID NO: 415642 - protein, 11 aa, Influenza virus
KSTQEAIEKIT

SEQ ID NO: 415643 - protein, 11 aa, Influenza virus
STQEAIGKITN

SEQ ID NO: 415644 - protein, 11 aa, Influenza virus
TQEAINKITNK

SEQ ID NO: 415645 - protein, 11 aa, Influenza virus
QEAIGKITNKV

SEQ ID NO: 415646 - protein, 11 aa, Influenza virus
EAINKITNKVN

SEQ ID NO: 415647 - protein, 11 aa, Influenza virus
AINKITNKVNN

SEQ ID NO: 415648 - protein, 11 aa, Influenza virus
IGKITNKVNNI

SEQ ID NO: 415649 - protein, 11 aa, Influenza virus
EKITNKVNNIV

SEQ ID NO: 415650 - protein, 11 aa, Influenza virus
DKMNREFEVVD

SEQ ID NO: 415651 - protein, 11 aa, Influenza virus
KMNREFEVVDH

SEQ ID NO: 415652 - protein, 11 aa, Influenza virus
MNREFEVVDHE

SEQ ID NO: 415653 - protein, 11 aa, Influenza virus
NREFEVVDHEF

SEQ ID NO: 415654 - protein, 11 aa, Influenza virus
REFEVVDHEFS

SEQ ID NO: 415655 - protein, 11 aa, Influenza virus
EKKINMINDKI

SEQ ID NO: 415656 - protein, 11 aa, Influenza virus
INMISDKIDDQ

SEQ ID NO: 415657 - protein, 11 aa, Influenza virus
NVINDKIDDQI

SEQ ID NO: 415658 - protein, 11 aa, Influenza virus
MISDKIDDQIE

SEQ ID NO: 415659 - protein, 11 aa, Influenza virus
DKIDDQIEGLW

SEQ ID NO: 415660 - protein, 11 aa, Influenza virus
KIDDQIENLWA

SEQ ID NO: 415661 - protein, 11 aa, Influenza virus
IDDQIEGLWAY

SEQ ID NO: 415662 - protein, 11 aa, Influenza virus
DDQIENLWAYN

SEQ ID NO: 415663 - protein, 11 aa, Influenza virus
DQIEELWAYNA

SEQ ID NO: 415664 - protein, 11 aa, Influenza virus
QIEELWAYNAE

SEQ ID NO: 415665 - protein, 11 aa, Influenza virus
IEELWAYNAEL

SEQ ID NO: 415666 - protein, 11 aa, Influenza virus
EELWAYNAELL

SEQ ID NO: 415667 - protein, 11 aa, Influenza virus
ELWAYNAELLV

SEQ ID NO: 415668 - protein, 11 aa, Influenza virus
KTLDEHDSNVE

SEQ ID NO: 415669 - protein, 11 aa, Influenza virus
TLDKHDSNVKN

SEQ ID NO: 415670 - protein, 11 aa, Influenza virus
LFDEVRRRLST

SEQ ID NO: 415671 - protein, 11 aa, Influenza virus
FDEVRRRLSTN

SEQ ID NO: 415672 - protein, 11 aa, Influenza virus
DEVRRRLSTNA

SEQ ID NO: 415673 - protein, 11 aa, Influenza virus
NAIDTGKGCFD

SEQ ID NO: 415674 - protein, 11 aa, Influenza virus
AVDTGNGCFDI

SEQ ID NO: 415675 - protein, 11 aa, Influenza virus
IDTGKGCFDIL

SEQ ID NO: 415676 - protein, 11 aa, Influenza virus
TIKNGTYNHKD

SEQ ID NO: 415677 - protein, 11 aa, Influenza virus
IKNGTYDHKDY

SEQ ID NO: 415678 - protein, 11 aa, Influenza virus
KNGTYDHKDYE

SEQ ID NO: 415679 - protein, 11 aa, Influenza virus
NGTYNRKEYEE

SEQ ID NO: 415680 - protein, 11 aa, Influenza virus
GTYDHKDYEEE

SEQ ID NO: 415681 - protein, 11 aa, Influenza virus
TYNRKEYEEEA

SEQ ID NO: 415682 - protein, 11 aa, Influenza virus
YNHKDYEEEAK

SEQ ID NO: 415683 - protein, 11 aa, Influenza virus
DHKDYEEEAKL

SEQ ID NO: 415684 - protein, 11 aa, Influenza virus
KLERSKINGVI

SEQ ID NO: 415685 - protein, 11 aa, Influenza virus
LERSKINGVRL

SEQ ID NO: 415686 - protein, 11 aa, Influenza virus
ERSKINGVILE

SEQ ID NO: 415687 - protein, 11 aa, Influenza virus
RSKINGVILEE

SEQ ID NO: 415688 - protein, 11 aa, Influenza virus
SRINGVKLEEN

SEQ ID NO: 415689 - protein, 11 aa, Influenza virus
RINGVKLEENT

SEQ ID NO: 415690 - protein, 11 aa, Influenza virus
INGVRLEENTT

SEQ ID NO: 415691 - protein, 11 aa, Influenza virus
NGVRLEENTTY

SEQ ID NO: 415692 - protein, 11 aa, Influenza virus
VRLEENTTYKI

SEQ ID NO: 415693 - protein, 11 aa, Influenza virus
KLEENTTYRIL

SEQ ID NO: 415694 - protein, 11 aa, Influenza virus
EGLIYGNPSCN

SEQ ID NO: 415695 - protein, 11 aa, Influenza virus
LRPGQTLRVRS

SEQ ID NO: 415696 - protein, 11 aa, Influenza virus
FIEGGWSGLVD

SEQ ID NO: 415697 - protein, 11 aa, Influenza virus
IEGGWSGLVDG

SEQ ID NO: 415698 - protein, 11 aa, Influenza virus
EGGWSGLVDGW

SEQ ID NO: 415699 - protein, 11 aa, Influenza virus
GWYGFQHTNDQ

SEQ ID NO: 415700 - protein, 11 aa, Influenza virus
WYGFQHTNDQG

SEQ ID NO: 415701 - protein, 11 aa, Influenza virus
DQIQDLWAYNA

SEQ ID NO: 415702 - protein, 11 aa, Influenza virus
QIQDLWAYNAE

SEQ ID NO: 415703 - protein, 11 aa, Influenza virus
IQDLWAYNAEL

SEQ ID NO: 415704 - protein, 11 aa, Influenza virus
QDLWAYNAELL

SEQ ID NO: 415705 - protein, 11 aa, Influenza virus
DLWAYNAELLV

SEQ ID NO: 415706 - protein, 11 aa, Influenza virus
ELLVLLENQKP

SEQ ID NO: 415707 - protein, 11 aa, Influenza virus
LLENQKILDEH

SEQ ID NO: 415708 - protein, 11 aa, Influenza virus
ENGNGCFELYH

SEQ ID NO: 415709 - protein, 11 aa, Influenza virus
GKGCFELYHRC

SEQ ID NO: 415710 - protein, 11 aa, Influenza virus
GAYKILTIYST

SEQ ID NO: 415711 - protein, 11 aa, Influenza virus
AYKILTIYSTV

SEQ ID NO: 415712 - protein, 11 aa, Influenza virus
HKILTIYSTVA

SEQ ID NO: 415713 - protein, 11 aa, Influenza virus
ILTIYSTVASP

SEQ ID NO: 415714 - protein, 11 aa, Influenza virus
LTIYSTVASSF

SEQ ID NO: 415715 - protein, 11 aa, Influenza virus
EGLIYGNPSCN

SEQ ID NO: 415716 - protein, 11 aa, Influenza virus
LRPGQTLRVRS

SEQ ID NO: 415717 - protein, 11 aa, Influenza virus
EGGWSGLVDGW

SEQ ID NO: 415718 - protein, 11 aa, Influenza virus
GWYGFQHTNDQ

SEQ ID NO: 415719 - protein, 11 aa, Influenza virus
WYGFQHTNDQG

SEQ ID NO: 415720 - protein, 11 aa, Influenza virus
DQIQDLWAYNA

SEQ ID NO: 415721 - protein, 11 aa, Influenza virus
QIQDLWAYNAE

SEQ ID NO: 415722 - protein, 11 aa, Influenza virus
IQDLWAYNAEL

SEQ ID NO: 415723 - protein, 11 aa, Influenza virus
QDLWAYNAELL

SEQ ID NO: 415724 - protein, 11 aa, Influenza virus
DLWAYNAELLV

SEQ ID NO: 415725 - protein, 11 aa, Influenza virus
ELLVLLENQKP

SEQ ID NO: 415726 - protein, 11 aa, Influenza virus
LLVLLENQKPL

SEQ ID NO: 415727 - protein, 11 aa, Influenza virus
LVLLENQKPLD

SEQ ID NO: 415728 - protein, 11 aa, Influenza virus
VLLENQKPLDE

SEQ ID NO: 415729 - protein, 11 aa, Influenza virus
LLENQKPLDEH

SEQ ID NO: 415730 - protein, 11 aa, Influenza virus
ENGNGCFELYH

SEQ ID NO: 415731 - protein, 11 aa, Influenza virus
GKGCFELYHRC

SEQ ID NO: 415732 - protein, 11 aa, Influenza virus
GAYKILTIYST

SEQ ID NO: 415733 - protein, 11 aa, Influenza virus
AYKILTIYSTV

SEQ ID NO: 415734 - protein, 11 aa, Influenza virus
HKILTIYSTVA

SEQ ID NO: 415735 - protein, 11 aa, Influenza virus
ILTIYSTVASP

SEQ ID NO: 415736 - protein, 11 aa, Influenza virus
LTIYSTVASSF

SEQ ID NO: 415737 - protein, 11 aa, Influenza virus
CNQFALGQGTT

SEQ ID NO: 415738 - protein, 11 aa, Influenza virus
NQFALGQGTTL

SEQ ID NO: 415739 - protein, 11 aa, Influenza virus
SYRTLLMSELG

SEQ ID NO: 415740 - protein, 11 aa, Influenza virus
HRTLLMNELGI

SEQ ID NO: 415741 - protein, 11 aa, Influenza virus
LLMNELGGPFH

SEQ ID NO: 415742 - protein, 11 aa, Influenza virus
VCIAWSSSSCY

SEQ ID NO: 415743 - protein, 11 aa, Influenza virus
CIAWSSASCHD

SEQ ID NO: 415744 - protein, 11 aa, Influenza virus
IAWSSASCHDG

SEQ ID NO: 415745 - protein, 11 aa, Influenza virus
AWSSASCHDGR

SEQ ID NO: 415746 - protein, 11 aa, Influenza virus
WSSASCHDGRA

SEQ ID NO: 415747 - protein, 11 aa, Influenza virus
SSASCHDGRAW

SEQ ID NO: 415748 - protein, 11 aa, Influenza virus
SASCHDGRAWL

SEQ ID NO: 415749 - protein, 11 aa, Influenza virus
ILRTQESECVS

SEQ ID NO: 415750 - protein, 11 aa, Influenza virus
GNAQHVEECSC

SEQ ID NO: 415751 - protein, 11 aa, Influenza virus
GAQHVEECSCY

SEQ ID NO: 415752 - protein, 11 aa, Influenza virus
VCRDNWRGFNR

SEQ ID NO: 415753 - protein, 11 aa, Influenza virus
CSGLVGDTPRT

SEQ ID NO: 415754 - protein, 11 aa, Influenza virus
INRCFYVELTR

SEQ ID NO: 415755 - protein, 11 aa, Influenza virus
RCFYVELTRGR

SEQ ID NO: 415756 - protein, 11 aa, Influenza virus
CFYVELTRGRP

SEQ ID NO: 415757 - protein, 11 aa, Influenza virus
HGTGSWPDGAN

SEQ ID NO: 415758 - protein, 11 aa, Influenza virus
LKAEIAQRLEG

SEQ ID NO: 415759 - protein, 11 aa, Influenza virus
KAEIAQRLEGV

SEQ ID NO: 415760 - protein, 11 aa, Influenza virus
AEIAQRLEGVF

SEQ ID NO: 415761 - protein, 11 aa, Influenza virus
EIAQRLEGVFA

SEQ ID NO: 415762 - protein, 11 aa, Influenza virus
IAQRLEGVFAG

SEQ ID NO: 415763 - protein, 11 aa, Influenza virus
AQRLEGVFAGK

SEQ ID NO: 415764 - protein, 11 aa, Influenza virus
VFAGKNTDLEV

SEQ ID NO: 415765 - protein, 11 aa, Influenza virus
FAGKNTDLEVL

SEQ ID NO: 415766 - protein, 11 aa, Influenza virus
AGKNTDLEVLM

SEQ ID NO: 415767 - protein, 11 aa, Influenza virus
GKNTDLEVLME

SEQ ID NO: 415768 - protein, 11 aa, Influenza virus
KNTDLEVLMEW

SEQ ID NO: 415769 - protein, 11 aa, Influenza virus
NSDLEALMEWL

SEQ ID NO: 415770 - protein, 11 aa, Influenza virus
SDLEALMEWLK

SEQ ID NO: 415771 - protein, 11 aa, Influenza virus
NGNGDPSNMDR

SEQ ID NO: 415772 - protein, 11 aa, Influenza virus
GDPNNMARAVK

SEQ ID NO: 415773 - protein, 11 aa, Influenza virus
DPNNMARAVKL

SEQ ID NO: 415774 - protein, 11 aa, Influenza virus
PNNMARAVKLY

SEQ ID NO: 415775 - protein, 11 aa, Influenza virus
NMDKAVKLYKK

SEQ ID NO: 415776 - protein, 11 aa, Influenza virus
MDKAVKLYKKL

SEQ ID NO: 415777 - protein, 11 aa, Influenza virus
DKAVKLYKKLK

SEQ ID NO: 415778 - protein, 11 aa, Influenza virus
KAVKLYKKLKR

SEQ ID NO: 415779 - protein, 11 aa, Influenza virus
RKLKREMTFHG

SEQ ID NO: 415780 - protein, 11 aa, Influenza virus
REITFHRAKEV

SEQ ID NO: 415781 - protein, 11 aa, Influenza virus
ALGYSTGALAS

SEQ ID NO: 415782 - protein, 11 aa, Influenza virus
GLIYNRMGTIT

SEQ ID NO: 415783 - protein, 11 aa, Influenza virus
TCEQIADSHHR

SEQ ID NO: 415784 - protein, 11 aa, Influenza virus
CEQIADSHHRS

SEQ ID NO: 415785 - protein, 11 aa, Influenza virus
EQIADSHHRSH

SEQ ID NO: 415786 - protein, 11 aa, Influenza virus
QIADSHHRSHR

SEQ ID NO: 415787 - protein, 11 aa, Influenza virus
IADSHHRSHRQ

SEQ ID NO: 415788 - protein, 11 aa, Influenza virus
ADSHHRSHRQM

SEQ ID NO: 415789 - protein, 11 aa, Influenza virus
ATTNPLIRHEN

SEQ ID NO: 415790 - protein, 11 aa, Influenza virus
QMAGSNEQAAE

SEQ ID NO: 415791 - protein, 11 aa, Influenza virus
MAGSNEQAAEA

SEQ ID NO: 415792 - protein, 11 aa, Influenza virus
GSNEQAAEAME

SEQ ID NO: 415793 - protein, 11 aa, Influenza virus
SEQAAEAMDIA

SEQ ID NO: 415794 - protein, 11 aa, Influenza virus
LLDNLQAYQKR

SEQ ID NO: 415795 - protein, 11 aa, Influenza virus
LDNLQAYQKRM

SEQ ID NO: 415796 - protein, 11 aa, Influenza virus
ENLQAYQNRMG

SEQ ID NO: 415797 - protein, 11 aa, Influenza virus
QAYQKRMGVQI

SEQ ID NO: 415798 - protein, 11 aa, Influenza virus
YQKRMGLQMQR

SEQ ID NO: 415799 - protein, 11 aa, Influenza virus
MSDIEIMASQG

SEQ ID NO: 415800 - protein, 11 aa, Influenza virus
SDIEIMASQGT

SEQ ID NO: 415801 - protein, 11 aa, Influenza virus
DIEIMASQGTK

SEQ ID NO: 415802 - protein, 11 aa, Influenza virus
IEAMATQGTKR

SEQ ID NO: 415803 - protein, 11 aa, Influenza virus
GAMASQGTKRS

SEQ ID NO: 415804 - protein, 11 aa, Influenza virus
MASQGTKRPYE

SEQ ID NO: 415805 - protein, 11 aa, Influenza virus
ASQGTKRPYEQ

SEQ ID NO: 415806 - protein, 11 aa, Influenza virus
SQGTKRPYEQM

SEQ ID NO: 415807 - protein, 11 aa, Influenza virus
TKRSHEQMETG

SEQ ID NO: 415808 - protein, 11 aa, Influenza virus
KRSHEQMETGG

SEQ ID NO: 415809 - protein, 11 aa, Influenza virus
RFYIQMCTELQ

SEQ ID NO: 415810 - protein, 11 aa, Influenza virus
YIQMCTELQLS

SEQ ID NO: 415811 - protein, 11 aa, Influenza virus
GRLVQNSITIE

SEQ ID NO: 415812 - protein, 11 aa, Influenza virus
RRNRYLEENPS

SEQ ID NO: 415813 - protein, 11 aa, Influenza virus
RNKYLEEHPST

SEQ ID NO: 415814 - protein, 11 aa, Influenza virus
NKYLEEHPSTG

SEQ ID NO: 415815 - protein, 11 aa, Influenza virus
YLEENPSAGKD

SEQ ID NO: 415816 - protein, 11 aa, Influenza virus
LEENPSAGKDP

SEQ ID NO: 415817 - protein, 11 aa, Influenza virus
EENPSAGKDPK

SEQ ID NO: 415818 - protein, 11 aa, Influenza virus
ENPSAGKDPKK

SEQ ID NO: 415819 - protein, 11 aa, Influenza virus
NPSAGKDPKKT

SEQ ID NO: 415820 - protein, 11 aa, Influenza virus
PSAGRDPKKTG

SEQ ID NO: 415821 - protein, 11 aa, Influenza virus
SAGRDPKKTGG

SEQ ID NO: 415822 - protein, 11 aa, Influenza virus
SGLTHIMIWHS

SEQ ID NO: 415823 - protein, 11 aa, Influenza virus
IMIWHSNLNDT

SEQ ID NO: 415824 - protein, 11 aa, Influenza virus
AGAAIKGVGTM

SEQ ID NO: 415825 - protein, 11 aa, Influenza virus
VLELIRMIKRG

SEQ ID NO: 415826 - protein, 11 aa, Influenza virus
MELVRMIKRGI

SEQ ID NO: 415827 - protein, 11 aa, Influenza virus
ELIRMIKRGVN

SEQ ID NO: 415828 - protein, 11 aa, Influenza virus
LIRMIKRGVND

SEQ ID NO: 415829 - protein, 11 aa, Influenza virus
IRMIKRGVNDR

SEQ ID NO: 415830 - protein, 11 aa, Influenza virus
TRTAYERMCNI

SEQ ID NO: 415831 - protein, 11 aa, Influenza virus
RTAYERMCNIL

SEQ ID NO: 415832 - protein, 11 aa, Influenza virus
TAYERMCNILK

SEQ ID NO: 415833 - protein, 11 aa, Influenza virus
QRAMMDQVREG

SEQ ID NO: 415834 - protein, 11 aa, Influenza virus
RAMMDQVREGR

SEQ ID NO: 415835 - protein, 11 aa, Influenza virus
GNAEIEDLIFM

SEQ ID NO: 415836 - protein, 11 aa, Influenza virus
NAEIEDLIFMA

SEQ ID NO: 415837 - protein, 11 aa, Influenza virus
AEIEDLIFMAR

SEQ ID NO: 415838 - protein, 11 aa, Influenza virus
EIEDLIFMARS

SEQ ID NO: 415839 - protein, 11 aa, Influenza virus
IEDLIFMARSA

SEQ ID NO: 415840 - protein, 11 aa, Influenza virus
EDLIFMARSAL

SEQ ID NO: 415841 - protein, 11 aa, Influenza virus
DLIFMARSALI

SEQ ID NO: 415842 - protein, 11 aa, Influenza virus
LIFMARSALIL

SEQ ID NO: 415843 - protein, 11 aa, Influenza virus
IFMARSALILR

SEQ ID NO: 415844 - protein, 11 aa, Influenza virus
LARSALILRGA

SEQ ID NO: 415845 - protein, 11 aa, Influenza virus
VAHKSCLPACI

SEQ ID NO: 415846 - protein, 11 aa, Influenza virus
KSCLPACIYGL

SEQ ID NO: 415847 - protein, 11 aa, Influenza virus
SCLPACIYGLV

SEQ ID NO: 415848 - protein, 11 aa, Influenza virus
GYNFEKEGYSL

SEQ ID NO: 415849 - protein, 11 aa, Influenza virus
YNFEKEGYSLV

SEQ ID NO: 415850 - protein, 11 aa, Influenza virus
FEREGYSLVGV

SEQ ID NO: 415851 - protein, 11 aa, Influenza virus
EREGYSLVGVD

SEQ ID NO: 415852 - protein, 11 aa, Influenza virus
YSLVGVDPFRL

SEQ ID NO: 415853 - protein, 11 aa, Influenza virus
SLVGVDPFRLL

SEQ ID NO: 415854 - protein, 11 aa, Influenza virus
LVGVDPFRLLQ

SEQ ID NO: 415855 - protein, 11 aa, Influenza virus
DPFKLLQTSQV

SEQ ID NO: 415856 - protein, 11 aa, Influenza virus
RPNENPVHKSQ

SEQ ID NO: 415857 - protein, 11 aa, Influenza virus
PNENPVHKSQL

SEQ ID NO: 415858 - protein, 11 aa, Influenza virus
NENPAHKSQLI

SEQ ID NO: 415859 - protein, 11 aa, Influenza virus
NPVHKSQLVWM

SEQ ID NO: 415860 - protein, 11 aa, Influenza virus
PVHKSQLVWMA

SEQ ID NO: 415861 - protein, 11 aa, Influenza virus
VHKSQLVWMAC

SEQ ID NO: 415862 - protein, 11 aa, Influenza virus
CHSAAFEDLRI

SEQ ID NO: 415863 - protein, 11 aa, Influenza virus
LATRGVQIASN

SEQ ID NO: 415864 - protein, 11 aa, Influenza virus
ATRGVQIASNE

SEQ ID NO: 415865 - protein, 11 aa, Influenza virus
AIRTKSGGNTN

SEQ ID NO: 415866 - protein, 11 aa, Influenza virus
IRTKSGGNTNQ

SEQ ID NO: 415867 - protein, 11 aa, Influenza virus
SVQPAFSVQRN

SEQ ID NO: 415868 - protein, 11 aa, Influenza virus
VQPAFSVQRNL

SEQ ID NO: 415869 - protein, 11 aa, Influenza virus
AFSVQRNLPFD

SEQ ID NO: 415870 - protein, 11 aa, Influenza virus
FSVQRSLPFER

SEQ ID NO: 415871 - protein, 11 aa, Influenza virus
EVSFQGRGVFE

SEQ ID NO: 415872 - protein, 11 aa, Influenza virus
MSFQGRGVFEL

SEQ ID NO: 415873 - protein, 11 aa, Influenza virus
GVFELSDERAA

SEQ ID NO: 415874 - protein, 11 aa, Influenza virus
ISNEGSYFFGD

SEQ ID NO: 415875 - protein, 11 aa, Influenza virus
SNEGSYFFGDS

SEQ ID NO: 415876 - protein, 11 aa, Influenza virus
DGSYFFGDNAE

SEQ ID NO: 415877 - protein, 11 aa, Influenza virus
GSYFFGDNAED

SEQ ID NO: 415878 - protein, 11 aa, Influenza virus
SYFFGDNAKEY

SEQ ID NO: 415879 - protein, 11 aa, Influenza virus
FQVDCFIWHIR

SEQ ID NO: 415880 - protein, 11 aa, Influenza virus
GDAPFLDRIRR

SEQ ID NO: 415881 - protein, 11 aa, Influenza virus
DAPFIDRLRRD

SEQ ID NO: 415882 - protein, 11 aa, Influenza virus
APFIDRLRRDQ

SEQ ID NO: 415883 - protein, 11 aa, Influenza virus
KMPASRYLTDM

SEQ ID NO: 415884 - protein, 11 aa, Influenza virus
MPASRYLTDMT

SEQ ID NO: 415885 - protein, 11 aa, Influenza virus
TENSFEQITFI

SEQ ID NO: 415886 - protein, 11 aa, Influenza virus
ENSFEQITFIQ

SEQ ID NO: 415887 - protein, 11 aa, Influenza virus
NSFEQITFIQA

SEQ ID NO: 415888 - protein, 11 aa, Influenza virus
ITFIQALQLLL

SEQ ID NO: 415889 - protein, 11 aa, Influenza virus
TFIQALQLLLE

SEQ ID NO: 415890 - protein, 11 aa, Influenza virus
FIQALQLLLEV

SEQ ID NO: 415891 - protein, 11 aa, Influenza virus
IQALQLLLEVE

SEQ ID NO: 415892 - protein, 11 aa, Influenza virus
QALQLLLEVEN

SEQ ID NO: 415893 - protein, 11 aa, Influenza virus
ALQLLLEVENE

SEQ ID NO: 415894 - protein, 11 aa, Influenza virus
MEEFVRQCFNP

SEQ ID NO: 415895 - protein, 11 aa, Influenza virus
RQCFNPMTVEL

SEQ ID NO: 415896 - protein, 11 aa, Influenza virus
QCFNPMTVELA

SEQ ID NO: 415897 - protein, 11 aa, Influenza virus
CFNPMTVELAE

SEQ ID NO: 415898 - protein, 11 aa, Influenza virus
ELAERAMKEYG

SEQ ID NO: 415899 - protein, 11 aa, Influenza virus
LAERAMKEYGE

SEQ ID NO: 415900 - protein, 11 aa, Influenza virus
ETNKFAAVCTH

SEQ ID NO: 415901 - protein, 11 aa, Influenza virus
TNKFASICTHL

SEQ ID NO: 415902 - protein, 11 aa, Influenza virus
NKFASICTHLE

SEQ ID NO: 415903 - protein, 11 aa, Influenza virus
ASICTHLEVCF

SEQ ID NO: 415904 - protein, 11 aa, Influenza virus
SICTHLEVCFM

SEQ ID NO: 415905 - protein, 11 aa, Influenza virus
MYSDFHFIDEQ

SEQ ID NO: 415906 - protein, 11 aa, Influenza virus
DPNTLLKHRFE

SEQ ID NO: 415907 - protein, 11 aa, Influenza virus
PNTLLKHRFEI

SEQ ID NO: 415908 - protein, 11 aa, Influenza virus
RFEIIEGRDRA

SEQ ID NO: 415909 - protein, 11 aa, Influenza virus
KPKYLPDLYDY

SEQ ID NO: 415910 - protein, 11 aa, Influenza virus
PKYLPDLYDYK

SEQ ID NO: 415911 - protein, 11 aa, Influenza virus
LPDLYDYKKNR

SEQ ID NO: 415912 - protein, 11 aa, Influenza virus
PDLYDYKKNRF

SEQ ID NO: 415913 - protein, 11 aa, Influenza virus
RFTEIGVTRRE

SEQ ID NO: 415914 - protein, 11 aa, Influenza virus
IGVTRREIHIY

SEQ ID NO: 415915 - protein, 11 aa, Influenza virus
GVTRREIHIYY

SEQ ID NO: 415916 - protein, 11 aa, Influenza virus
VTRREIHIYYL

SEQ ID NO: 415917 - protein, 11 aa, Influenza virus
TRREIHIYYLE

SEQ ID NO: 415918 - protein, 11 aa, Influenza virus
RREIHIYYLEK

SEQ ID NO: 415919 - protein, 11 aa, Influenza virus
YYMEKANKIKS

SEQ ID NO: 415920 - protein, 11 aa, Influenza virus
IFSFIGEEMAT

SEQ ID NO: 415921 - protein, 11 aa, Influenza virus
FSFTGEEMASK

SEQ ID NO: 415922 - protein, 11 aa, Influenza virus
DYILDEESRAR

SEQ ID NO: 415923 - protein, 11 aa, Influenza virus
RLFTIRQELAS

SEQ ID NO: 415924 - protein, 11 aa, Influenza virus
RGLWDPFRQSE

SEQ ID NO: 415925 - protein, 11 aa, Influenza virus
SERGEETVEER

SEQ ID NO: 415926 - protein, 11 aa, Influenza virus
ERGEETVEERF

SEQ ID NO: 415927 - protein, 11 aa, Influenza virus
RGEETVEERFE

SEQ ID NO: 415928 - protein, 11 aa, Influenza virus
GEETVEERFEI

SEQ ID NO: 415929 - protein, 11 aa, Influenza virus
LADQSLPPNFP

SEQ ID NO: 415930 - protein, 11 aa, Influenza virus
FRTYVDGFEPN

SEQ ID NO: 415931 - protein, 11 aa, Influenza virus
YVDGFEPNGSI

SEQ ID NO: 415932 - protein, 11 aa, Influenza virus
VDGFEPNGSIE

SEQ ID NO: 415933 - protein, 11 aa, Influenza virus
FEPNGCIESKL

SEQ ID NO: 415934 - protein, 11 aa, Influenza virus
GCIEGKLSQMP

SEQ ID NO: 415935 - protein, 11 aa, Influenza virus
CIESKLSQMSK

SEQ ID NO: 415936 - protein, 11 aa, Influenza virus
CFQRSKFLLMD

SEQ ID NO: 415937 - protein, 11 aa, Influenza virus
KLSIENPSHEG

SEQ ID NO: 415938 - protein, 11 aa, Influenza virus
LSIENPSHEGE

SEQ ID NO: 415939 - protein, 11 aa, Influenza virus
SIENPSHEGEG

SEQ ID NO: 415940 - protein, 11 aa, Influenza virus
IENPSHEGEGI

SEQ ID NO: 415941 - protein, 11 aa, Influenza virus
ENPSHEGEGIP

SEQ ID NO: 415942 - protein, 11 aa, Influenza virus
NPSHEGEGIPL

SEQ ID NO: 415943 - protein, 11 aa, Influenza virus
PSHEGEGIPLH

SEQ ID NO: 415944 - protein, 11 aa, Influenza virus
SHEGEGIPLHD

SEQ ID NO: 415945 - protein, 11 aa, Influenza virus
GEGIPLYDAVK

SEQ ID NO: 415946 - protein, 11 aa, Influenza virus
EGIPLYDAVKC

SEQ ID NO: 415947 - protein, 11 aa, Influenza virus
LKWTLGENMAP

SEQ ID NO: 415948 - protein, 11 aa, Influenza virus
KWTLGENMAPE

SEQ ID NO: 415949 - protein, 11 aa, Influenza virus
LGENIAPEKVD

SEQ ID NO: 415950 - protein, 11 aa, Influenza virus
GENIAPEKVDF

SEQ ID NO: 415951 - protein, 11 aa, Influenza virus
WVQSEFNKACE

SEQ ID NO: 415952 - protein, 11 aa, Influenza virus
VQSEFNKACEL

SEQ ID NO: 415953 - protein, 11 aa, Influenza virus
FNKACELTDST

SEQ ID NO: 415954 - protein, 11 aa, Influenza virus
NKACELTDSTW

SEQ ID NO: 415955 - protein, 11 aa, Influenza virus
EFDEIGEDVAP

SEQ ID NO: 415956 - protein, 11 aa, Influenza virus
FDEIGEDVAPI

SEQ ID NO: 415957 - protein, 11 aa, Influenza virus
EIGEDIAPIEY

SEQ ID NO: 415958 - protein, 11 aa, Influenza virus
APIEHVASMRR

SEQ ID NO: 415959 - protein, 11 aa, Influenza virus
YFTTEVSHCRA

SEQ ID NO: 415960 - protein, 11 aa, Influenza virus
FTTEVSHCRAT

SEQ ID NO: 415961 - protein, 11 aa, Influenza virus
TTEVSHCRATE

SEQ ID NO: 415962 - protein, 11 aa, Influenza virus
TEVSHCRATEY

SEQ ID NO: 415963 - protein, 11 aa, Influenza virus
EVSHCRATEYM

SEQ ID NO: 415964 - protein, 11 aa, Influenza virus
VSHCRATEYMM

SEQ ID NO: 415965 - protein, 11 aa, Influenza virus
SHCRATEYIIK

SEQ ID NO: 415966 - protein, 11 aa, Influenza virus
HCRATEYIIKG

SEQ ID NO: 415967 - protein, 11 aa, Influenza virus
KGVYINTAMLN

SEQ ID NO: 415968 - protein, 11 aa, Influenza virus
GVYINTAMLNA

SEQ ID NO: 415969 - protein, 11 aa, Influenza virus
VYINTAMLNAS

SEQ ID NO: 415970 - protein, 11 aa, Influenza virus
YINTAMLNASC

SEQ ID NO: 415971 - protein, 11 aa, Influenza virus
INTAMLNASCA

SEQ ID NO: 415972 - protein, 11 aa, Influenza virus
LLNASCAAMED

SEQ ID NO: 415973 - protein, 11 aa, Influenza virus
LNSSCAAMDDF

SEQ ID NO: 415974 - protein, 11 aa, Influenza virus
NSSCAAMDDFQ

SEQ ID NO: 415975 - protein, 11 aa, Influenza virus
SSCAAMDDFQL

SEQ ID NO: 415976 - protein, 11 aa, Influenza virus
SCAAMDDYQLI

SEQ ID NO: 415977 - protein, 11 aa, Influenza virus
CAAMDDYQLIP

SEQ ID NO: 415978 - protein, 11 aa, Influenza virus
TAMDDFQLIPM

SEQ ID NO: 415979 - protein, 11 aa, Influenza virus
AMDDYQLIPMI

SEQ ID NO: 415980 - protein, 11 aa, Influenza virus
DDYQLIPMISK

SEQ ID NO: 415981 - protein, 11 aa, Influenza virus
DFQLIPMISNC

SEQ ID NO: 415982 - protein, 11 aa, Influenza virus
LIPMISNCRTK

SEQ ID NO: 415983 - protein, 11 aa, Influenza virus
IPMISNCRTKE

SEQ ID NO: 415984 - protein, 11 aa, Influenza virus
PMISKSRTKEG

SEQ ID NO: 415985 - protein, 11 aa, Influenza virus
MISKSRTKEGR

SEQ ID NO: 415986 - protein, 11 aa, Influenza virus
ISKSRTKEGRR

SEQ ID NO: 415987 - protein, 11 aa, Influenza virus
SKCKTKEGRRK

SEQ ID NO: 415988 - protein, 11 aa, Influenza virus
KCKTKEGRRKT

SEQ ID NO: 415989 - protein, 11 aa, Influenza virus
CKTKEGRRKTN

SEQ ID NO: 415990 - protein, 11 aa, Influenza virus
RRKTNLYGFLI

SEQ ID NO: 415991 - protein, 11 aa, Influenza virus
MEFSLVDPRLE

SEQ ID NO: 415992 - protein, 11 aa, Influenza virus
LFLYVRTNGTS

SEQ ID NO: 415993 - protein, 11 aa, Influenza virus
SLQQVESMIEA

SEQ ID NO: 415994 - protein, 11 aa, Influenza virus
LQQVESMIEAE

SEQ ID NO: 415995 - protein, 11 aa, Influenza virus
QQVESMIEAES

SEQ ID NO: 415996 - protein, 11 aa, Influenza virus
QVESMIEAESS

SEQ ID NO: 415997 - protein, 11 aa, Influenza virus
IESIIEAESSV

SEQ ID NO: 415998 - protein, 11 aa, Influenza virus
ESMIEAESSVR

SEQ ID NO: 415999 - protein, 11 aa, Influenza virus
MIEAESSVREK

SEQ ID NO: 416000 - protein, 11 aa, Influenza virus
IEAESSVREKD

SEQ ID NO: 416001 - protein, 11 aa, Influenza virus
EAESSVKEKDL

SEQ ID NO: 416002 - protein, 11 aa, Influenza virus
AESSVKEKDLT

SEQ ID NO: 416003 - protein, 11 aa, Influenza virus
ESSVREKDMTK

SEQ ID NO: 416004 - protein, 11 aa, Influenza virus
MEEGSIGKVCR

SEQ ID NO: 416005 - protein, 11 aa, Influenza virus
EEGSIGKVCRA

SEQ ID NO: 416006 - protein, 11 aa, Influenza virus
EGSIGKVCRAL

SEQ ID NO: 416007 - protein, 11 aa, Influenza virus
RALLAKSVFNS

SEQ ID NO: 416008 - protein, 11 aa, Influenza virus
ALLAKSVFNSL

SEQ ID NO: 416009 - protein, 11 aa, Influenza virus
LLAKSVFNSIY

SEQ ID NO: 416010 - protein, 11 aa, Influenza virus
LAKSVFNSLYS

SEQ ID NO: 416011 - protein, 11 aa, Influenza virus
AKSVFNSLYSS

SEQ ID NO: 416012 - protein, 11 aa, Influenza virus
FNSLYSSPQLE

SEQ ID NO: 416013 - protein, 11 aa, Influenza virus
NSLYSSPQLEG

SEQ ID NO: 416014 - protein, 11 aa, Influenza virus
SLYSSPQLEGF

SEQ ID NO: 416015 - protein, 11 aa, Influenza virus
AESRKMLLIVQ

SEQ ID NO: 416016 - protein, 11 aa, Influenza virus
ESRKMLLIVQA

SEQ ID NO: 416017 - protein, 11 aa, Influenza virus
QALKDNLEPGT

SEQ ID NO: 416018 - protein, 11 aa, Influenza virus
ALKDNLEPGTF

SEQ ID NO: 416019 - protein, 11 aa, Influenza virus
LKDNLEPGTFD

SEQ ID NO: 416020 - protein, 11 aa, Influenza virus
KDNLEPGTFDL

SEQ ID NO: 416021 - protein, 11 aa, Influenza virus
LEPGTFDIEGL

SEQ ID NO: 416022 - protein, 11 aa, Influenza virus
EPGTFDIEGLY

SEQ ID NO: 416023 - protein, 11 aa, Influenza virus
GLYGAIEECLI

SEQ ID NO: 416024 - protein, 11 aa, Influenza virus
LYGAIEECLIN

SEQ ID NO: 416025 - protein, 11 aa, Influenza virus
YGAIEECLIND

SEQ ID NO: 416026 - protein, 11 aa, Influenza virus
GAIEECLINDP

SEQ ID NO: 416027 - protein, 11 aa, Influenza virus
LNASWFNSFLI

SEQ ID NO: 416028 - protein, 11 aa, Influenza virus
NASWFNSFLIH

SEQ ID NO: 416029 - protein, 11 aa, Influenza virus
FNSFLTHALRF

SEQ ID NO: 416030 - protein, 11 aa, Influenza virus
NRTHQYSEKGR

SEQ ID NO: 416031 - protein, 11 aa, Influenza virus
RTHQYSEKGRW

SEQ ID NO: 416032 - protein, 11 aa, Influenza virus
ETGALQLNPID

SEQ ID NO: 416033 - protein, 11 aa, Influenza virus
TGALQLNPIDG

SEQ ID NO: 416034 - protein, 11 aa, Influenza virus
GAPQLNPVDGP

SEQ ID NO: 416035 - protein, 11 aa, Influenza virus
QLNPIDGPLPV

SEQ ID NO: 416036 - protein, 11 aa, Influenza virus
NEPNGYAQTDC

SEQ ID NO: 416037 - protein, 11 aa, Influenza virus
CVLEAMALLEE

SEQ ID NO: 416038 - protein, 11 aa, Influenza virus
VLEAMALLEES

SEQ ID NO: 416039 - protein, 11 aa, Influenza virus
EAMALLEESHP

SEQ ID NO: 416040 - protein, 11 aa, Influenza virus
SHPGIFGNSCL

SEQ ID NO: 416041 - protein, 11 aa, Influenza virus
HPGIFGNSCLE

SEQ ID NO: 416042 - protein, 11 aa, Influenza virus
VQQTRMDKLTQ

SEQ ID NO: 416043 - protein, 11 aa, Influenza virus
ALANTIEVFKS

SEQ ID NO: 416044 - protein, 11 aa, Influenza virus
LANTIEVFKSN

SEQ ID NO: 416045 - protein, 11 aa, Influenza virus
GRLMDFLKDVM

SEQ ID NO: 416046 - protein, 11 aa, Influenza virus
SYLIRTLTLNT

SEQ ID NO: 416047 - protein, 11 aa, Influenza virus
QIRGFVYFVEI

SEQ ID NO: 416048 - protein, 11 aa, Influenza virus
IRGFVYFVEIL

SEQ ID NO: 416049 - protein, 11 aa, Influenza virus
RGFVYFVEILA

SEQ ID NO: 416050 - protein, 11 aa, Influenza virus
LARNICEKLEQ

SEQ ID NO: 416051 - protein, 11 aa, Influenza virus
ARNICEKLEQS

SEQ ID NO: 416052 - protein, 11 aa, Influenza virus
RNICEKLEQSG

SEQ ID NO: 416053 - protein, 11 aa, Influenza virus
NICEKLEQSGL

SEQ ID NO: 416054 - protein, 11 aa, Influenza virus
VRKMMTNSHDT

SEQ ID NO: 416055 - protein, 11 aa, Influenza virus
SQDTEVSFTIT

SEQ ID NO: 416056 - protein, 11 aa, Influenza virus
QDTEVSFTITG

SEQ ID NO: 416057 - protein, 11 aa, Influenza virus
NENQNPRVFLT

SEQ ID NO: 416058 - protein, 11 aa, Influenza virus
ENQNPRVFLTM

SEQ ID NO: 416059 - protein, 11 aa, Influenza virus
NQNPRVFLTMI

SEQ ID NO: 416060 - protein, 11 aa, Influenza virus
QNPRVFLTMIT

SEQ ID NO: 416061 - protein, 11 aa, Influenza virus
NPRVFLTMITY

SEQ ID NO: 416062 - protein, 11 aa, Influenza virus
PRVFLTMITYI

SEQ ID NO: 416063 - protein, 11 aa, Influenza virus
RVFLTMITYIT

SEQ ID NO: 416064 - protein, 11 aa, Influenza virus
WFRNVLSVAPI

SEQ ID NO: 416065 - protein, 11 aa, Influenza virus
FRNVLSVAPIM

SEQ ID NO: 416066 - protein, 11 aa, Influenza virus
RNVLSVAPIMF

SEQ ID NO: 416067 - protein, 11 aa, Influenza virus
NVLSVAPIMFS

SEQ ID NO: 416068 - protein, 11 aa, Influenza virus
VLSVAPIMFSN

SEQ ID NO: 416069 - protein, 11 aa, Influenza virus
SIAPIMFSNKV

SEQ ID NO: 416070 - protein, 11 aa, Influenza virus
IAPIMFSNKVA

SEQ ID NO: 416071 - protein, 11 aa, Influenza virus
GTAALSPGMMM

SEQ ID NO: 416072 - protein, 11 aa, Influenza virus
TVYWWDGLQSS

SEQ ID NO: 416073 - protein, 11 aa, Influenza virus
VYWWDGLQSSD

SEQ ID NO: 416074 - protein, 11 aa, Influenza virus
SDDFALILNAP

SEQ ID NO: 416075 - protein, 11 aa, Influenza virus
VQAGVDRFYRT

SEQ ID NO: 416076 - protein, 11 aa, Influenza virus
NRFYRTCKLVG

SEQ ID NO: 416077 - protein, 11 aa, Influenza virus
VNESADMSIGI

SEQ ID NO: 416078 - protein, 11 aa, Influenza virus
ADMSIGVAVIK

SEQ ID NO: 416079 - protein, 11 aa, Influenza virus
DMSIGVAVIKN

SEQ ID NO: 416080 - protein, 11 aa, Influenza virus
MSIGVAVIKNN

SEQ ID NO: 416081 - protein, 11 aa, Influenza virus
SIGVAVIKNNM

SEQ ID NO: 416082 - protein, 11 aa, Influenza virus
IGVTVIKNNMV

SEQ ID NO: 416083 - protein, 11 aa, Influenza virus
GVTVIKNNMVN

SEQ ID NO: 416084 - protein, 11 aa, Influenza virus
AVIKNNMINND

SEQ ID NO: 416085 - protein, 11 aa, Influenza virus
YTYRCHRGDTH

SEQ ID NO: 416086 - protein, 11 aa, Influenza virus
LHIPEVCLKWG

SEQ ID NO: 416087 - protein, 11 aa, Influenza virus
HIPEVCLKWGL

SEQ ID NO: 416088 - protein, 11 aa, Influenza virus
IPEVCLKWGLM

SEQ ID NO: 416089 - protein, 11 aa, Influenza virus
YQGRLCNPMNP

SEQ ID NO: 416090 - protein, 11 aa, Influenza virus
QGRLCNPMNPF

SEQ ID NO: 416091 - protein, 11 aa, Influenza virus
RLCNPMNPFVS

SEQ ID NO: 416092 - protein, 11 aa, Influenza virus
LCNPMNPFVSH

SEQ ID NO: 416093 - protein, 11 aa, Influenza virus
TSQKGILEDEQ

SEQ ID NO: 416094 - protein, 11 aa, Influenza virus
SQKGILEDEQM

SEQ ID NO: 416095 - protein, 11 aa, Influenza virus
GILEDERMYQK

SEQ ID NO: 416096 - protein, 11 aa, Influenza virus
ILEDERMYQKC

SEQ ID NO: 416097 - protein, 11 aa, Influenza virus
EDEQMYQKCCT

SEQ ID NO: 416098 - protein, 11 aa, Influenza virus
DEQMYQKCCTL

SEQ ID NO: 416099 - protein, 11 aa, Influenza virus
EQMYQKCCTLF

SEQ ID NO: 416100 - protein, 11 aa, Influenza virus
MYQKCCTLFEK

SEQ ID NO: 416101 - protein, 11 aa, Influenza virus
YQKCCTLFEKF

SEQ ID NO: 416102 - protein, 11 aa, Influenza virus
QKCCTLFEKFF

SEQ ID NO: 416103 - protein, 11 aa, Influenza virus
KCCTLFEKFFP

SEQ ID NO: 416104 - protein, 11 aa, Influenza virus
YRRPVGISSMM

SEQ ID NO: 416105 - protein, 11 aa, Influenza virus
RRPVGISSMME

SEQ ID NO: 416106 - protein, 11 aa, Influenza virus
RPVGISSMMEA

SEQ ID NO: 416107 - protein, 11 aa, Influenza virus
PVGISSMMEAM

SEQ ID NO: 416108 - protein, 11 aa, Influenza virus
GISSMVEAMIS

SEQ ID NO: 416109 - protein, 11 aa, Influenza virus
ISSMVEAMISR

SEQ ID NO: 416110 - protein, 11 aa, Influenza virus
SSMVEAMISRA

SEQ ID NO: 416111 - protein, 11 aa, Influenza virus
SMVEAMISRAR

SEQ ID NO: 416112 - protein, 11 aa, Influenza virus
MVEAMISRARI

SEQ ID NO: 416113 - protein, 11 aa, Influenza virus
VEAMISRARID

SEQ ID NO: 416114 - protein, 11 aa, Influenza virus
MMSRARIDARI

SEQ ID NO: 416115 - protein, 11 aa, Influenza virus
MSRARIDARID

SEQ ID NO: 416116 - protein, 11 aa, Influenza virus
LMSLSRTREIL

SEQ ID NO: 416117 - protein, 11 aa, Influenza virus
MSLSRTREILT

SEQ ID NO: 416118 - protein, 11 aa, Influenza virus
SRTRGILTKTT

SEQ ID NO: 416119 - protein, 11 aa, Influenza virus
RTRGILTKTTV

SEQ ID NO: 416120 - protein, 11 aa, Influenza virus
TRGILTKTTVD

SEQ ID NO: 416121 - protein, 11 aa, Influenza virus
RGILTKTTVDH

SEQ ID NO: 416122 - protein, 11 aa, Influenza virus
GILTKTTVDHM

SEQ ID NO: 416123 - protein, 11 aa, Influenza virus
LTKTTVDHMAV

SEQ ID NO: 416124 - protein, 11 aa, Influenza virus
TKTTVDHMAVI

SEQ ID NO: 416125 - protein, 11 aa, Influenza virus
KTTVDHMAIIR

SEQ ID NO: 416126 - protein, 11 aa, Influenza virus
MMAMKYPITAN

SEQ ID NO: 416127 - protein, 11 aa, Influenza virus
MVSPLAITWWN

SEQ ID NO: 416128 - protein, 11 aa, Influenza virus
SPLAITWWNRN

SEQ ID NO: 416129 - protein, 11 aa, Influenza virus
PLAITWWNRNG

SEQ ID NO: 416130 - protein, 11 aa, Influenza virus
GTFGPVHFRSQ

SEQ ID NO: 416131 - protein, 11 aa, Influenza virus
FGPVHFRSQVK

SEQ ID NO: 416132 - protein, 11 aa, Influenza virus
GPVHFRSQVKI

SEQ ID NO: 416133 - protein, 11 aa, Influenza virus
PVHFRSQVKIR

SEQ ID NO: 416134 - protein, 11 aa, Influenza virus
VHFRSQVKIRR

SEQ ID NO: 416135 - protein, 11 aa, Influenza virus
HFRSQVKIRRR

SEQ ID NO: 416136 - protein, 11 aa, Influenza virus
QIKIRRRVDIN

SEQ ID NO: 416137 - protein, 11 aa, Influenza virus
IKIRRRVDINP

SEQ ID NO: 416138 - protein, 11 aa, Influenza virus
KIRRRVDMNPG

SEQ ID NO: 416139 - protein, 11 aa, Influenza virus
IRRRVDMNPGH

SEQ ID NO: 416140 - protein, 11 aa, Influenza virus
RRRVDMNPGHA

SEQ ID NO: 416141 - protein, 11 aa, Influenza virus
TKEAQDVIMEV

SEQ ID NO: 416142 - protein, 11 aa, Influenza virus
FPNEVGARILA

SEQ ID NO: 416143 - protein, 11 aa, Influenza virus
NEVGARILASE

SEQ ID NO: 416144 - protein, 11 aa, Influenza virus
EVGARILASES

SEQ ID NO: 416145 - protein, 11 aa, Influenza virus
VGARILASESQ

SEQ ID NO: 416146 - protein, 11 aa, Influenza virus
GARIITSESQL

SEQ ID NO: 416147 - protein, 11 aa, Influenza virus
LVRKTRFLPVV

SEQ ID NO: 416148 - protein, 11 aa, Influenza virus
VRKTRFLPVVG

SEQ ID NO: 416149 - protein, 11 aa, Influenza virus
RKTRFLPVVGG

SEQ ID NO: 416150 - protein, 11 aa, Influenza virus
KTRFLPVVGGT

SEQ ID NO: 416151 - protein, 11 aa, Influenza virus
TRFLPVTGGTS

SEQ ID NO: 416152 - protein, 11 aa, Influenza virus
RFLPVTGGTSS

SEQ ID NO: 416153 - protein, 11 aa, Influenza virus
GGTSSVYVEVL

SEQ ID NO: 416154 - protein, 11 aa, Influenza virus
GTSSVYVEVLH

SEQ ID NO: 416155 - protein, 11 aa, Influenza virus
TSSVYVEVLHL

SEQ ID NO: 416156 - protein, 11 aa, Influenza virus
SSVYVEVLHLT

SEQ ID NO: 416157 - protein, 11 aa, Influenza virus
CWEQMYTPGGK

SEQ ID NO: 416158 - protein, 11 aa, Influenza virus
WEQMYTPGGKV

SEQ ID NO: 416159 - protein, 11 aa, Influenza virus
NDEVDQSLIIA

SEQ ID NO: 416160 - protein, 11 aa, Influenza virus
DEVDQSLIIAA

SEQ ID NO: 416161 - protein, 11 aa, Influenza virus
EVDQSLIIAAR

SEQ ID NO: 416162 - protein, 11 aa, Influenza virus
VDQSLVIAARN

SEQ ID NO: 416163 - protein, 11 aa, Influenza virus
IAARNIVRRAI

SEQ ID NO: 416164 - protein, 11 aa, Influenza virus
AARNIVRRAIV

SEQ ID NO: 416165 - protein, 11 aa, Influenza virus
ARNIVRRAIVS

SEQ ID NO: 416166 - protein, 11 aa, Influenza virus
RNIVRRAIVSA

SEQ ID NO: 416167 - protein, 11 aa, Influenza virus
NIVRRAIVSAD

SEQ ID NO: 416168 - protein, 11 aa, Influenza virus
RRATVSADPLL

SEQ ID NO: 416169 - protein, 11 aa, Influenza virus
RATVSADPLLS

SEQ ID NO: 416170 - protein, 11 aa, Influenza virus
ATVSADPLLSL

SEQ ID NO: 416171 - protein, 11 aa, Influenza virus
LVSLLEMCHST

SEQ ID NO: 416172 - protein, 11 aa, Influenza virus
ASLLEMCHGTQ

SEQ ID NO: 416173 - protein, 11 aa, Influenza virus
LLEMCHSTQVG

SEQ ID NO: 416174 - protein, 11 aa, Influenza virus
LEMCHSTQVGG

SEQ ID NO: 416175 - protein, 11 aa, Influenza virus
DILRQNPSEEQ

SEQ ID NO: 416176 - protein, 11 aa, Influenza virus
ILRQNPSEEQA

SEQ ID NO: 416177 - protein, 11 aa, Influenza virus
QNPTEEQAVEI

SEQ ID NO: 416178 - protein, 11 aa, Influenza virus
NPTEEQAVEIC

SEQ ID NO: 416179 - protein, 11 aa, Influenza virus
PTEEQAVEICK

SEQ ID NO: 416180 - protein, 11 aa, Influenza virus
TEEQAVEICKA

SEQ ID NO: 416181 - protein, 11 aa, Influenza virus
EQAVDICKAAL

SEQ ID NO: 416182 - protein, 11 aa, Influenza virus
QAVDICKAALG

SEQ ID NO: 416183 - protein, 11 aa, Influenza virus
ICKAAMGLKIS

SEQ ID NO: 416184 - protein, 11 aa, Influenza virus
CKAAMGLKISS

SEQ ID NO: 416185 - protein, 11 aa, Influenza virus
KAAMGLKISSS

SEQ ID NO: 416186 - protein, 11 aa, Influenza virus
AAMGLKISSSF

SEQ ID NO: 416187 - protein, 11 aa, Influenza virus
AMGLKISSSFS

SEQ ID NO: 416188 - protein, 11 aa, Influenza virus
MGLKISSSFSF

SEQ ID NO: 416189 - protein, 11 aa, Influenza virus
SFGSFTFKRTS

SEQ ID NO: 416190 - protein, 11 aa, Influenza virus
EEELLTGNLQT

SEQ ID NO: 416191 - protein, 11 aa, Influenza virus
EELLTGNLQTL

SEQ ID NO: 416192 - protein, 11 aa, Influenza virus
EVLTGNLQALK

SEQ ID NO: 416193 - protein, 11 aa, Influenza virus
IVAIVFSQEDC

SEQ ID NO: 416194 - protein, 11 aa, Influenza virus
VAIVFSQEDCM

SEQ ID NO: 416195 - protein, 11 aa, Influenza virus
RMIKAVRGDLN

SEQ ID NO: 416196 - protein, 11 aa, Influenza virus
LLRHFQKNAKV

SEQ ID NO: 416197 - protein, 11 aa, Influenza virus
LRHFQKNAKVL

SEQ ID NO: 416198 - protein, 11 aa, Influenza virus
DRFLRVRDQLG

SEQ ID NO: 416199 - protein, 11 aa, Influenza virus
SPEEVSEAQGT

SEQ ID NO: 416200 - protein, 11 aa, Influenza virus
PEEVSEAQGTE

SEQ ID NO: 416201 - protein, 11 aa, Influenza virus
EKLTIIYSSSM

SEQ ID NO: 416202 - protein, 11 aa, Influenza virus
KLTIIYSSSMM

SEQ ID NO: 416203 - protein, 11 aa, Influenza virus
LTITYSSPMMW

SEQ ID NO: 416204 - protein, 11 aa, Influenza virus
TITYSSPMMWE

SEQ ID NO: 416205 - protein, 11 aa, Influenza virus
IIYSSSMMWEI

SEQ ID NO: 416206 - protein, 11 aa, Influenza virus
IYSSSMMWEIN

SEQ ID NO: 416207 - protein, 11 aa, Influenza virus
YSSPMMWEING

SEQ ID NO: 416208 - protein, 11 aa, Influenza virus
SSPMMWEINGP

SEQ ID NO: 416209 - protein, 11 aa, Influenza virus
SPMMWEINGPE

SEQ ID NO: 416210 - protein, 11 aa, Influenza virus
PMMWEINGPES

SEQ ID NO: 416211 - protein, 11 aa, Influenza virus
MMWEINGPDSV

SEQ ID NO: 416212 - protein, 11 aa, Influenza virus
WEINGPDSVLV

SEQ ID NO: 416213 - protein, 11 aa, Influenza virus
EINGPDSVLVN

SEQ ID NO: 416214 - protein, 11 aa, Influenza virus
INGPDSVLVNT

SEQ ID NO: 416215 - protein, 11 aa, Influenza virus
DSVLVNTYQWI

SEQ ID NO: 416216 - protein, 11 aa, Influenza virus
VLVNTYQWIIK

SEQ ID NO: 416217 - protein, 11 aa, Influenza virus
LVNTYQWIIKN

SEQ ID NO: 416218 - protein, 11 aa, Influenza virus
VNTYQWIIKNW

SEQ ID NO: 416219 - protein, 11 aa, Influenza virus
LYNKLEFEPFQ

SEQ ID NO: 416220 - protein, 11 aa, Influenza virus
YNKLEFEPFQS

SEQ ID NO: 416221 - protein, 11 aa, Influenza virus
NKLEFEPFQSL

SEQ ID NO: 416222 - protein, 11 aa, Influenza virus
KVEFEPFQSLV

SEQ ID NO: 416223 - protein, 11 aa, Influenza virus
VEFEPFQSLVP

SEQ ID NO: 416224 - protein, 11 aa, Influenza virus
QIIKMLPFAAA

SEQ ID NO: 416225 - protein, 11 aa, Influenza virus
IIKMLPFAAAP

SEQ ID NO: 416226 - protein, 11 aa, Influenza virus
KLLPFASAPPE

SEQ ID NO: 416227 - protein, 11 aa, Influenza virus
LLPFASAPPEQ

SEQ ID NO: 416228 - protein, 11 aa, Influenza virus
LPFASAPPEQS

SEQ ID NO: 416229 - protein, 11 aa, Influenza virus
PPVQSKMQFSS

SEQ ID NO: 416230 - protein, 11 aa, Influenza virus
QSRMQFSSLAV

SEQ ID NO: 416231 - protein, 11 aa, Influenza virus
RMQFSSLAVNV

SEQ ID NO: 416232 - protein, 11 aa, Influenza virus
MQFSSFTVNVR

SEQ ID NO: 416233 - protein, 11 aa, Influenza virus
FSSLAVNVRGS

SEQ ID NO: 416234 - protein, 11 aa, Influenza virus
SSLAVNVRGSG

SEQ ID NO: 416235 - protein, 11 aa, Influenza virus
SLTVSVRGSGM

SEQ ID NO: 416236 - protein, 11 aa, Influenza virus
LTVSVRGSGMR

SEQ ID NO: 416237 - protein, 11 aa, Influenza virus
TVSVRGSGMRI

SEQ ID NO: 416238 - protein, 11 aa, Influenza virus
VSVRGSGMRIL

SEQ ID NO: 416239 - protein, 11 aa, Influenza virus
RGTGMRILVRG

SEQ ID NO: 416240 - protein, 11 aa, Influenza virus
GLRILIRGNSP

SEQ ID NO: 416241 - protein, 11 aa, Influenza virus
LIRGNSPIFNY

SEQ ID NO: 416242 - protein, 11 aa, Influenza virus
IRGNSPIFNYN

SEQ ID NO: 416243 - protein, 11 aa, Influenza virus
RGNSPAFNYNK

SEQ ID NO: 416244 - protein, 11 aa, Influenza virus
RRLTVLGKDAG

SEQ ID NO: 416245 - protein, 11 aa, Influenza virus
GGVESAVLRGF

SEQ ID NO: 416246 - protein, 11 aa, Influenza virus
LRGFLILGRED

SEQ ID NO: 416247 - protein, 11 aa, Influenza virus
RGFLILGKENK

SEQ ID NO: 416248 - protein, 11 aa, Influenza virus
ENKKYGPALSI

SEQ ID NO: 416249 - protein, 11 aa, Influenza virus
KRYGPALSISE

SEQ ID NO: 416250 - protein, 11 aa, Influenza virus
IAKGEKANVLI

SEQ ID NO: 416251 - protein, 11 aa, Influenza virus
AKGEKTNVLIG

SEQ ID NO: 416252 - protein, 11 aa, Influenza virus
QTATKRIRLAI

SEQ ID NO: 416253 - protein, 11 aa, Influenza virus
TKRIRMAINWG

SEQ ID NO: 416254 - protein, 11 aa, Influenza virus
EIKMNPNQKIM

SEQ ID NO: 416255 - protein, 11 aa, Influenza virus
IRHLEECSCYV

SEQ ID NO: 416256 - protein, 11 aa, Influenza virus
IKMNPNQKIIT

SEQ ID NO: 416257 - protein, 11 aa, Influenza virus
FECRTFFLTQG

SEQ ID NO: 416258 - protein, 11 aa, Influenza virus
LLNDRHSNGTI

SEQ ID NO: 416259 - protein, 11 aa, Influenza virus
AWSASACHDGV

SEQ ID NO: 416260 - protein, 11 aa, Influenza virus
SWLTIGVSGPD

SEQ ID NO: 416261 - protein, 11 aa, Influenza virus
TIGVSGPDNGA

SEQ ID NO: 416262 - protein, 11 aa, Influenza virus
IGVSGPDNGAV

SEQ ID NO: 416263 - protein, 11 aa, Influenza virus
GVSGPDNGAVA

SEQ ID NO: 416264 - protein, 11 aa, Influenza virus
VSGPDNGAVAV

SEQ ID NO: 416265 - protein, 11 aa, Influenza virus
SGPDNGAVAVV

SEQ ID NO: 416266 - protein, 11 aa, Influenza virus
GPDNGAVAVVK

SEQ ID NO: 416267 - protein, 11 aa, Influenza virus
PDNGAVAVVKY

SEQ ID NO: 416268 - protein, 11 aa, Influenza virus
NGSCFTLMTDG

SEQ ID NO: 416269 - protein, 11 aa, Influenza virus
GFCFTVMTDGP

SEQ ID NO: 416270 - protein, 11 aa, Influenza virus
APNYYYEECSC

SEQ ID NO: 416271 - protein, 11 aa, Influenza virus
PNYYYEECSCY

SEQ ID NO: 416272 - protein, 11 aa, Influenza virus
NYYYEECSCYP

SEQ ID NO: 416273 - protein, 11 aa, Influenza virus
ICSGVFGDTPR

SEQ ID NO: 416274 - protein, 11 aa, Influenza virus
TNWSGYSGSFV

SEQ ID NO: 416275 - protein, 11 aa, Influenza virus
NCIKPCFWVEL

SEQ ID NO: 416276 - protein, 11 aa, Influenza virus
CIKPCFWVELI

SEQ ID NO: 416277 - protein, 11 aa, Influenza virus
IKPCFWVELIR

SEQ ID NO: 416278 - protein, 11 aa, Influenza virus
TIWTSASSISF

SEQ ID NO: 416279 - protein, 11 aa, Influenza virus
IWTSASSISFC

SEQ ID NO: 416280 - protein, 11 aa, Influenza virus
SASSISFCGVN

SEQ ID NO: 416281 - protein, 11 aa, Influenza virus
WSWPDDAELPF

SEQ ID NO: 416282 - protein, 11 aa, Influenza virus
KDNSIQLSAGG

SEQ ID NO: 416283 - protein, 11 aa, Influenza virus
SHRTLLMNELG

SEQ ID NO: 416284 - protein, 11 aa, Influenza virus
YRTLLMNELGI

SEQ ID NO: 416285 - protein, 11 aa, Influenza virus
ELGVPFYLGTK

SEQ ID NO: 416286 - protein, 11 aa, Influenza virus
LGVPFYLGTKQ

SEQ ID NO: 416287 - protein, 11 aa, Influenza virus
GVPFYLGTKQV

SEQ ID NO: 416288 - protein, 11 aa, Influenza virus
VPFYLGTKQVC

SEQ ID NO: 416289 - protein, 11 aa, Influenza virus
KQVCVAWSSSS

SEQ ID NO: 416290 - protein, 11 aa, Influenza virus
QHVEECSCYPS

SEQ ID NO: 416291 - protein, 11 aa, Influenza virus
VKCVCRDNWKG

SEQ ID NO: 416292 - protein, 11 aa, Influenza virus
CSGLVGDTPRE

SEQ ID NO: 416293 - protein, 11 aa, Influenza virus
TANSIIVFCGT

SEQ ID NO: 416294 - protein, 11 aa, Influenza virus
VFCGTSGTYGK

SEQ ID NO: 416295 - protein, 11 aa, Influenza virus
GTSGTYGKGSW

SEQ ID NO: 416296 - protein, 11 aa, Influenza virus
TSGTYGKGSWP

SEQ ID NO: 416297 - protein, 11 aa, Influenza virus
TYGTGSWPDGG

SEQ ID NO: 416298 - protein, 11 aa, Influenza virus
GADIKSHAYIS

SEQ ID NO: 416299 - protein, 11 aa, Influenza virus
IVTREPCVSCD

SEQ ID NO: 416300 - protein, 11 aa, Influenza virus
ITREPYVSCDN

SEQ ID NO: 416301 - protein, 11 aa, Influenza virus
DRTPYRSLIKF

SEQ ID NO: 416302 - protein, 11 aa, Influenza virus
RTPYRSLIKFP

SEQ ID NO: 416303 - protein, 11 aa, Influenza virus
RNILRTQESEC

SEQ ID NO: 416304 - protein, 11 aa, Influenza virus
KIRHLEECSCY

SEQ ID NO: 416305 - protein, 11 aa, Influenza virus
IRHLEECSCYV

SEQ ID NO: 416306 - protein, 11 aa, Influenza virus
QHLEECSCYMD

SEQ ID NO: 416307 - protein, 11 aa, Influenza virus
WKGSNRPWMKI

SEQ ID NO: 416308 - protein, 11 aa, Influenza virus
GSNRPWIRINN

SEQ ID NO: 416309 - protein, 11 aa, Influenza virus
SNRPWIRINNE

SEQ ID NO: 416310 - protein, 11 aa, Influenza virus
NRPWIRINNET

SEQ ID NO: 416311 - protein, 11 aa, Influenza virus
RPWIRINNETI

SEQ ID NO: 416312 - protein, 11 aa, Influenza virus
INNETIVETGY

SEQ ID NO: 416313 - protein, 11 aa, Influenza virus
NNETIVETGYV

SEQ ID NO: 416314 - protein, 11 aa, Influenza virus
ETILETGYVCG

SEQ ID NO: 416315 - protein, 11 aa, Influenza virus
TILETGYVCGK

SEQ ID NO: 416316 - protein, 11 aa, Influenza virus
ILETGYVCGKF

SEQ ID NO: 416317 - protein, 11 aa, Influenza virus
LETGYVCGKFH

SEQ ID NO: 416318 - protein, 11 aa, Influenza virus
KFHSDTPRPTD

SEQ ID NO: 416319 - protein, 11 aa, Influenza virus
FHSDTPRPTDP

SEQ ID NO: 416320 - protein, 11 aa, Influenza virus
HSDTPRPTDPS

SEQ ID NO: 416321 - protein, 11 aa, Influenza virus
NQTLVSNNDWS

SEQ ID NO: 416322 - protein, 11 aa, Influenza virus
DWSGYSGSFVV

SEQ ID NO: 416323 - protein, 11 aa, Influenza virus
WPDGANIGLCP

SEQ ID NO: 416324 - protein, 11 aa, Influenza virus
PNQSIITIGSA

SEQ ID NO: 416325 - protein, 11 aa, Influenza virus
LTTIGPLLQIT

SEQ ID NO: 416326 - protein, 11 aa, Influenza virus
TTIGLLLQIIS

SEQ ID NO: 416327 - protein, 11 aa, Influenza virus
TVGLLLQVTSL

SEQ ID NO: 416328 - protein, 11 aa, Influenza virus
IGPLLQITSLC

SEQ ID NO: 416329 - protein, 11 aa, Influenza virus
WFSHYNQVAQT

SEQ ID NO: 416330 - protein, 11 aa, Influenza virus
VSCSIHECRTF

SEQ ID NO: 416331 - protein, 11 aa, Influenza virus
SCSVSECRTFF

SEQ ID NO: 416332 - protein, 11 aa, Influenza virus
CSVSECRTFFL

SEQ ID NO: 416333 - protein, 11 aa, Influenza virus
SIHECRTFFLT

SEQ ID NO: 416334 - protein, 11 aa, Influenza virus
IHECRTFFLTQ

SEQ ID NO: 416335 - protein, 11 aa, Influenza virus
KILKIKKGKIM

SEQ ID NO: 416336 - protein, 11 aa, Influenza virus
ATGFHLEECSC

SEQ ID NO: 416337 - protein, 11 aa, Influenza virus
IGFHFEECSCY

SEQ ID NO: 416338 - protein, 11 aa, Influenza virus
AFCGVNSNTTG

SEQ ID NO: 416339 - protein, 11 aa, Influenza virus
FCGVNSNTTGW

SEQ ID NO: 416340 - protein, 11 aa, Influenza virus
KIITIGSVSLT

SEQ ID NO: 416341 - protein, 11 aa, Influenza virus
IMTIGSVSLAL

SEQ ID NO: 416342 - protein, 11 aa, Influenza virus
EPLCEVSGFVI

SEQ ID NO: 416343 - protein, 11 aa, Influenza virus
SGFVIVSKDNG

SEQ ID NO: 416344 - protein, 11 aa, Influenza virus
GFVIVSKDNGI

SEQ ID NO: 416345 - protein, 11 aa, Influenza virus
FAIASKDNGIR

SEQ ID NO: 416346 - protein, 11 aa, Influenza virus
IASKDNGIRIG

SEQ ID NO: 416347 - protein, 11 aa, Influenza virus
IREPFVACSPS

SEQ ID NO: 416348 - protein, 11 aa, Influenza virus
REPFVACSPSE

SEQ ID NO: 416349 - protein, 11 aa, Influenza virus
EPFVACSPSEC

SEQ ID NO: 416350 - protein, 11 aa, Influenza virus
PFVACSPSECR

SEQ ID NO: 416351 - protein, 11 aa, Influenza virus
FVACSPSECRT

SEQ ID NO: 416352 - protein, 11 aa, Influenza virus
VACSPSECRTF

SEQ ID NO: 416353 - protein, 11 aa, Influenza virus
ACSPSECRTFF

SEQ ID NO: 416354 - protein, 11 aa, Influenza virus
ATACHDGKKWM

SEQ ID NO: 416355 - protein, 11 aa, Influenza virus
IHYGGVPTDVM

SEQ ID NO: 416356 - protein, 11 aa, Influenza virus
HYGGVPTDVMR

SEQ ID NO: 416357 - protein, 11 aa, Influenza virus
YGGVPTDVMRS

SEQ ID NO: 416358 - protein, 11 aa, Influenza virus
GGIPTDVIRSW

SEQ ID NO: 416359 - protein, 11 aa, Influenza virus
PTDVVRSWRRQ

SEQ ID NO: 416360 - protein, 11 aa, Influenza virus
TDVVRSWRRQI

SEQ ID NO: 416361 - protein, 11 aa, Influenza virus
DVVRSWRRQIL

SEQ ID NO: 416362 - protein, 11 aa, Influenza virus
VVRSWRRQILR

SEQ ID NO: 416363 - protein, 11 aa, Influenza virus
VRSWRRQILRT

SEQ ID NO: 416364 - protein, 11 aa, Influenza virus
DGPANNQASYR

SEQ ID NO: 416365 - protein, 11 aa, Influenza virus
GPANNQASYRI

SEQ ID NO: 416366 - protein, 11 aa, Influenza virus
PANNQASYRIF

SEQ ID NO: 416367 - protein, 11 aa, Influenza virus
ANNQASYRIFK

SEQ ID NO: 416368 - protein, 11 aa, Influenza virus
NNQASYRIFKS

SEQ ID NO: 416369 - protein, 11 aa, Influenza virus
EECSCYPNLCQ

SEQ ID NO: 416370 - protein, 11 aa, Influenza virus
ECSCYPNLGIV

SEQ ID NO: 416371 - protein, 11 aa, Influenza virus
CSCYPNLGIVE

SEQ ID NO: 416372 - protein, 11 aa, Influenza virus
SCYPNLGIVEC

SEQ ID NO: 416373 - protein, 11 aa, Influenza virus
CYPNLGIVECV

SEQ ID NO: 416374 - protein, 11 aa, Influenza virus
YPNLCQVECVC

SEQ ID NO: 416375 - protein, 11 aa, Influenza virus
PNLGIVECVCR

SEQ ID NO: 416376 - protein, 11 aa, Influenza virus
NLCQVECVCRD

SEQ ID NO: 416377 - protein, 11 aa, Influenza virus
LCQVECVCRDN

SEQ ID NO: 416378 - protein, 11 aa, Influenza virus
IPTDTPRFQDS

SEQ ID NO: 416379 - protein, 11 aa, Influenza virus
QGNNVWAGRTV

SEQ ID NO: 416380 - protein, 11 aa, Influenza virus
RSGFEVLFIED

SEQ ID NO: 416381 - protein, 11 aa, Influenza virus
SGFEVLFIEDG

SEQ ID NO: 416382 - protein, 11 aa, Influenza virus
EVLNNKHWSGY

SEQ ID NO: 416383 - protein, 11 aa, Influenza virus
VLDNKNWSGYS

SEQ ID NO: 416384 - protein, 11 aa, Influenza virus
NNKHWSGYSGS

SEQ ID NO: 416385 - protein, 11 aa, Influenza virus
SGYSGAFTIPV

SEQ ID NO: 416386 - protein, 11 aa, Influenza virus
PEERNSIWTSS

SEQ ID NO: 416387 - protein, 11 aa, Influenza virus
EERPSIWTSSS

SEQ ID NO: 416388 - protein, 11 aa, Influenza virus
RPSIWTSSSST

SEQ ID NO: 416389 - protein, 11 aa, Influenza virus
VSSEVPEWSWD

SEQ ID NO: 416390 - protein, 11 aa, Influenza virus
PNQKIICISAA

SEQ ID NO: 416391 - protein, 11 aa, Influenza virus
CISATGMILSV

SEQ ID NO: 416392 - protein, 11 aa, Influenza virus
SLCEVNSWHIL

SEQ ID NO: 416393 - protein, 11 aa, Influenza virus
SKDNAIRIGEG

SEQ ID NO: 416394 - protein, 11 aa, Influenza virus
KDNAIRIGEGA

SEQ ID NO: 416395 - protein, 11 aa, Influenza virus
DNAVRIGEDAH

SEQ ID NO: 416396 - protein, 11 aa, Influenza virus
GAHILVTREPY

SEQ ID NO: 416397 - protein, 11 aa, Influenza virus
LKGRHANGTIH

SEQ ID NO: 416398 - protein, 11 aa, Influenza virus
KGRHANGTIHD

SEQ ID NO: 416399 - protein, 11 aa, Influenza virus
ANGTINDRSPF

SEQ ID NO: 416400 - protein, 11 aa, Influenza virus
NGTINDRSPFR

SEQ ID NO: 416401 - protein, 11 aa, Influenza virus
GTINDRSPFRA

SEQ ID NO: 416402 - protein, 11 aa, Influenza virus
TINDRSPFRAL

SEQ ID NO: 416403 - protein, 11 aa, Influenza virus
NDRSPFRALVS

SEQ ID NO: 416404 - protein, 11 aa, Influenza virus
RSPFRALISWG

SEQ ID NO: 416405 - protein, 11 aa, Influenza virus
SPFRALISWGM

SEQ ID NO: 416406 - protein, 11 aa, Influenza virus
PFRALISWGMG

SEQ ID NO: 416407 - protein, 11 aa, Influenza virus
FRALISWEMGL

SEQ ID NO: 416408 - protein, 11 aa, Influenza virus
RTLISWEMGQA

SEQ ID NO: 416409 - protein, 11 aa, Influenza virus
TLISWEMGQAP

SEQ ID NO: 416410 - protein, 11 aa, Influenza virus
WEMGQAPSPCN

SEQ ID NO: 416411 - protein, 11 aa, Influenza virus
GWSSTSCHDGK

SEQ ID NO: 416412 - protein, 11 aa, Influenza virus
SSTSCHDGKSR

SEQ ID NO: 416413 - protein, 11 aa, Influenza virus
STSCHDGKSRM

SEQ ID NO: 416414 - protein, 11 aa, Influenza virus
TSCHDGKSRMS

SEQ ID NO: 416415 - protein, 11 aa, Influenza virus
RMSICVSGPNN

SEQ ID NO: 416416 - protein, 11 aa, Influenza virus
MSICVSGPNNN

SEQ ID NO: 416417 - protein, 11 aa, Influenza virus
SICVSGPNNNA

SEQ ID NO: 416418 - protein, 11 aa, Influenza virus
IEIPSWAGNIL

SEQ ID NO: 416419 - protein, 11 aa, Influenza virus
PTWAGNILRTQ

SEQ ID NO: 416420 - protein, 11 aa, Influenza virus
CVCHNGTCPVV

SEQ ID NO: 416421 - protein, 11 aa, Influenza virus
YLCSKTLTDTS

SEQ ID NO: 416422 - protein, 11 aa, Influenza virus
LCSKTLTDTSR

SEQ ID NO: 416423 - protein, 11 aa, Influenza virus
CSKTLTDTSRP

SEQ ID NO: 416424 - protein, 11 aa, Influenza virus
PGIKGFAFLDG

SEQ ID NO: 416425 - protein, 11 aa, Influenza virus
DTRSGYEMLKV

SEQ ID NO: 416426 - protein, 11 aa, Influenza virus
TRSGYEMLKVP

SEQ ID NO: 416427 - protein, 11 aa, Influenza virus
RSGYEMLKVPD

SEQ ID NO: 416428 - protein, 11 aa, Influenza virus
SGYEMLKVPDA

SEQ ID NO: 416429 - protein, 11 aa, Influenza virus
GYEMLKVPDAE

SEQ ID NO: 416430 - protein, 11 aa, Influenza virus
NNPNWSGYSGA

SEQ ID NO: 416431 - protein, 11 aa, Influenza virus
WSGYSGAFINY

SEQ ID NO: 416432 - protein, 11 aa, Influenza virus
MNPNQNLFTLS

SEQ ID NO: 416433 - protein, 11 aa, Influenza virus
NPNQKLFALSE

SEQ ID NO: 416434 - protein, 11 aa, Influenza virus
PKSKLFTLSGV

SEQ ID NO: 416435 - protein, 11 aa, Influenza virus
KSKLFTLSGVA

SEQ ID NO: 416436 - protein, 11 aa, Influenza virus
QKLFALSEVAI

SEQ ID NO: 416437 - protein, 11 aa, Influenza virus
NLLIGISNVVL

SEQ ID NO: 416438 - protein, 11 aa, Influenza virus
LLIGISNVVLN

SEQ ID NO: 416439 - protein, 11 aa, Influenza virus
SNVGLNMSLHL

SEQ ID NO: 416440 - protein, 11 aa, Influenza virus
ENTYVNKTTVI

SEQ ID NO: 416441 - protein, 11 aa, Influenza virus
YLMLSKSLCKV

SEQ ID NO: 416442 - protein, 11 aa, Influenza virus
WVVIAQDNAIR

SEQ ID NO: 416443 - protein, 11 aa, Influenza virus
VVIEKDNAVRF

SEQ ID NO: 416444 - protein, 11 aa, Influenza virus
VIEKDNAVRFG

SEQ ID NO: 416445 - protein, 11 aa, Influenza virus
TREPYVSCDPK

SEQ ID NO: 416446 - protein, 11 aa, Influenza virus
TIHDRNAFRGL

SEQ ID NO: 416447 - protein, 11 aa, Influenza virus
DRAAFRGLIST

SEQ ID NO: 416448 - protein, 11 aa, Influenza virus
TFRGLISTPLG

SEQ ID NO: 416449 - protein, 11 aa, Influenza virus
SNSEFLCVGWS

SEQ ID NO: 416450 - protein, 11 aa, Influenza virus
NSEFLCVGWSS

SEQ ID NO: 416451 - protein, 11 aa, Influenza virus
SEFLCVGWSST

SEQ ID NO: 416452 - protein, 11 aa, Influenza virus
CHDGVNRMTIC

SEQ ID NO: 416453 - protein, 11 aa, Influenza virus
QGNNKNATATV

SEQ ID NO: 416454 - protein, 11 aa, Influenza virus
GNNKNATATVY

SEQ ID NO: 416455 - protein, 11 aa, Influenza virus
NNKNATATVYY

SEQ ID NO: 416456 - protein, 11 aa, Influenza virus
NKNATATVYYD

SEQ ID NO: 416457 - protein, 11 aa, Influenza virus
VYYNRRPTTTI

SEQ ID NO: 416458 - protein, 11 aa, Influenza virus
RRLTTTVKTWA

SEQ ID NO: 416459 - protein, 11 aa, Influenza virus
RPTTTIKTWAR

SEQ ID NO: 416460 - protein, 11 aa, Influenza virus
TTTIKPWARNI

SEQ ID NO: 416461 - protein, 11 aa, Influenza virus
TTIKPWARNIL

SEQ ID NO: 416462 - protein, 11 aa, Influenza virus
TIKPWARNILR

SEQ ID NO: 416463 - protein, 11 aa, Influenza virus
IKPWARNILRT

SEQ ID NO: 416464 - protein, 11 aa, Influenza virus
KPWARNILRTQ

SEQ ID NO: 416465 - protein, 11 aa, Influenza virus
PWARNILRTQE

SEQ ID NO: 416466 - protein, 11 aa, Influenza virus
SECVCHNGTCG

SEQ ID NO: 416467 - protein, 11 aa, Influenza virus
LKGSAMHIEEC

SEQ ID NO: 416468 - protein, 11 aa, Influenza virus
VTCICRDNWQG

SEQ ID NO: 416469 - protein, 11 aa, Influenza virus
QGANRPAIEID

SEQ ID NO: 416470 - protein, 11 aa, Influenza virus
TGILTDTSRPS

SEQ ID NO: 416471 - protein, 11 aa, Influenza virus
GILTDTSRPSD

SEQ ID NO: 416472 - protein, 11 aa, Influenza virus
DCSNPITGSPC

SEQ ID NO: 416473 - protein, 11 aa, Influenza virus
APGTKGFGFLN

SEQ ID NO: 416474 - protein, 11 aa, Influenza virus
NTWLGGTISPR

SEQ ID NO: 416475 - protein, 11 aa, Influenza virus
TWLGRTISPHS

SEQ ID NO: 416476 - protein, 11 aa, Influenza virus
WLGRTFSPRSR

SEQ ID NO: 416477 - protein, 11 aa, Influenza virus
TISPHSRSGFE

SEQ ID NO: 416478 - protein, 11 aa, Influenza virus
SPHSRSGFEML

SEQ ID NO: 416479 - protein, 11 aa, Influenza virus
SRSGFEMLKIH

SEQ ID NO: 416480 - protein, 11 aa, Influenza virus
GFEMLRIPNAG

SEQ ID NO: 416481 - protein, 11 aa, Influenza virus
SACYNPCFYVE

SEQ ID NO: 416482 - protein, 11 aa, Influenza virus
NSLIALCGSPV

SEQ ID NO: 416483 - protein, 11 aa, Influenza virus
VGSGSFPDGAR

SEQ ID NO: 416484 - protein, 11 aa, Influenza virus
GSGSFPDGARI

SEQ ID NO: 416485 - protein, 11 aa, Influenza virus
GSLPDGAQIQY

SEQ ID NO: 416486 - protein, 11 aa, Influenza virus
SFPDGAKIQYF

SEQ ID NO: 416487 - protein, 11 aa, Influenza virus
FPNGAQIQYFS

SEQ ID NO: 416488 - protein, 11 aa, Influenza virus
RTFFLTQGSLP

SEQ ID NO: 416489 - protein, 11 aa, Influenza virus
QGSLPNDKHSN

SEQ ID NO: 416490 - protein, 11 aa, Influenza virus
DKHSSGTVKDR

SEQ ID NO: 416491 - protein, 11 aa, Influenza virus
KHSSGTVKDRS

SEQ ID NO: 416492 - protein, 11 aa, Influenza virus
SSGTVKDRSPF

SEQ ID NO: 416493 - protein, 11 aa, Influenza virus
SGTVKDRSPFR

SEQ ID NO: 416494 - protein, 11 aa, Influenza virus
RSPYRTLMSVG

SEQ ID NO: 416495 - protein, 11 aa, Influenza virus
VYQAKFEAVAW

SEQ ID NO: 416496 - protein, 11 aa, Influenza virus
YQAKFEAVAWS

SEQ ID NO: 416497 - protein, 11 aa, Influenza virus
QAKFEAVAWSA

SEQ ID NO: 416498 - protein, 11 aa, Influenza virus
AKFEAVAWSAT

SEQ ID NO: 416499 - protein, 11 aa, Influenza virus
RDILRTQESSC

SEQ ID NO: 416500 - protein, 11 aa, Influenza virus
FTEGHIEECSC

SEQ ID NO: 416501 - protein, 11 aa, Influenza virus
TEGHIEECSCY

SEQ ID NO: 416502 - protein, 11 aa, Influenza virus
NWIGTNRPVLV

SEQ ID NO: 416503 - protein, 11 aa, Influenza virus
WTGTNRPVLMI

SEQ ID NO: 416504 - protein, 11 aa, Influenza virus
LSYSVGYLCAG

SEQ ID NO: 416505 - protein, 11 aa, Influenza virus
PSDTPRGEDGQ

SEQ ID NO: 416506 - protein, 11 aa, Influenza virus
SDTPRGEDGQF

SEQ ID NO: 416507 - protein, 11 aa, Influenza virus
SSSIVMCGVEH

SEQ ID NO: 416508 - protein, 11 aa, Influenza virus
NWSWHDGAILP

SEQ ID NO: 416509 - protein, 11 aa, Influenza virus
PNQRILCTSAT

SEQ ID NO: 416510 - protein, 11 aa, Influenza virus
SQKILCTSATA

SEQ ID NO: 416511 - protein, 11 aa, Influenza virus
QKILFASATAI

SEQ ID NO: 416512 - protein, 11 aa, Influenza virus
FNNLTKGLCII

SEQ ID NO: 416513 - protein, 11 aa, Influenza virus
NNLTRGLCKIN

SEQ ID NO: 416514 - protein, 11 aa, Influenza virus
NLTKELCTINS

SEQ ID NO: 416515 - protein, 11 aa, Influenza virus
LTKGLCIINSW

SEQ ID NO: 416516 - protein, 11 aa, Influenza virus
TKGLCIINSWH

SEQ ID NO: 416517 - protein, 11 aa, Influenza virus
RGLCKINSWHI

SEQ ID NO: 416518 - protein, 11 aa, Influenza virus
GLCKINSWHIF

SEQ ID NO: 416519 - protein, 11 aa, Influenza virus
GKDNAIRIGGN

SEQ ID NO: 416520 - protein, 11 aa, Influenza virus
KDNAIRIGGNS

SEQ ID NO: 416521 - protein, 11 aa, Influenza virus
RIGENSGVLVT

SEQ ID NO: 416522 - protein, 11 aa, Influenza virus
IGEKSDVLVTR

SEQ ID NO: 416523 - protein, 11 aa, Influenza virus
GENSGVLVTRE

SEQ ID NO: 416524 - protein, 11 aa, Influenza virus
KSDVLVTREPY

SEQ ID NO: 416525 - protein, 11 aa, Influenza virus
WSSTSCHDGKT

SEQ ID NO: 416526 - protein, 11 aa, Influenza virus
SSTSCHDGKTR

SEQ ID NO: 416527 - protein, 11 aa, Influenza virus
STSCHDGKTRM

SEQ ID NO: 416528 - protein, 11 aa, Influenza virus
TSCHDGKTRMS

SEQ ID NO: 416529 - protein, 11 aa, Influenza virus
NNNASAIIWYN

SEQ ID NO: 416530 - protein, 11 aa, Influenza virus
QESECVCQNGV

SEQ ID NO: 416531 - protein, 11 aa, Influenza virus
CVCHNGICPVA

SEQ ID NO: 416532 - protein, 11 aa, Influenza virus
VCQNGVCPVVF

SEQ ID NO: 416533 - protein, 11 aa, Influenza virus
CHNGICPVAFT

SEQ ID NO: 416534 - protein, 11 aa, Influenza virus
HNGICPVAFTD

SEQ ID NO: 416535 - protein, 11 aa, Influenza virus
AMKHTSQYICS

SEQ ID NO: 416536 - protein, 11 aa, Influenza virus
LTDNPRPNDPS

SEQ ID NO: 416537 - protein, 11 aa, Influenza virus
CNDPYPGNNNG

SEQ ID NO: 416538 - protein, 11 aa, Influenza virus
NDPYPGNNNGV

SEQ ID NO: 416539 - protein, 11 aa, Influenza virus
DPYPGSNNNGV

SEQ ID NO: 416540 - protein, 11 aa, Influenza virus
GNSNNGVKGFS

SEQ ID NO: 416541 - protein, 11 aa, Influenza virus
GRTINTASRSG

SEQ ID NO: 416542 - protein, 11 aa, Influenza virus
RTISTASRAGY

SEQ ID NO: 416543 - protein, 11 aa, Influenza virus
TLNTASRSGYE

SEQ ID NO: 416544 - protein, 11 aa, Influenza virus
SIASRSGYEIL

SEQ ID NO: 416545 - protein, 11 aa, Influenza virus
LKVPNALTNDR

SEQ ID NO: 416546 - protein, 11 aa, Influenza virus
KVPNALTNDRS

SEQ ID NO: 416547 - protein, 11 aa, Influenza virus
VPNALIDDRSK

SEQ ID NO: 416548 - protein, 11 aa, Influenza virus
PNALTNDRSKP

SEQ ID NO: 416549 - protein, 11 aa, Influenza virus
SGSFIDYWAKE

SEQ ID NO: 416550 - protein, 11 aa, Influenza virus
DYWAKEECYRA

SEQ ID NO: 416551 - protein, 11 aa, Influenza virus
YWAKEECYRAC

SEQ ID NO: 416552 - protein, 11 aa, Influenza virus
WAKEECYRACF

SEQ ID NO: 416553 - protein, 11 aa, Influenza virus
AKEECYRACFY

SEQ ID NO: 416554 - protein, 11 aa, Influenza virus
KEECYRACFYV

SEQ ID NO: 416555 - protein, 11 aa, Influenza virus
DKVWWTSNSII

SEQ ID NO: 416556 - protein, 11 aa, Influenza virus
NWPDGAKIETL

SEQ ID NO: 416557 - protein, 11 aa, Influenza virus
DKICLGHHAVT

SEQ ID NO: 416558 - protein, 11 aa, Influenza virus
KICLGHHAVTN

SEQ ID NO: 416559 - protein, 11 aa, Influenza virus
MEEVTNATETV

SEQ ID NO: 416560 - protein, 11 aa, Influenza virus
RNFPQTTNTYR

SEQ ID NO: 416561 - protein, 11 aa, Influenza virus
QTTNTYRNTDP

SEQ ID NO: 416562 - protein, 11 aa, Influenza virus
YGAQSLSISVG

SEQ ID NO: 416563 - protein, 11 aa, Influenza virus
GAQSLSISVGS

SEQ ID NO: 416564 - protein, 11 aa, Influenza virus
AQSLSISVGSS

SEQ ID NO: 416565 - protein, 11 aa, Influenza virus
ESLSISVGSST

SEQ ID NO: 416566 - protein, 11 aa, Influenza virus
SISVGSSTYHN

SEQ ID NO: 416567 - protein, 11 aa, Influenza virus
VGSSTYHNSFV

SEQ ID NO: 416568 - protein, 11 aa, Influenza virus
STYHNSFVPVV

SEQ ID NO: 416569 - protein, 11 aa, Influenza virus
NNFVPVMGARP

SEQ ID NO: 416570 - protein, 11 aa, Influenza virus
FVPVVGDRPLV

SEQ ID NO: 416571 - protein, 11 aa, Influenza virus
VPVVGARPKVN

SEQ ID NO: 416572 - protein, 11 aa, Influenza virus
PVVGARPKVNG

SEQ ID NO: 416573 - protein, 11 aa, Influenza virus
VVGARPLVNGQ

SEQ ID NO: 416574 - protein, 11 aa, Influenza virus
VNGQSGRINFH

SEQ ID NO: 416575 - protein, 11 aa, Influenza virus
NGQSGRIVFHW

SEQ ID NO: 416576 - protein, 11 aa, Influenza virus
PGDNIIFSHNG

SEQ ID NO: 416577 - protein, 11 aa, Influenza virus
GDNIIFSHNGG

SEQ ID NO: 416578 - protein, 11 aa, Influenza virus
HNGGLIAPTRV

SEQ ID NO: 416579 - protein, 11 aa, Influenza virus
SKCFWKSGSIN

SEQ ID NO: 416580 - protein, 11 aa, Influenza virus
KCFWKSGSINT

SEQ ID NO: 416581 - protein, 11 aa, Influenza virus
SGSINTKLPFQ

SEQ ID NO: 416582 - protein, 11 aa, Influenza virus
GSLLLATGMRN

SEQ ID NO: 416583 - protein, 11 aa, Influenza virus
LAADYKSTQAA

SEQ ID NO: 416584 - protein, 11 aa, Influenza virus
AADYESTQAAI

SEQ ID NO: 416585 - protein, 11 aa, Influenza virus
TIDQVTGKLNR

SEQ ID NO: 416586 - protein, 11 aa, Influenza virus
IVQITGKLNRL

SEQ ID NO: 416587 - protein, 11 aa, Influenza virus
SEFSEIEHQIS

SEQ ID NO: 416588 - protein, 11 aa, Influenza virus
EFNEIEYQIGN

SEQ ID NO: 416589 - protein, 11 aa, Influenza virus
FSEIEHQISNV

SEQ ID NO: 416590 - protein, 11 aa, Influenza virus
SEIEHQISNVI

SEQ ID NO: 416591 - protein, 11 aa, Influenza virus
NCMERIRNNTY

SEQ ID NO: 416592 - protein, 11 aa, Influenza virus
IRNNTYNHTQY

SEQ ID NO: 416593 - protein, 11 aa, Influenza virus
RNNTYNHTQYR

SEQ ID NO: 416594 - protein, 11 aa, Influenza virus
NNTYDHSHYRE

SEQ ID NO: 416595 - protein, 11 aa, Influenza virus
NTYDHSHYREE

SEQ ID NO: 416596 - protein, 11 aa, Influenza virus
EALLNRININP

SEQ ID NO: 416597 - protein, 11 aa, Influenza virus
ALLSRLNINPV

SEQ ID NO: 416598 - protein, 11 aa, Influenza virus
INPVELSSGYK

SEQ ID NO: 416599 - protein, 11 aa, Influenza virus
DKICLGHHAVT

SEQ ID NO: 416600 - protein, 11 aa, Influenza virus
KICLGHHAIPN

SEQ ID NO: 416601 - protein, 11 aa, Influenza virus
LGHHAVANGTV

SEQ ID NO: 416602 - protein, 11 aa, Influenza virus
GTIVKTLTNER

SEQ ID NO: 416603 - protein, 11 aa, Influenza virus
TIIKTLTNEKE

SEQ ID NO: 416604 - protein, 11 aa, Influenza virus
EKEKVTNATET

SEQ ID NO: 416605 - protein, 11 aa, Influenza virus
REEVTNATETV

SEQ ID NO: 416606 - protein, 11 aa, Influenza virus
RDLGNCHPIGM

SEQ ID NO: 416607 - protein, 11 aa, Influenza virus
GAPSCDLHLTG

SEQ ID NO: 416608 - protein, 11 aa, Influenza virus
CDLHLTGIWDT

SEQ ID NO: 416609 - protein, 11 aa, Influenza virus
DLHLTGIWDTL

SEQ ID NO: 416610 - protein, 11 aa, Influenza virus
LHLTGIWDTLI

SEQ ID NO: 416611 - protein, 11 aa, Influenza virus
TGKWDTLIERE

SEQ ID NO: 416612 - protein, 11 aa, Influenza virus
GKWDTLIEREN

SEQ ID NO: 416613 - protein, 11 aa, Influenza virus
ANCYPGATVNE

SEQ ID NO: 416614 - protein, 11 aa, Influenza virus
CYPGSTVNEEA

SEQ ID NO: 416615 - protein, 11 aa, Influenza virus
YPGATVNEGAL

SEQ ID NO: 416616 - protein, 11 aa, Influenza virus
PGSTVNEEALR

SEQ ID NO: 416617 - protein, 11 aa, Influenza virus
GATVNEGALRQ

SEQ ID NO: 416618 - protein, 11 aa, Influenza virus
ATVNEGALRQK

SEQ ID NO: 416619 - protein, 11 aa, Influenza virus
IMESGGIDKVS

SEQ ID NO: 416620 - protein, 11 aa, Influenza virus
MESGGIDKVST

SEQ ID NO: 416621 - protein, 11 aa, Influenza virus
YAELKWLVSKD

SEQ ID NO: 416622 - protein, 11 aa, Influenza virus
AELKWLVSKDK

SEQ ID NO: 416623 - protein, 11 aa, Influenza virus
ELKWLVSKDKG

SEQ ID NO: 416624 - protein, 11 aa, Influenza virus
LKWLISKSKEQ

SEQ ID NO: 416625 - protein, 11 aa, Influenza virus
QSFPQTTNTYR

SEQ ID NO: 416626 - protein, 11 aa, Influenza virus
QTTNTYRNTDP

SEQ ID NO: 416627 - protein, 11 aa, Influenza virus
EHIIMWGIHHP

SEQ ID NO: 416628 - protein, 11 aa, Influenza virus
HLVMWGIHHPS

SEQ ID NO: 416629 - protein, 11 aa, Influenza virus
LVMWGIHHPSS

SEQ ID NO: 416630 - protein, 11 aa, Influenza virus
HHPSSTQERND

SEQ ID NO: 416631 - protein, 11 aa, Influenza virus
HPSSTQEKNAL

SEQ ID NO: 416632 - protein, 11 aa, Influenza virus
PSSTQERNDLY

SEQ ID NO: 416633 - protein, 11 aa, Influenza virus
SSTQEKNALYG

SEQ ID NO: 416634 - protein, 11 aa, Influenza virus
EKNDLYGAQSL

SEQ ID NO: 416635 - protein, 11 aa, Influenza virus
KNALYGTQSLS

SEQ ID NO: 416636 - protein, 11 aa, Influenza virus
ISVGSSTYHNS

SEQ ID NO: 416637 - protein, 11 aa, Influenza virus
SVGSSTYHNSF

SEQ ID NO: 416638 - protein, 11 aa, Influenza virus
VGSSIYQNSFV

SEQ ID NO: 416639 - protein, 11 aa, Influenza virus
VQPGDNITFSD

SEQ ID NO: 416640 - protein, 11 aa, Influenza virus
RSLMLATGMRN

SEQ ID NO: 416641 - protein, 11 aa, Influenza virus
AADYKSTQATI

SEQ ID NO: 416642 - protein, 11 aa, Influenza virus
YKSTQATIDQI

SEQ ID NO: 416643 - protein, 11 aa, Influenza virus
KSTQATIDQIT

SEQ ID NO: 416644 - protein, 11 aa, Influenza virus
DGKGCFEIYHN

SEQ ID NO: 416645 - protein, 11 aa, Influenza virus
GRGCFEIYHKC

SEQ ID NO: 416646 - protein, 11 aa, Influenza virus
DNCMESIRDNT

SEQ ID NO: 416647 - protein, 11 aa, Influenza virus
LLSRLNINPVK

SEQ ID NO: 416648 - protein, 11 aa, Influenza virus
LSRLNINPVKL

SEQ ID NO: 416649 - protein, 11 aa, Influenza virus
SRLNINPVKLS

SEQ ID NO: 416650 - protein, 11 aa, Influenza virus
FGASCFVLLAI

SEQ ID NO: 416651 - protein, 11 aa, Influenza virus
IVGLVFFCLKN

SEQ ID NO: 416652 - protein, 11 aa, Influenza virus
NLFTLSGVAIA

SEQ ID NO: 416653 - protein, 11 aa, Influenza virus
LFALSGVAITL

SEQ ID NO: 416654 - protein, 11 aa, Influenza virus
EKGPKQEENST

SEQ ID NO: 416655 - protein, 11 aa, Influenza virus
NQNNTTVVENK

SEQ ID NO: 416656 - protein, 11 aa, Influenza virus
YLMLSKSLCKV

SEQ ID NO: 416657 - protein, 11 aa, Influenza virus
LMLSKSLCKVE

SEQ ID NO: 416658 - protein, 11 aa, Influenza virus
LNKSLCKVEEW

SEQ ID NO: 416659 - protein, 11 aa, Influenza virus
NKRLCKVEGWV

SEQ ID NO: 416660 - protein, 11 aa, Influenza virus
YVSCDPLGCKT

SEQ ID NO: 416661 - protein, 11 aa, Influenza virus
VSCDPLGCKTY

SEQ ID NO: 416662 - protein, 11 aa, Influenza virus
SCDPIGCKMYA

SEQ ID NO: 416663 - protein, 11 aa, Influenza virus
CDPLGCKTYAL

SEQ ID NO: 416664 - protein, 11 aa, Influenza virus
DPLGCKTYALH

SEQ ID NO: 416665 - protein, 11 aa, Influenza virus
PIGCKMYALHQ

SEQ ID NO: 416666 - protein, 11 aa, Influenza virus
IGCKMYALHQG

SEQ ID NO: 416667 - protein, 11 aa, Influenza virus
LMSTPLGTPPT

SEQ ID NO: 416668 - protein, 11 aa, Influenza virus
MSTPLGTPPTV

SEQ ID NO: 416669 - protein, 11 aa, Influenza virus
LGSPPMVSNSD

SEQ ID NO: 416670 - protein, 11 aa, Influenza virus
GSPPMVSNSDF

SEQ ID NO: 416671 - protein, 11 aa, Influenza virus
DFICVGWSSTT

SEQ ID NO: 416672 - protein, 11 aa, Influenza virus
IGRMTICVQGK

SEQ ID NO: 416673 - protein, 11 aa, Influenza virus
RMIICIQGNND

SEQ ID NO: 416674 - protein, 11 aa, Influenza virus
MTICVQGKNDN

SEQ ID NO: 416675 - protein, 11 aa, Influenza virus
TICVQGKNDNA

SEQ ID NO: 416676 - protein, 11 aa, Influenza virus
NNATATVYYER

SEQ ID NO: 416677 - protein, 11 aa, Influenza virus
YNRRPTTTIKT

SEQ ID NO: 416678 - protein, 11 aa, Influenza virus
NGRLTTTIKTW

SEQ ID NO: 416679 - protein, 11 aa, Influenza virus
CVVIMTDGPAN

SEQ ID NO: 416680 - protein, 11 aa, Influenza virus
VIMTDGPASSQ

SEQ ID NO: 416681 - protein, 11 aa, Influenza virus
IMTDGPASSQA

SEQ ID NO: 416682 - protein, 11 aa, Influenza virus
MTDGPASSQAY

SEQ ID NO: 416683 - protein, 11 aa, Influenza virus
TDGPASSQAYT

SEQ ID NO: 416684 - protein, 11 aa, Influenza virus
DGPANSQAYTK

SEQ ID NO: 416685 - protein, 11 aa, Influenza virus
QAHTKILYFHK

SEQ ID NO: 416686 - protein, 11 aa, Influenza virus
AYTKILYFHKG

SEQ ID NO: 416687 - protein, 11 aa, Influenza virus
YFHKGLLIKEE

SEQ ID NO: 416688 - protein, 11 aa, Influenza virus
KEETLKGSARH

SEQ ID NO: 416689 - protein, 11 aa, Influenza virus
IEECPCYGHNS

SEQ ID NO: 416690 - protein, 11 aa, Influenza virus
QGANRPAIEID

SEQ ID NO: 416691 - protein, 11 aa, Influenza virus
GANRPIIEINM

SEQ ID NO: 416692 - protein, 11 aa, Influenza virus
AMKHTSQYLCT

SEQ ID NO: 416693 - protein, 11 aa, Influenza virus
DHTSQYLCTGV

SEQ ID NO: 416694 - protein, 11 aa, Influenza virus
VLTDTSKPSDK

SEQ ID NO: 416695 - protein, 11 aa, Influenza virus
LKIPNAGIDPN

SEQ ID NO: 416696 - protein, 11 aa, Influenza virus
KIPNAGIDPNS

SEQ ID NO: 416697 - protein, 11 aa, Influenza virus
NNNLSGYSGSF

SEQ ID NO: 416698 - protein, 11 aa, Influenza virus
RNWSGYSGSFI

SEQ ID NO: 416699 - protein, 11 aa, Influenza virus
SACYNPCFYVE

SEQ ID NO: 416700 - protein, 11 aa, Influenza virus
SLIALCGSPFS

SEQ ID NO: 416701 - protein, 11 aa, Influenza virus
LIALCGSPFSV

SEQ ID NO: 416702 - protein, 11 aa, Influenza virus
IALCGSPFSVG

SEQ ID NO: 416703 - protein, 11 aa, Influenza virus
PFSVGSGSFPD

SEQ ID NO: 416704 - protein, 11 aa, Influenza virus
FSVGSGSFPDG

SEQ ID NO: 416705 - protein, 11 aa, Influenza virus
MSNNSTEKVDT

SEQ ID NO: 416706 - protein, 11 aa, Influenza virus
STEKVNTIIES

SEQ ID NO: 416707 - protein, 11 aa, Influenza virus
TEKVDTIIENN

SEQ ID NO: 416708 - protein, 11 aa, Influenza virus
KVDTIIESNIT

SEQ ID NO: 416709 - protein, 11 aa, Influenza virus
HTGTFCSINGK

SEQ ID NO: 416710 - protein, 11 aa, Influenza virus
FCSINGKEPIS

SEQ ID NO: 416711 - protein, 11 aa, Influenza virus
CSINGKEPISL

SEQ ID NO: 416712 - protein, 11 aa, Influenza virus
SLDGKAPISLG

SEQ ID NO: 416713 - protein, 11 aa, Influenza virus
NGRAPISLGDC

SEQ ID NO: 416714 - protein, 11 aa, Influenza virus
GWILGNPMCDY

SEQ ID NO: 416715 - protein, 11 aa, Influenza virus
WILGNPMCDNL

SEQ ID NO: 416716 - protein, 11 aa, Influenza virus
ILGNPMCDNLI

SEQ ID NO: 416717 - protein, 11 aa, Influenza virus
LGNPMCDYLIG

SEQ ID NO: 416718 - protein, 11 aa, Influenza virus
GNPMCDYLIGK

SEQ ID NO: 416719 - protein, 11 aa, Influenza virus
CDDLIGKNSWS

SEQ ID NO: 416720 - protein, 11 aa, Influenza virus
DDLIEKTSWSY

SEQ ID NO: 416721 - protein, 11 aa, Influenza virus
DLIGKNSWSYI

SEQ ID NO: 416722 - protein, 11 aa, Influenza virus
KTSWSYIVERP

SEQ ID NO: 416723 - protein, 11 aa, Influenza virus
TSWSYIVEKSN

SEQ ID NO: 416724 - protein, 11 aa, Influenza virus
QAGRMTFYWII

SEQ ID NO: 416725 - protein, 11 aa, Influenza virus
TFESNGVFLAP

SEQ ID NO: 416726 - protein, 11 aa, Influenza virus
FESNGAFLAPG

SEQ ID NO: 416727 - protein, 11 aa, Influenza virus
ESNGVFLAPRY

SEQ ID NO: 416728 - protein, 11 aa, Influenza virus
NVHRNTIGNCP

SEQ ID NO: 416729 - protein, 11 aa, Influenza virus
RSTIGDCPKYV

SEQ ID NO: 416730 - protein, 11 aa, Influenza virus
STIGDCPKYVN

SEQ ID NO: 416731 - protein, 11 aa, Influenza virus
TFGDCPKYVNV

SEQ ID NO: 416732 - protein, 11 aa, Influenza virus
FGDCPKYVNVK

SEQ ID NO: 416733 - protein, 11 aa, Influenza virus
KSLKLAIGPRN

SEQ ID NO: 416734 - protein, 11 aa, Influenza virus
SLKLVTGLRNV

SEQ ID NO: 416735 - protein, 11 aa, Influenza virus
LKLVTGLRNVP

SEQ ID NO: 416736 - protein, 11 aa, Influenza virus
KLAIGPRNVPA

SEQ ID NO: 416737 - protein, 11 aa, Influenza virus
GVAADKESTQK

SEQ ID NO: 416738 - protein, 11 aa, Influenza virus
LQDNAKDEGNG

SEQ ID NO: 416739 - protein, 11 aa, Influenza virus
QDNAKDEGNGC

SEQ ID NO: 416740 - protein, 11 aa, Influenza virus
FYHRCDNECIE

SEQ ID NO: 416741 - protein, 11 aa, Influenza virus
NECIEKIRNGT

SEQ ID NO: 416742 - protein, 11 aa, Influenza virus
YDHKEFEKESR

SEQ ID NO: 416743 - protein, 11 aa, Influenza virus
ESKLNRQEIGG

SEQ ID NO: 416744 - protein, 11 aa, Influenza virus
INRQEIEGARL

SEQ ID NO: 416745 - protein, 11 aa, Influenza virus
NRQEIEGARLD

SEQ ID NO: 416746 - protein, 11 aa, Influenza virus
CIASSLILAAL

SEQ ID NO: 416747 - protein, 11 aa, Influenza virus
ASSLVLAALNM

SEQ ID NO: 416748 - protein, 11 aa, Influenza virus
SSLILAALIMG

SEQ ID NO: 416749 - protein, 11 aa, Influenza virus
WVCSNGSCRCT

SEQ ID NO: 416750 - protein, 11 aa, Influenza virus
ACGNGSCRCTI

SEQ ID NO: 416751 - protein, 11 aa, Influenza virus
NNSTDTVNTLT

SEQ ID NO: 416752 - protein, 11 aa, Influenza virus
NSTDTVNTLTE

SEQ ID NO: 416753 - protein, 11 aa, Influenza virus
STDTVNTLTEQ

SEQ ID NO: 416754 - protein, 11 aa, Influenza virus
TDTVNTLTEQN

SEQ ID NO: 416755 - protein, 11 aa, Influenza virus
QVEELVHGGIN

SEQ ID NO: 416756 - protein, 11 aa, Influenza virus
VEELVHGGINP

SEQ ID NO: 416757 - protein, 11 aa, Influenza virus
DDCSLEGLILS

SEQ ID NO: 416758 - protein, 11 aa, Influenza virus
DCSLEGLILSN

SEQ ID NO: 416759 - protein, 11 aa, Influenza virus
CSLKGLILGNP

SEQ ID NO: 416760 - protein, 11 aa, Influenza virus
SLEGLILSNPK

SEQ ID NO: 416761 - protein, 11 aa, Influenza virus
LEGLILSNPKC

SEQ ID NO: 416762 - protein, 11 aa, Influenza virus
EGLVLGNPKCD

SEQ ID NO: 416763 - protein, 11 aa, Influenza virus
GLILSNPKCDL

SEQ ID NO: 416764 - protein, 11 aa, Influenza virus
LVLGNPKCDLY

SEQ ID NO: 416765 - protein, 11 aa, Influenza virus
IEGICYPGSIE

SEQ ID NO: 416766 - protein, 11 aa, Influenza virus
GSIKNQEELRS

SEQ ID NO: 416767 - protein, 11 aa, Influenza virus
SVENQEELRSL

SEQ ID NO: 416768 - protein, 11 aa, Influenza virus
VENQEELRSLF

SEQ ID NO: 416769 - protein, 11 aa, Influenza virus
FTKWNVTHTGT

SEQ ID NO: 416770 - protein, 11 aa, Influenza virus
TKWNVTHTGTS

SEQ ID NO: 416771 - protein, 11 aa, Influenza virus
SNQDSFYRSMK

SEQ ID NO: 416772 - protein, 11 aa, Influenza virus
NQDSFYRSMKW

SEQ ID NO: 416773 - protein, 11 aa, Influenza virus
QDSFYRSMKWL

SEQ ID NO: 416774 - protein, 11 aa, Influenza virus
YRSMKWLTLKS

SEQ ID NO: 416775 - protein, 11 aa, Influenza virus
MKWLTLKSGQF

SEQ ID NO: 416776 - protein, 11 aa, Influenza virus
IHHPPTSAEQV

SEQ ID NO: 416777 - protein, 11 aa, Influenza virus
EIDRSFRPNIG

SEQ ID NO: 416778 - protein, 11 aa, Influenza virus
INRNFKPNIGP

SEQ ID NO: 416779 - protein, 11 aa, Influenza virus
DRSFRPNIGPR

SEQ ID NO: 416780 - protein, 11 aa, Influenza virus
NFKPNIGPRPF

SEQ ID NO: 416781 - protein, 11 aa, Influenza virus
KPNIGPRPLVM

SEQ ID NO: 416782 - protein, 11 aa, Influenza virus
PNIGPRPLIRG

SEQ ID NO: 416783 - protein, 11 aa, Influenza virus
NIGPRPLVMGQ

SEQ ID NO: 416784 - protein, 11 aa, Influenza virus
IGPRPLIRGQQ

SEQ ID NO: 416785 - protein, 11 aa, Influenza virus
GPRPLVMGQQG

SEQ ID NO: 416786 - protein, 11 aa, Influenza virus
PRPLIRGQQGR

SEQ ID NO: 416787 - protein, 11 aa, Influenza virus
RPLIRGQQGRM

SEQ ID NO: 416788 - protein, 11 aa, Influenza virus
PLIRGQQGRMD

SEQ ID NO: 416789 - protein, 11 aa, Influenza virus
LVMGQQGRMDY

SEQ ID NO: 416790 - protein, 11 aa, Influenza virus
YLITGKSHGRI

SEQ ID NO: 416791 - protein, 11 aa, Influenza virus
TECQLNEGIMN

SEQ ID NO: 416792 - protein, 11 aa, Influenza virus
ECQLNEGIMNT

SEQ ID NO: 416793 - protein, 11 aa, Influenza virus
VINTSKPFQNT

SEQ ID NO: 416794 - protein, 11 aa, Influenza virus
IGKCPKYIPSR

SEQ ID NO: 416795 - protein, 11 aa, Influenza virus
GKCPKYIPSRS

SEQ ID NO: 416796 - protein, 11 aa, Influenza virus
KCPKYISSGSL

SEQ ID NO: 416797 - protein, 11 aa, Influenza virus
CPKYIPSRSLK

SEQ ID NO: 416798 - protein, 11 aa, Influenza virus
PKYIPSRSLKL

SEQ ID NO: 416799 - protein, 11 aa, Influenza virus
KYISSGSLKLA

SEQ ID NO: 416800 - protein, 11 aa, Influenza virus
PSRSLKLAIGL

SEQ ID NO: 416801 - protein, 11 aa, Influenza virus
LAIGLRNVPQI

SEQ ID NO: 416802 - protein, 11 aa, Influenza virus
AIGLRNVPQIQ

SEQ ID NO: 416803 - protein, 11 aa, Influenza virus
RNVPQIQNRGL

SEQ ID NO: 416804 - protein, 11 aa, Influenza virus
NVPQIQNRGLF

SEQ ID NO: 416805 - protein, 11 aa, Influenza virus
VPQIQNRGLFG

SEQ ID NO: 416806 - protein, 11 aa, Influenza virus
PQIQNRGLFGA

SEQ ID NO: 416807 - protein, 11 aa, Influenza virus
QHQNAEGIGIA

SEQ ID NO: 416808 - protein, 11 aa, Influenza virus
HQNAEGIGIAA

SEQ ID NO: 416809 - protein, 11 aa, Influenza virus
QNSEGTGIVAD

SEQ ID NO: 416810 - protein, 11 aa, Influenza virus
NAEGIGIAADR

SEQ ID NO: 416811 - protein, 11 aa, Influenza virus
EGTGIAADRGS

SEQ ID NO: 416812 - protein, 11 aa, Influenza virus
GIGIAADRDST

SEQ ID NO: 416813 - protein, 11 aa, Influenza virus
TGIAADRGSTQ

SEQ ID NO: 416814 - protein, 11 aa, Influenza virus
AADRGSTQKAI

SEQ ID NO: 416815 - protein, 11 aa, Influenza virus
DRDSTQKAIDI

SEQ ID NO: 416816 - protein, 11 aa, Influenza virus
RGSTQKAIDNM

SEQ ID NO: 416817 - protein, 11 aa, Influenza virus
DSTQKAIDIMQ

SEQ ID NO: 416818 - protein, 11 aa, Influenza virus
TQKAIDIMQNK

SEQ ID NO: 416819 - protein, 11 aa, Influenza virus
QKAIDNMQNRL

SEQ ID NO: 416820 - protein, 11 aa, Influenza virus
KAIDNMQNRLN

SEQ ID NO: 416821 - protein, 11 aa, Influenza virus
RINMINSKIED

SEQ ID NO: 416822 - protein, 11 aa, Influenza virus
INTINSKIDDQ

SEQ ID NO: 416823 - protein, 11 aa, Influenza virus
INDQITDIWAY

SEQ ID NO: 416824 - protein, 11 aa, Influenza virus
EDQITDIWAYN

SEQ ID NO: 416825 - protein, 11 aa, Influenza virus
ANVRNLHDRTR

SEQ ID NO: 416826 - protein, 11 aa, Influenza virus
NVRNLHERIRR

SEQ ID NO: 416827 - protein, 11 aa, Influenza virus
ENAIDNGDGCF

SEQ ID NO: 416828 - protein, 11 aa, Influenza virus
NAIDNGDGCFE

SEQ ID NO: 416829 - protein, 11 aa, Influenza virus
AIDNGDGCFEI

SEQ ID NO: 416830 - protein, 11 aa, Influenza virus
IDNGDGCFEIL

SEQ ID NO: 416831 - protein, 11 aa, Influenza virus
GCFEILHKCND

SEQ ID NO: 416832 - protein, 11 aa, Influenza virus
YEEESRIERQK

SEQ ID NO: 416833 - protein, 11 aa, Influenza virus
IGYLSTNSSER

SEQ ID NO: 416834 - protein, 11 aa, Influenza virus
YLSTNSSEKVN

SEQ ID NO: 416835 - protein, 11 aa, Influenza virus
LSTNSSEKVNT

SEQ ID NO: 416836 - protein, 11 aa, Influenza virus
STNSSDKVDTL

SEQ ID NO: 416837 - protein, 11 aa, Influenza virus
TNSSEKVNTLL

SEQ ID NO: 416838 - protein, 11 aa, Influenza virus
NSSEKVNTLLE

SEQ ID NO: 416839 - protein, 11 aa, Influenza virus
VDTLLESDVPV

SEQ ID NO: 416840 - protein, 11 aa, Influenza virus
DTLLESDVPVT

SEQ ID NO: 416841 - protein, 11 aa, Influenza virus
LLESDVPVTSS

SEQ ID NO: 416842 - protein, 11 aa, Influenza virus
VPVTSTIDLIE

SEQ ID NO: 416843 - protein, 11 aa, Influenza virus
PVTSTIDLIET

SEQ ID NO: 416844 - protein, 11 aa, Influenza virus
NFEGWIVGNPA

SEQ ID NO: 416845 - protein, 11 aa, Influenza virus
YLIEDPSAPHR

SEQ ID NO: 416846 - protein, 11 aa, Influenza virus
LIEDPSAPHRL

SEQ ID NO: 416847 - protein, 11 aa, Influenza virus
IEDPSAPHRLC

SEQ ID NO: 416848 - protein, 11 aa, Influenza virus
EDPSAPHRLCY

SEQ ID NO: 416849 - protein, 11 aa, Influenza virus
DPSAPHRLCYP

SEQ ID NO: 416850 - protein, 11 aa, Influenza virus
PSAPHRLCYPG

SEQ ID NO: 416851 - protein, 11 aa, Influenza virus
SAPHRLCYPGE

SEQ ID NO: 416852 - protein, 11 aa, Influenza virus
GVYNNTTGRDV

SEQ ID NO: 416853 - protein, 11 aa, Influenza virus
PYTLVSTRSWS

SEQ ID NO: 416854 - protein, 11 aa, Influenza virus
GVRPRYNGQRS

SEQ ID NO: 416855 - protein, 11 aa, Influenza virus
VRPRYNGQRSW

SEQ ID NO: 416856 - protein, 11 aa, Influenza virus
GKGRIFQSRII

SEQ ID NO: 416857 - protein, 11 aa, Influenza virus
FQNIDKNALGE

SEQ ID NO: 416858 - protein, 11 aa, Influenza virus
QNIDKNALGEC

SEQ ID NO: 416859 - protein, 11 aa, Influenza virus
NIDKNALGECP

SEQ ID NO: 416860 - protein, 11 aa, Influenza virus
IDRNALGDCPK

SEQ ID NO: 416861 - protein, 11 aa, Influenza virus
DRNALGDCPKY

SEQ ID NO: 416862 - protein, 11 aa, Influenza virus
KLATGLKNVPA

SEQ ID NO: 416863 - protein, 11 aa, Influenza virus
QNEQGMGMAAD

SEQ ID NO: 416864 - protein, 11 aa, Influenza virus
NEQGMGMAADK

SEQ ID NO: 416865 - protein, 11 aa, Influenza virus
EQGMGMAADKE

SEQ ID NO: 416866 - protein, 11 aa, Influenza virus
QGMGMAADKES

SEQ ID NO: 416867 - protein, 11 aa, Influenza virus
GMGMAADKEST

SEQ ID NO: 416868 - protein, 11 aa, Influenza virus
MGMAADKESTQ

SEQ ID NO: 416869 - protein, 11 aa, Influenza virus
SIRGEFNQVEQ

SEQ ID NO: 416870 - protein, 11 aa, Influenza virus
IRGEFNQVEQR

SEQ ID NO: 416871 - protein, 11 aa, Influenza virus
RGEFNQVEQRI

SEQ ID NO: 416872 - protein, 11 aa, Influenza virus
GEFNQVEQRIN

SEQ ID NO: 416873 - protein, 11 aa, Influenza virus
EFNQVEQRINM

SEQ ID NO: 416874 - protein, 11 aa, Influenza virus
FNQVEQRINML

SEQ ID NO: 416875 - protein, 11 aa, Influenza virus
NQVEQRINMLA

SEQ ID NO: 416876 - protein, 11 aa, Influenza virus
DANVRNLHEQI

SEQ ID NO: 416877 - protein, 11 aa, Influenza virus
ANVRNLHEQIK

SEQ ID NO: 416878 - protein, 11 aa, Influenza virus
KRQEIEGIKLE

SEQ ID NO: 416879 - protein, 11 aa, Influenza virus
RQEIEGIRLKS

SEQ ID NO: 416880 - protein, 11 aa, Influenza virus
SEDNVYRALSI

SEQ ID NO: 416881 - protein, 11 aa, Influenza virus
EDNVYRALSIY

SEQ ID NO: 416882 - protein, 11 aa, Influenza virus
VLVGLILTFIM

SEQ ID NO: 416883 - protein, 11 aa, Influenza virus
LVGLILTFIMW

SEQ ID NO: 416884 - protein, 11 aa, Influenza virus
VGLILTFIMWA

SEQ ID NO: 416885 - protein, 11 aa, Influenza virus
GPILSFIMWAG

SEQ ID NO: 416886 - protein, 11 aa, Influenza virus
FIMWACSNGNC

SEQ ID NO: 416887 - protein, 11 aa, Influenza virus
IMWACSNGNCR

SEQ ID NO: 416888 - protein, 11 aa, Influenza virus
MWACSNGNCRF

SEQ ID NO: 416889 - protein, 11 aa, Influenza virus
SRYSKADKICI

SEQ ID NO: 416890 - protein, 11 aa, Influenza virus
GYLSNNATDTV

SEQ ID NO: 416891 - protein, 11 aa, Influenza virus
YLSNNATDTVD

SEQ ID NO: 416892 - protein, 11 aa, Influenza virus
LSNNATDTVDT

SEQ ID NO: 416893 - protein, 11 aa, Influenza virus
SNNATDTVDTL

SEQ ID NO: 416894 - protein, 11 aa, Influenza virus
NNATDTVDTLT

SEQ ID NO: 416895 - protein, 11 aa, Influenza virus
NATDTVDTLTE

SEQ ID NO: 416896 - protein, 11 aa, Influenza virus
TDKVDTLTETG

SEQ ID NO: 416897 - protein, 11 aa, Influenza virus
EDPNAPNKFCY

SEQ ID NO: 416898 - protein, 11 aa, Influenza virus
DPNAPNKFCYP

SEQ ID NO: 416899 - protein, 11 aa, Influenza virus
PNAPNKFCYPG

SEQ ID NO: 416900 - protein, 11 aa, Influenza virus
NAPNKFCYPGE

SEQ ID NO: 416901 - protein, 11 aa, Influenza virus
KFCYPGELDNN

SEQ ID NO: 416902 - protein, 11 aa, Influenza virus
FCYPGELDNNG

SEQ ID NO: 416903 - protein, 11 aa, Influenza virus
SFSRTELISPN

SEQ ID NO: 416904 - protein, 11 aa, Influenza virus
FSRTELISPNK

SEQ ID NO: 416905 - protein, 11 aa, Influenza virus
SRTELISPNKW

SEQ ID NO: 416906 - protein, 11 aa, Influenza virus
RTELISPNKWG

SEQ ID NO: 416907 - protein, 11 aa, Influenza virus
PNKWGDILDGV

SEQ ID NO: 416908 - protein, 11 aa, Influenza virus
NKWGDILDGVT

SEQ ID NO: 416909 - protein, 11 aa, Influenza virus
GVTASCRDNGA

SEQ ID NO: 416910 - protein, 11 aa, Influenza virus
SFYRNLIWLVQ

SEQ ID NO: 416911 - protein, 11 aa, Influenza virus
WGIHHPDTEAV

SEQ ID NO: 416912 - protein, 11 aa, Influenza virus
GIHHPDTEAVA

SEQ ID NO: 416913 - protein, 11 aa, Influenza virus
ATRLYVNKNPY

SEQ ID NO: 416914 - protein, 11 aa, Influenza virus
INLYASKNPYT

SEQ ID NO: 416915 - protein, 11 aa, Influenza virus
TFESNGGLIAP

SEQ ID NO: 416916 - protein, 11 aa, Influenza virus
GRIFQSRIRMG

SEQ ID NO: 416917 - protein, 11 aa, Influenza virus
RVARCNTKCQT

SEQ ID NO: 416918 - protein, 11 aa, Influenza virus
VARCNTKCQTS

SEQ ID NO: 416919 - protein, 11 aa, Influenza virus
RCNTKCQTSVG

SEQ ID NO: 416920 - protein, 11 aa, Influenza virus
NTKCQTSLGGV

SEQ ID NO: 416921 - protein, 11 aa, Influenza virus
DERGLFGAIAG

SEQ ID NO: 416922 - protein, 11 aa, Influenza virus
ADKVSTQKALN

SEQ ID NO: 416923 - protein, 11 aa, Influenza virus
DKVSTQKALNE

SEQ ID NO: 416924 - protein, 11 aa, Influenza virus
KVSTQKALNEI

SEQ ID NO: 416925 - protein, 11 aa, Influenza virus
VSTQKALNEIT

SEQ ID NO: 416926 - protein, 11 aa, Influenza virus
DANVKNLHDQI

SEQ ID NO: 416927 - protein, 11 aa, Influenza virus
ANVKNLHDQIK

SEQ ID NO: 416928 - protein, 11 aa, Influenza virus
NVKNLHDQIKR

SEQ ID NO: 416929 - protein, 11 aa, Influenza virus
KSEDNVYKVLS

SEQ ID NO: 416930 - protein, 11 aa, Influenza virus
SEDNVYKVLSI

SEQ ID NO: 416931 - protein, 11 aa, Influenza virus
IYSCIASSTVM

SEQ ID NO: 416932 - protein, 11 aa, Influenza virus
YSCIASSTVMV

SEQ ID NO: 416933 - protein, 11 aa, Influenza virus
SCIASSTVMVG

SEQ ID NO: 416934 - protein, 11 aa, Influenza virus
CIASSTVMVGL

SEQ ID NO: 416935 - protein, 11 aa, Influenza virus
IASSTVMVGLI

SEQ ID NO: 416936 - protein, 11 aa, Influenza virus
ASSTVMVGLIL

SEQ ID NO: 416937 - protein, 11 aa, Influenza virus
SSTVMVGLILA

SEQ ID NO: 416938 - protein, 11 aa, Influenza virus
STVMVGLILAF

SEQ ID NO: 416939 - protein, 11 aa, Influenza virus
TVMVGLILAFI

SEQ ID NO: 416940 - protein, 11 aa, Influenza virus
GFIEGGWPGLV

SEQ ID NO: 416941 - protein, 11 aa, Influenza virus
FIEGGWPGLVA

SEQ ID NO: 416942 - protein, 11 aa, Influenza virus
IEGGWPGLVAG

SEQ ID NO: 416943 - protein, 11 aa, Influenza virus
EGGWPGLVAGW

SEQ ID NO: 416944 - protein, 11 aa, Influenza virus
GGWPGLVAGWY

SEQ ID NO: 416945 - protein, 11 aa, Influenza virus
GWPGLVAGWYG

SEQ ID NO: 416946 - protein, 11 aa, Influenza virus
WPGLVAGWYGF

SEQ ID NO: 416947 - protein, 11 aa, Influenza virus
PGLVAGWYGFQ

SEQ ID NO: 416948 - protein, 11 aa, Influenza virus
GLVAGWYGFQH

SEQ ID NO: 416949 - protein, 11 aa, Influenza virus
YNAKLLVLLEN

SEQ ID NO: 416950 - protein, 11 aa, Influenza virus
STDTVDTVREK

SEQ ID NO: 416951 - protein, 11 aa, Influenza virus
TDTVDTVREKN

SEQ ID NO: 416952 - protein, 11 aa, Influenza virus
TVDTVREKNVT

SEQ ID NO: 416953 - protein, 11 aa, Influenza virus
VDTVREKNVTV

SEQ ID NO: 416954 - protein, 11 aa, Influenza virus
DTVREKNVTVT

SEQ ID NO: 416955 - protein, 11 aa, Influenza virus
TVREKNVTVTH

SEQ ID NO: 416956 - protein, 11 aa, Influenza virus
VREKNVTVTHS

SEQ ID NO: 416957 - protein, 11 aa, Influenza virus
VAGWILGNPKC

SEQ ID NO: 416958 - protein, 11 aa, Influenza virus
NYEELREHLSS

SEQ ID NO: 416959 - protein, 11 aa, Influenza virus
LKEQLSSVSSF

SEQ ID NO: 416960 - protein, 11 aa, Influenza virus
EQLSSVSSFKR

SEQ ID NO: 416961 - protein, 11 aa, Influenza virus
QLSSVSSFKRF

SEQ ID NO: 416962 - protein, 11 aa, Influenza virus
SSVSSFKRFEI

SEQ ID NO: 416963 - protein, 11 aa, Influenza virus
SVSSFKRFEIF

SEQ ID NO: 416964 - protein, 11 aa, Influenza virus
SSFKRFEIFPK

SEQ ID NO: 416965 - protein, 11 aa, Influenza virus
DTIIFEATGNL

SEQ ID NO: 416966 - protein, 11 aa, Influenza virus
IGKCSKYVKST

SEQ ID NO: 416967 - protein, 11 aa, Influenza virus
LRMATGLRNVP

SEQ ID NO: 416968 - protein, 11 aa, Influenza virus
RMATGLRNVPS

SEQ ID NO: 416969 - protein, 11 aa, Influenza virus
ATGLRNIPSVQ

SEQ ID NO: 416970 - protein, 11 aa, Influenza virus
NAQGSGYAADL

SEQ ID NO: 416971 - protein, 11 aa, Influenza virus
AQGSGYAADLK

SEQ ID NO: 416972 - protein, 11 aa, Influenza virus
NSIIEKMNIQF

SEQ ID NO: 416973 - protein, 11 aa, Influenza virus
SIIEKMNIQFT

SEQ ID NO: 416974 - protein, 11 aa, Influenza virus
MNTQFTSVGKE

SEQ ID NO: 416975 - protein, 11 aa, Influenza virus
NTQFTVVGKEF

SEQ ID NO: 416976 - protein, 11 aa, Influenza virus
RIESLNNKVDD

SEQ ID NO: 416977 - protein, 11 aa, Influenza virus
NLNRKVDDGFL

SEQ ID NO: 416978 - protein, 11 aa, Influenza virus
LNRKVDDGFLD

SEQ ID NO: 416979 - protein, 11 aa, Influenza virus
DDGFIDVWTYN

SEQ ID NO: 416980 - protein, 11 aa, Influenza virus
DGFIDVWTYNA

SEQ ID NO: 416981 - protein, 11 aa, Influenza virus
GFIDVWTYNAE

SEQ ID NO: 416982 - protein, 11 aa, Influenza virus
FIDVWTYNAEL

SEQ ID NO: 416983 - protein, 11 aa, Influenza virus
ENERTLDYHDF

SEQ ID NO: 416984 - protein, 11 aa, Influenza virus
ASTLVLLVSLG

SEQ ID NO: 416985 - protein, 11 aa, Influenza virus
STLVLLVSLGA

SEQ ID NO: 416986 - protein, 11 aa, Influenza virus
LLVSLGAIGFW

SEQ ID NO: 416987 - protein, 11 aa, Influenza virus
LVSLGAIGFWM

SEQ ID NO: 416988 - protein, 11 aa, Influenza virus
MCSWSLQCRIC

SEQ ID NO: 416989 - protein, 11 aa, Influenza virus
SKDNGVRIGSK

SEQ ID NO: 416990 - protein, 11 aa, Influenza virus
NGVRIGSKGDV

SEQ ID NO: 416991 - protein, 11 aa, Influenza virus
GVRIGSKGDVF

SEQ ID NO: 416992 - protein, 11 aa, Influenza virus
MREPFISCSHF

SEQ ID NO: 416993 - protein, 11 aa, Influenza virus
LNDRHSNGTIK

SEQ ID NO: 416994 - protein, 11 aa, Influenza virus
KNRSPYRALMS

SEQ ID NO: 416995 - protein, 11 aa, Influenza virus
AWSASACHDGV

SEQ ID NO: 416996 - protein, 11 aa, Influenza virus
LTIGISGPDNE

SEQ ID NO: 416997 - protein, 11 aa, Influenza virus
AVLKYKGIITG

SEQ ID NO: 416998 - protein, 11 aa, Influenza virus
VLKYNDIITDT

SEQ ID NO: 416999 - protein, 11 aa, Influenza virus
LRTQESECACI

SEQ ID NO: 417000 - protein, 11 aa, Influenza virus
QESECACINGS

SEQ ID NO: 417001 - protein, 11 aa, Influenza virus
ESECACINGSC

SEQ ID NO: 417002 - protein, 11 aa, Influenza virus
APNYYYEECSC

SEQ ID NO: 417003 - protein, 11 aa, Influenza virus
PNYYYEECSCY

SEQ ID NO: 417004 - protein, 11 aa, Influenza virus
NYYYEECSCYP

SEQ ID NO: 417005 - protein, 11 aa, Influenza virus
HASNRPWISFD

SEQ ID NO: 417006 - protein, 11 aa, Influenza virus
NRPWVSFNHNL

SEQ ID NO: 417007 - protein, 11 aa, Influenza virus
MGYICSGVFGD

SEQ ID NO: 417008 - protein, 11 aa, Influenza virus
GFSYRYGNGVW

SEQ ID NO: 417009 - protein, 11 aa, Influenza virus
KEWSGYSGSFV

SEQ ID NO: 417010 - protein, 11 aa, Influenza virus
QHPELTGMDCI

SEQ ID NO: 417011 - protein, 11 aa, Influenza virus
NCMRPCFWVEL

SEQ ID NO: 417012 - protein, 11 aa, Influenza virus
CIKPCFWVELI

SEQ ID NO: 417013 - protein, 11 aa, Influenza virus
IKPCFWVELIR

SEQ ID NO: 417014 - protein, 11 aa, Influenza virus
RNITVTHSVNL

SEQ ID NO: 417015 - protein, 11 aa, Influenza virus
NVTVTHSVNLF

SEQ ID NO: 417016 - protein, 11 aa, Influenza virus
VAVTHSVNLLE

SEQ ID NO: 417017 - protein, 11 aa, Influenza virus
PFQNIHPATIG

SEQ ID NO: 417018 - protein, 11 aa, Influenza virus
VTIGKCPKYVK

SEQ ID NO: 417019 - protein, 11 aa, Influenza virus
SIQSKGLFGAI

SEQ ID NO: 417020 - protein, 11 aa, Influenza virus
IHSRGLFGAIA

SEQ ID NO: 417021 - protein, 11 aa, Influenza virus
IWTYNAELLIL

SEQ ID NO: 417022 - protein, 11 aa, Influenza virus
VLLENERTLDL

SEQ ID NO: 417023 - protein, 11 aa, Influenza virus
NERTLDYHDSH

SEQ ID NO: 417024 - protein, 11 aa, Influenza virus
ERTLDFHESNV

SEQ ID NO: 417025 - protein, 11 aa, Influenza virus
DNAKEIGNGCF

SEQ ID NO: 417026 - protein, 11 aa, Influenza virus
NARELGNGCFE

SEQ ID NO: 417027 - protein, 11 aa, Influenza virus
VKEIGNGCFEF

SEQ ID NO: 417028 - protein, 11 aa, Influenza virus
REIGNGCFEFY

SEQ ID NO: 417029 - protein, 11 aa, Influenza virus
GCFEFYHRCDD

SEQ ID NO: 417030 - protein, 11 aa, Influenza virus
SFWMCPNGSLQ

SEQ ID NO: 417031 - protein, 11 aa, Influenza virus
WMCPNGSLQCT

SEQ ID NO: 417032 - protein, 11 aa, Influenza virus
MCSNGSLQFRI

SEQ ID NO: 417033 - protein, 11 aa, Influenza virus
IAGFAPFSKDN

SEQ ID NO: 417034 - protein, 11 aa, Influenza virus
RLSAGGDIWAT

SEQ ID NO: 417035 - protein, 11 aa, Influenza virus
LSAGGDIWATR

SEQ ID NO: 417036 - protein, 11 aa, Influenza virus
SAGGDIWATRE

SEQ ID NO: 417037 - protein, 11 aa, Influenza virus
ASGDVWVTREP

SEQ ID NO: 417038 - protein, 11 aa, Influenza virus
GGAVWVTREPY

SEQ ID NO: 417039 - protein, 11 aa, Influenza virus
GDIWVTRKPYV

SEQ ID NO: 417040 - protein, 11 aa, Influenza virus
DIWVTREPYAS

SEQ ID NO: 417041 - protein, 11 aa, Influenza virus
ELGIPFHLGTR

SEQ ID NO: 417042 - protein, 11 aa, Influenza virus
SCYDGKAWLHI

SEQ ID NO: 417043 - protein, 11 aa, Influenza virus
CYDGKAWLHIC

SEQ ID NO: 417044 - protein, 11 aa, Influenza virus
ICAVVMTDGSA

SEQ ID NO: 417045 - protein, 11 aa, Influenza virus
CTVVMTDGSAT

SEQ ID NO: 417046 - protein, 11 aa, Influenza virus
IEEGSVYPRFL

SEQ ID NO: 417047 - protein, 11 aa, Influenza virus
DNWKGSNRPVI

SEQ ID NO: 417048 - protein, 11 aa, Influenza virus
NWKGSNRPVID

SEQ ID NO: 417049 - protein, 11 aa, Influenza virus
WKGSNRPVIDI

SEQ ID NO: 417050 - protein, 11 aa, Influenza virus
GSHGVKGWAFD

SEQ ID NO: 417051 - protein, 11 aa, Influenza virus
SCINRCFYVES

SEQ ID NO: 417052 - protein, 11 aa, Influenza virus
CFYVELIRGRE

SEQ ID NO: 417053 - protein, 11 aa, Influenza virus
VWWTSTSIVVF

SEQ ID NO: 417054 - protein, 11 aa, Influenza virus
SNSVVVFCGTS

SEQ ID NO: 417055 - protein, 11 aa, Influenza virus
NSIVAFCGTSG

SEQ ID NO: 417056 - protein, 11 aa, Influenza virus
SIVEFCGTSGT

SEQ ID NO: 417057 - protein, 11 aa, Influenza virus
VEFCGTSGTYG

SEQ ID NO: 417058 - protein, 11 aa, Influenza virus
GDQICVGYHAN

SEQ ID NO: 417059 - protein, 11 aa, Influenza virus
DQICVGYHANN

SEQ ID NO: 417060 - protein, 11 aa, Influenza virus
QICVGYHANNS

SEQ ID NO: 417061 - protein, 11 aa, Influenza virus
TVTHAKDILER

SEQ ID NO: 417062 - protein, 11 aa, Influenza virus
DILEKAHNGKL

SEQ ID NO: 417063 - protein, 11 aa, Influenza virus
GIPPLELGNCS

SEQ ID NO: 417064 - protein, 11 aa, Influenza virus
IPPLELGNCSI

SEQ ID NO: 417065 - protein, 11 aa, Influenza virus
WLLGNPKCDRL

SEQ ID NO: 417066 - protein, 11 aa, Influenza virus
LLGNPKCDRLL

SEQ ID NO: 417067 - protein, 11 aa, Influenza virus
VPEWSYIMEKK

SEQ ID NO: 417068 - protein, 11 aa, Influenza virus
SYNNTSGEQVL

SEQ ID NO: 417069 - protein, 11 aa, Influenza virus
INFESNGNLIA

SEQ ID NO: 417070 - protein, 11 aa, Influenza virus
NFESNGNLIAP

SEQ ID NO: 417071 - protein, 11 aa, Influenza virus
FKISKRGSSGV

SEQ ID NO: 417072 - protein, 11 aa, Influenza virus
ISKRGSSGVMK

SEQ ID NO: 417073 - protein, 11 aa, Influenza virus
SKRGSSGVMKT

SEQ ID NO: 417074 - protein, 11 aa, Influenza virus
CDTKCQTPLGA

SEQ ID NO: 417075 - protein, 11 aa, Influenza virus
TKCQSPLGAIN

SEQ ID NO: 417076 - protein, 11 aa, Influenza virus
KCQSPLGAINT

SEQ ID NO: 417077 - protein, 11 aa, Influenza virus
PQTESRGLFGA

SEQ ID NO: 417078 - protein, 11 aa, Influenza virus
QIEARGLFGAI

SEQ ID NO: 417079 - protein, 11 aa, Influenza virus
IEARGLFGAIA

SEQ ID NO: 417080 - protein, 11 aa, Influenza virus
ENLNKRMEDGF

SEQ ID NO: 417081 - protein, 11 aa, Influenza virus
NERILDFHDSN

SEQ ID NO: 417082 - protein, 11 aa, Influenza virus
ERTLGFHDSNV

SEQ ID NO: 417083 - protein, 11 aa, Influenza virus
LDFHDSSVKNL

SEQ ID NO: 417084 - protein, 11 aa, Influenza virus
EFHDSNVKNLY

SEQ ID NO: 417085 - protein, 11 aa, Influenza virus
LYDRVRMQLRD

SEQ ID NO: 417086 - protein, 11 aa, Influenza virus
YDKVRMQLKDN

SEQ ID NO: 417087 - protein, 11 aa, Influenza virus
KVKMQLRDNAK

SEQ ID NO: 417088 - protein, 11 aa, Influenza virus
MQLKDNAKEVG

SEQ ID NO: 417089 - protein, 11 aa, Influenza virus
DNAKEVGNGCF

SEQ ID NO: 417090 - protein, 11 aa, Influenza virus
NAKETGNGCFE

SEQ ID NO: 417091 - protein, 11 aa, Influenza virus
AKEVGNGCFEF

SEQ ID NO: 417092 - protein, 11 aa, Influenza virus
FYHKCNDECMN

SEQ ID NO: 417093 - protein, 11 aa, Influenza virus
YHKCNDECMNS

SEQ ID NO: 417094 - protein, 11 aa, Influenza virus
GTYDYIKYEEE

SEQ ID NO: 417095 - protein, 11 aa, Influenza virus
TYNYSKYEEES

SEQ ID NO: 417096 - protein, 11 aa, Influenza virus
PKYEKESKLNR

SEQ ID NO: 417097 - protein, 11 aa, Influenza virus
KYEEESKLNRS

SEQ ID NO: 417098 - protein, 11 aa, Influenza virus
YEEESKLNRSE

SEQ ID NO: 417099 - protein, 11 aa, Influenza virus
EEESKLNRSEI

SEQ ID NO: 417100 - protein, 11 aa, Influenza virus
ESKLNRSEIKG

SEQ ID NO: 417101 - protein, 11 aa, Influenza virus
LSLAIMMAGIF

SEQ ID NO: 417102 - protein, 11 aa, Influenza virus
AGIFFWMCSNG

SEQ ID NO: 417103 - protein, 11 aa, Influenza virus
GIFFWMCSNGS

SEQ ID NO: 417104 - protein, 11 aa, Influenza virus
IFFWMCSNGSL

SEQ ID NO: 417105 - protein, 11 aa, Influenza virus
FFWMCSNGSLQ

SEQ ID NO: 417106 - protein, 11 aa, Influenza virus
KGDRICIGYHA

SEQ ID NO: 417107 - protein, 11 aa, Influenza virus
IGYHANNSTEM

SEQ ID NO: 417108 - protein, 11 aa, Influenza virus
MVDTILERNVT

SEQ ID NO: 417109 - protein, 11 aa, Influenza virus
VTHAQNILEKT

SEQ ID NO: 417110 - protein, 11 aa, Influenza virus
THAKDILEKAH

SEQ ID NO: 417111 - protein, 11 aa, Influenza virus
HAKDILEKAHN

SEQ ID NO: 417112 - protein, 11 aa, Influenza virus
AQDILERTHNG

SEQ ID NO: 417113 - protein, 11 aa, Influenza virus
KAHNGKLCRLS

SEQ ID NO: 417114 - protein, 11 aa, Influenza virus
LGNPECDRLLI

SEQ ID NO: 417115 - protein, 11 aa, Influenza virus
VPEWSYIMERE

SEQ ID NO: 417116 - protein, 11 aa, Influenza virus
PEWSYIIEKEN

SEQ ID NO: 417117 - protein, 11 aa, Influenza virus
EWSYIIEKENP

SEQ ID NO: 417118 - protein, 11 aa, Influenza virus
HFEKIKILPRD

SEQ ID NO: 417119 - protein, 11 aa, Influenza virus
AQGSYNNTSGE

SEQ ID NO: 417120 - protein, 11 aa, Influenza virus
RGSYNNTSGEQ

SEQ ID NO: 417121 - protein, 11 aa, Influenza virus
WDTISFESTGN

SEQ ID NO: 417122 - protein, 11 aa, Influenza virus
TISFESTGNLV

SEQ ID NO: 417123 - protein, 11 aa, Influenza virus
NCEIKCQTPLG

SEQ ID NO: 417124 - protein, 11 aa, Influenza virus
ETQCQTPLGAI

SEQ ID NO: 417125 - protein, 11 aa, Influenza virus
IGECPRYVKSE

SEQ ID NO: 417126 - protein, 11 aa, Influenza virus
GECPRYVKSEK

SEQ ID NO: 417127 - protein, 11 aa, Influenza virus
ECPRYVKSEKL

SEQ ID NO: 417128 - protein, 11 aa, Influenza virus
CPKYVKSKRLV

SEQ ID NO: 417129 - protein, 11 aa, Influenza virus
PRYVKSEKLVL

SEQ ID NO: 417130 - protein, 11 aa, Influenza virus
KYVKSKRLVLA

SEQ ID NO: 417131 - protein, 11 aa, Influenza virus
YVKSKRLVLAT

SEQ ID NO: 417132 - protein, 11 aa, Influenza virus
VKSDRLVLAIG

SEQ ID NO: 417133 - protein, 11 aa, Influenza virus
SKRLVLATGLR

SEQ ID NO: 417134 - protein, 11 aa, Influenza virus
DRLVLAIGLRN

SEQ ID NO: 417135 - protein, 11 aa, Influenza virus
KLVLATGLRNA

SEQ ID NO: 417136 - protein, 11 aa, Influenza virus
LATGLRNAHKM

SEQ ID NO: 417137 - protein, 11 aa, Influenza virus
AIGLRNVPQIE

SEQ ID NO: 417138 - protein, 11 aa, Influenza virus
RNAHKMESRGL

SEQ ID NO: 417139 - protein, 11 aa, Influenza virus
NVPQIEPRGLF

SEQ ID NO: 417140 - protein, 11 aa, Influenza virus
VPQIEARGLFG

SEQ ID NO: 417141 - protein, 11 aa, Influenza virus
AADKESTQKAV

SEQ ID NO: 417142 - protein, 11 aa, Influenza virus
KEFGNLERRLE

SEQ ID NO: 417143 - protein, 11 aa, Influenza virus
EFGNLERRLEN

SEQ ID NO: 417144 - protein, 11 aa, Influenza virus
FGNLERRLENL

SEQ ID NO: 417145 - protein, 11 aa, Influenza virus
LEKRLGNLNKK

SEQ ID NO: 417146 - protein, 11 aa, Influenza virus
RLGNLNKKMED

SEQ ID NO: 417147 - protein, 11 aa, Influenza virus
LGNLNKKMEDG

SEQ ID NO: 417148 - protein, 11 aa, Influenza virus
MEDGFLGVWTY

SEQ ID NO: 417149 - protein, 11 aa, Influenza virus
DGFLDVWTYNT

SEQ ID NO: 417150 - protein, 11 aa, Influenza virus
GFRDVWTYNAE

SEQ ID NO: 417151 - protein, 11 aa, Influenza virus
FLGVWTYNAEL

SEQ ID NO: 417152 - protein, 11 aa, Influenza virus
RILDFHDSNVK

SEQ ID NO: 417153 - protein, 11 aa, Influenza virus
TLDFHDSSVKN

SEQ ID NO: 417154 - protein, 11 aa, Influenza virus
FHDSNVRNLYD

SEQ ID NO: 417155 - protein, 11 aa, Influenza virus
VRNLYDKVRMQ

SEQ ID NO: 417156 - protein, 11 aa, Influenza virus
RNLYDKVRMQL

SEQ ID NO: 417157 - protein, 11 aa, Influenza virus
NLYDKVRMQLK

SEQ ID NO: 417158 - protein, 11 aa, Influenza virus
DKVRMQLKDNA

SEQ ID NO: 417159 - protein, 11 aa, Influenza virus
RNGTYNYPKYE

SEQ ID NO: 417160 - protein, 11 aa, Influenza virus
NGTYNYPKYEE

SEQ ID NO: 417161 - protein, 11 aa, Influenza virus
YNYPKYEEESR

SEQ ID NO: 417162 - protein, 11 aa, Influenza virus
DYSKYEEESKL

SEQ ID NO: 417163 - protein, 11 aa, Influenza virus
PKYEEESKLNK

SEQ ID NO: 417164 - protein, 11 aa, Influenza virus
KLNKNEIKGVK

SEQ ID NO: 417165 - protein, 11 aa, Influenza virus
IKGVELSSMGV

SEQ ID NO: 417166 - protein, 11 aa, Influenza virus
KGVELSSMGVY

SEQ ID NO: 417167 - protein, 11 aa, Influenza virus
GVELSSMGVYQ

SEQ ID NO: 417168 - protein, 11 aa, Influenza virus
VELSSMGVYQI

SEQ ID NO: 417169 - protein, 11 aa, Influenza virus
ELSSMGVYQIL

SEQ ID NO: 417170 - protein, 11 aa, Influenza virus
LSNMGVYQVLA

SEQ ID NO: 417171 - protein, 11 aa, Influenza virus
SNMGVYQVLAI

SEQ ID NO: 417172 - protein, 11 aa, Influenza virus
NMGVYQVLAIY

SEQ ID NO: 417173 - protein, 11 aa, Influenza virus
LSLAIMMAGIF

SEQ ID NO: 417174 - protein, 11 aa, Influenza virus
NQKIITIGFVS

SEQ ID NO: 417175 - protein, 11 aa, Influenza virus
QKIITIDSVSL

SEQ ID NO: 417176 - protein, 11 aa, Influenza virus
HIAILATTVTL

SEQ ID NO: 417177 - protein, 11 aa, Influenza virus
AATVTLHFKQH

SEQ ID NO: 417178 - protein, 11 aa, Influenza virus
TVTLHFKQHKC

SEQ ID NO: 417179 - protein, 11 aa, Influenza virus
RLSAGGDIWVM

SEQ ID NO: 417180 - protein, 11 aa, Influenza virus
LSAGGDIWVMR

SEQ ID NO: 417181 - protein, 11 aa, Influenza virus
SADGDIWVTRE

SEQ ID NO: 417182 - protein, 11 aa, Influenza virus
ASGDIWVTREP

SEQ ID NO: 417183 - protein, 11 aa, Influenza virus
DKCYQFALGQG

SEQ ID NO: 417184 - protein, 11 aa, Influenza virus
TLENKHSNGTK

SEQ ID NO: 417185 - protein, 11 aa, Influenza virus
LENKHSNGTKH

SEQ ID NO: 417186 - protein, 11 aa, Influenza virus
ENKHSNGTKHD

SEQ ID NO: 417187 - protein, 11 aa, Influenza virus
TIHDRSPHRTL

SEQ ID NO: 417188 - protein, 11 aa, Influenza virus
KHDRIPHRTLL

SEQ ID NO: 417189 - protein, 11 aa, Influenza virus
FHLGTKQVCAA

SEQ ID NO: 417190 - protein, 11 aa, Influenza virus
HLGTKQVCAAW

SEQ ID NO: 417191 - protein, 11 aa, Influenza virus
LGTKQVCAAWS

SEQ ID NO: 417192 - protein, 11 aa, Influenza virus
GTKQVCAAWSS

SEQ ID NO: 417193 - protein, 11 aa, Influenza virus
TKQVCAAWSSS

SEQ ID NO: 417194 - protein, 11 aa, Influenza virus
KQVCAAWSSSS

SEQ ID NO: 417195 - protein, 11 aa, Influenza virus
KAWLHVCVTGY

SEQ ID NO: 417196 - protein, 11 aa, Influenza virus
CVTGYEKNATA

SEQ ID NO: 417197 - protein, 11 aa, Influenza virus
VTGDDENATAS

SEQ ID NO: 417198 - protein, 11 aa, Influenza virus
GDDRNATASFV

SEQ ID NO: 417199 - protein, 11 aa, Influenza virus
DDENATASFIY

SEQ ID NO: 417200 - protein, 11 aa, Influenza virus
HESECVCINGT

SEQ ID NO: 417201 - protein, 11 aa, Influenza virus
GTCTVVMTDGN

SEQ ID NO: 417202 - protein, 11 aa, Influenza virus
ADTRILFIREG

SEQ ID NO: 417203 - protein, 11 aa, Influenza virus
DTRILFIREGK

SEQ ID NO: 417204 - protein, 11 aa, Influenza virus
VHVSPLSGSAQ

SEQ ID NO: 417205 - protein, 11 aa, Influenza virus
VSPLSGSAQHI

SEQ ID NO: 417206 - protein, 11 aa, Influenza virus
YPDVRCTCRDN

SEQ ID NO: 417207 - protein, 11 aa, Influenza virus
PDVRCTCRDNW

SEQ ID NO: 417208 - protein, 11 aa, Influenza virus
DISMEDYSIGS

SEQ ID NO: 417209 - protein, 11 aa, Influenza virus
DYSIDSGYVCS

SEQ ID NO: 417210 - protein, 11 aa, Influenza virus
VGDTPRNNDGS

SEQ ID NO: 417211 - protein, 11 aa, Influenza virus
GDTPRSDDSSS

SEQ ID NO: 417212 - protein, 11 aa, Influenza virus
SSSNCRNPNNE

SEQ ID NO: 417213 - protein, 11 aa, Influenza virus
PNNERGYPGVK

SEQ ID NO: 417214 - protein, 11 aa, Influenza virus
NNERGNHGVKG

SEQ ID NO: 417215 - protein, 11 aa, Influenza virus
NERGYPGVKGW

SEQ ID NO: 417216 - protein, 11 aa, Influenza virus
ERGYPGVKGWA

SEQ ID NO: 417217 - protein, 11 aa, Influenza virus
RGNHGVKGWAF

SEQ ID NO: 417218 - protein, 11 aa, Influenza virus
PGVKGWAFDYG

SEQ ID NO: 417219 - protein, 11 aa, Influenza virus
KESRSGYETFK

SEQ ID NO: 417220 - protein, 11 aa, Influenza virus
YETFRVIGGWV

SEQ ID NO: 417221 - protein, 11 aa, Influenza virus
ETFRVIGGWVT

SEQ ID NO: 417222 - protein, 11 aa, Influenza virus
KNNWSGYSGIF

SEQ ID NO: 417223 - protein, 11 aa, Influenza virus
KSCVNRCFYVE

SEQ ID NO: 417224 - protein, 11 aa, Influenza virus
NCINRCFYVEL

SEQ ID NO: 417225 - protein, 11 aa, Influenza virus
CFYVELIRGMP

SEQ ID NO: 417226 - protein, 11 aa, Influenza virus
FYVELIRGMPQ

SEQ ID NO: 417227 - protein, 11 aa, Influenza virus
YVELIRGRRQE

SEQ ID NO: 417228 - protein, 11 aa, Influenza virus
TGSWPDGANTN

SEQ ID NO: 417229 - protein, 11 aa, Influenza virus
GSWPDGANTNF

SEQ ID NO: 417230 - protein, 11 aa, Influenza virus
SWPDGANISFM

SEQ ID NO: 417231 - protein, 11 aa, Influenza virus
WPDGANTNFMP

SEQ ID NO: 417232 - protein, 11 aa, Influenza virus
PDGANTNFMPI

SEQ ID NO: 417233 - protein, 11 aa, Influenza virus
DATLCLGHHAV

SEQ ID NO: 417234 - protein, 11 aa, Influenza virus
AMLCLGHHAVP

SEQ ID NO: 417235 - protein, 11 aa, Influenza virus
MLCLGHHAVPN

SEQ ID NO: 417236 - protein, 11 aa, Influenza virus
DNIEVTNATEL

SEQ ID NO: 417237 - protein, 11 aa, Influenza virus
SLRSLVGSSGT

SEQ ID NO: 417238 - protein, 11 aa, Influenza virus
LRSLVASSGNL

SEQ ID NO: 417239 - protein, 11 aa, Influenza virus
FDKLYVWGIHH

SEQ ID NO: 417240 - protein, 11 aa, Influenza virus
KCITPNGSIPN

SEQ ID NO: 417241 - protein, 11 aa, Influenza virus
CITPNGSIPNG

SEQ ID NO: 417242 - protein, 11 aa, Influenza virus
LATGMRNIPER

SEQ ID NO: 417243 - protein, 11 aa, Influenza virus
GMVNGWYGFRH

SEQ ID NO: 417244 - protein, 11 aa, Influenza virus
DGWYGFRHHNS

SEQ ID NO: 417245 - protein, 11 aa, Influenza virus
NSEGTGQAGDL

SEQ ID NO: 417246 - protein, 11 aa, Influenza virus
SEGTGQAGDLK

SEQ ID NO: 417247 - protein, 11 aa, Influenza virus
DFKSTQAAINQ

SEQ ID NO: 417248 - protein, 11 aa, Influenza virus
VEKTNEKFHQI

SEQ ID NO: 417249 - protein, 11 aa, Influenza virus
SYNAEILVALE

SEQ ID NO: 417250 - protein, 11 aa, Influenza virus
YNAEILVALEN

SEQ ID NO: 417251 - protein, 11 aa, Influenza virus
ILVALENQHTI

SEQ ID NO: 417252 - protein, 11 aa, Influenza virus
VVLENQHTIDL

SEQ ID NO: 417253 - protein, 11 aa, Influenza virus
ALENQHTIDMT

SEQ ID NO: 417254 - protein, 11 aa, Influenza virus
NQNTIDLTDSE

SEQ ID NO: 417255 - protein, 11 aa, Influenza virus
QNTIDLTDSEM

SEQ ID NO: 417256 - protein, 11 aa, Influenza virus
KQLRENAEEMG

SEQ ID NO: 417257 - protein, 11 aa, Influenza virus
QLRENAEDLGN

SEQ ID NO: 417258 - protein, 11 aa, Influenza virus
LRENAEDLGNG

SEQ ID NO: 417259 - protein, 11 aa, Influenza virus
ENAEDIGNGCF

SEQ ID NO: 417260 - protein, 11 aa, Influenza virus
GCFKIYHRCDN

SEQ ID NO: 417261 - protein, 11 aa, Influenza virus
GYKDWFLWISF

SEQ ID NO: 417262 - protein, 11 aa, Influenza virus
KNWILWISFAI

SEQ ID NO: 417263 - protein, 11 aa, Influenza virus
NWILWISFAIS

SEQ ID NO: 417264 - protein, 11 aa, Influenza virus
ILWISFAISCL

SEQ ID NO: 417265 - protein, 11 aa, Influenza virus
GFVMWACQKGN

SEQ ID NO: 417266 - protein, 11 aa, Influenza virus
ACQKGNIRCSI

SEQ ID NO: 417267 - protein, 11 aa, Influenza virus
QKGNIRCNICV

SEQ ID NO: 417268 - protein, 11 aa, Influenza virus
HHAVPNGTMVK

SEQ ID NO: 417269 - protein, 11 aa, Influenza virus
HAVPNGTMVKT

SEQ ID NO: 417270 - protein, 11 aa, Influenza virus
AVPNGTMVKTI

SEQ ID NO: 417271 - protein, 11 aa, Influenza virus
VPNGTMVKTIT

SEQ ID NO: 417272 - protein, 11 aa, Influenza virus
TLIDSLLGDPH

SEQ ID NO: 417273 - protein, 11 aa, Influenza virus
LIDSLLGDPHC

SEQ ID NO: 417274 - protein, 11 aa, Influenza virus
IDSLLGDPHCD

SEQ ID NO: 417275 - protein, 11 aa, Influenza virus
FNKLYIWGVHH

SEQ ID NO: 417276 - protein, 11 aa, Influenza virus
SVYWTIVKPGD

SEQ ID NO: 417277 - protein, 11 aa, Influenza virus
NLIAPRGYFRI

SEQ ID NO: 417278 - protein, 11 aa, Influenza virus
KCITPNGSIPN

SEQ ID NO: 417279 - protein, 11 aa, Influenza virus
CITPNGSIPNN

SEQ ID NO: 417280 - protein, 11 aa, Influenza virus
TPNGSIPNNKP

SEQ ID NO: 417281 - protein, 11 aa, Influenza virus
NGSIPNGKPFQ

SEQ ID NO: 417282 - protein, 11 aa, Influenza virus
GSIPNGKPFQN

SEQ ID NO: 417283 - protein, 11 aa, Influenza virus
FQNINRITYGA

SEQ ID NO: 417284 - protein, 11 aa, Influenza virus
QNINRITYGAC

SEQ ID NO: 417285 - protein, 11 aa, Influenza virus
NINRITYGACP

SEQ ID NO: 417286 - protein, 11 aa, Influenza virus
YVRQNTLKLAT

SEQ ID NO: 417287 - protein, 11 aa, Influenza virus
VRQNTLKLATG

SEQ ID NO: 417288 - protein, 11 aa, Influenza virus
LATGMRNIPER

SEQ ID NO: 417289 - protein, 11 aa, Influenza virus
ATGMRNIPERQ

SEQ ID NO: 417290 - protein, 11 aa, Influenza virus
TGMRNIPERQT

SEQ ID NO: 417291 - protein, 11 aa, Influenza virus
GMRNIPERQTR

SEQ ID NO: 417292 - protein, 11 aa, Influenza virus
MRNIPERQTRG

SEQ ID NO: 417293 - protein, 11 aa, Influenza virus
PERQTRGLFGA

SEQ ID NO: 417294 - protein, 11 aa, Influenza virus
ERQTRGLFGAI

SEQ ID NO: 417295 - protein, 11 aa, Influenza virus
RQTRGLFGAIA

SEQ ID NO: 417296 - protein, 11 aa, Influenza virus
MVDGWYGFRHH

SEQ ID NO: 417297 - protein, 11 aa, Influenza virus
VDGWYGFRHHN

SEQ ID NO: 417298 - protein, 11 aa, Influenza virus
ADFKSTQAAIN

SEQ ID NO: 417299 - protein, 11 aa, Influenza virus
DLKSTQAAITQ

SEQ ID NO: 417300 - protein, 11 aa, Influenza virus
SYNAELLIALE

SEQ ID NO: 417301 - protein, 11 aa, Influenza virus
YNAELLIALEN

SEQ ID NO: 417302 - protein, 11 aa, Influenza virus
NAELLIAMENQ

SEQ ID NO: 417303 - protein, 11 aa, Influenza virus
ILVALENQHTI

SEQ ID NO: 417304 - protein, 11 aa, Influenza virus
HTIDMTDSEMN

SEQ ID NO: 417305 - protein, 11 aa, Influenza virus
TDSEMNKLFDR

SEQ ID NO: 417306 - protein, 11 aa, Influenza virus
NAEDLGNGCFK

SEQ ID NO: 417307 - protein, 11 aa, Influenza virus
AEEMGNGCFKI

SEQ ID NO: 417308 - protein, 11 aa, Influenza virus
EDLGNGCFKIY

SEQ ID NO: 417309 - protein, 11 aa, Influenza virus
LGNGCFKIYHK

SEQ ID NO: 417310 - protein, 11 aa, Influenza virus
MESIRNGTYDH

SEQ ID NO: 417311 - protein, 11 aa, Influenza virus
YRDEALSNRFQ

SEQ ID NO: 417312 - protein, 11 aa, Influenza virus
KNWILWISFAI

SEQ ID NO: 417313 - protein, 11 aa, Influenza virus
FLWISFAISCF

SEQ ID NO: 417314 - protein, 11 aa, Influenza virus
LGFVMWACQKG

SEQ ID NO: 417315 - protein, 11 aa, Influenza virus
FVMWACQKGNI

SEQ ID NO: 417316 - protein, 11 aa, Influenza virus
IMWTCQKGNIR

SEQ ID NO: 417317 - protein, 11 aa, Influenza virus
SAGGDIWVTRV

SEQ ID NO: 417318 - protein, 11 aa, Influenza virus
AGGDIWVTRVP

SEQ ID NO: 417319 - protein, 11 aa, Influenza virus
DRCYQFALGQG

SEQ ID NO: 417320 - protein, 11 aa, Influenza virus
EILRTQESECI

SEQ ID NO: 417321 - protein, 11 aa, Influenza virus
CVCINGTCTVI

SEQ ID NO: 417322 - protein, 11 aa, Influenza virus
CIDGTCTVVMT

SEQ ID NO: 417323 - protein, 11 aa, Influenza virus
INGTCTVVITD

SEQ ID NO: 417324 - protein, 11 aa, Influenza virus
TVVMTDGNASG

SEQ ID NO: 417325 - protein, 11 aa, Influenza virus
LSGGAQHVEEC

SEQ ID NO: 417326 - protein, 11 aa, Influenza virus
EECSCYPRYSG

SEQ ID NO: 417327 - protein, 11 aa, Influenza virus
DNWRGSNRPIV

SEQ ID NO: 417328 - protein, 11 aa, Influenza virus
NWRGSNRPIVD

SEQ ID NO: 417329 - protein, 11 aa, Influenza virus
WRGSNRPIVDI

SEQ ID NO: 417330 - protein, 11 aa, Influenza virus
HTGNPVICLGH

SEQ ID NO: 417331 - protein, 11 aa, Influenza virus
VEVITAQELVE

SEQ ID NO: 417332 - protein, 11 aa, Influenza virus
EVVTAQELVEP

SEQ ID NO: 417333 - protein, 11 aa, Influenza virus
VPGYQSLRSIL

SEQ ID NO: 417334 - protein, 11 aa, Influenza virus
PGYQSLRSILA

SEQ ID NO: 417335 - protein, 11 aa, Influenza virus
GYQSLRSILAN

SEQ ID NO: 417336 - protein, 11 aa, Influenza virus
NNGKLEFIAEE

SEQ ID NO: 417337 - protein, 11 aa, Influenza virus
NGKFEFIVEKF

SEQ ID NO: 417338 - protein, 11 aa, Influenza virus
AVKQNGKSGAC

SEQ ID NO: 417339 - protein, 11 aa, Influenza virus
QNLTKTNNGDY

SEQ ID NO: 417340 - protein, 11 aa, Influenza virus
VRGQSSRISFY

SEQ ID NO: 417341 - protein, 11 aa, Influenza virus
GRISVYWTIVE

SEQ ID NO: 417342 - protein, 11 aa, Influenza virus
ISFYWTIVVPG

SEQ ID NO: 417343 - protein, 11 aa, Influenza virus
SLYWTIVEPGD

SEQ ID NO: 417344 - protein, 11 aa, Influenza virus
PGDVIVFNTIG

SEQ ID NO: 417345 - protein, 11 aa, Influenza virus
GDVIVFNTIGN

SEQ ID NO: 417346 - protein, 11 aa, Influenza virus
GNCPKYVKQGS

SEQ ID NO: 417347 - protein, 11 aa, Influenza virus
NCPKYVKQGSL

SEQ ID NO: 417348 - protein, 11 aa, Influenza virus
TQAAIDQVNGK

SEQ ID NO: 417349 - protein, 11 aa, Influenza virus
QAAIDQVNGKL

SEQ ID NO: 417350 - protein, 11 aa, Influenza virus
AAIDKINGKLN

SEQ ID NO: 417351 - protein, 11 aa, Influenza virus
EFNKIEGRVQD

SEQ ID NO: 417352 - protein, 11 aa, Influenza virus
FEQVEGRIQNL

SEQ ID NO: 417353 - protein, 11 aa, Influenza virus
DLENYVEDTKI

SEQ ID NO: 417354 - protein, 11 aa, Influenza virus
HTIDVTDSEMS

SEQ ID NO: 417355 - protein, 11 aa, Influenza virus
ADSEMNKLFER

SEQ ID NO: 417356 - protein, 11 aa, Influenza virus
DSEMNKLFERI

SEQ ID NO: 417357 - protein, 11 aa, Influenza virus
CGNNCIESIRN

SEQ ID NO: 417358 - protein, 11 aa, Influenza virus
NNCIESIRNGK

SEQ ID NO: 417359 - protein, 11 aa, Influenza virus
YRDDAINNRFQ

SEQ ID NO: 417360 - protein, 11 aa, Influenza virus
RDDAINNRFQI

SEQ ID NO: 417361 - protein, 11 aa, Influenza virus
RFQIQGIKLTQ

SEQ ID NO: 417362 - protein, 11 aa, Influenza virus
FQIQGIKLTQG

SEQ ID NO: 417363 - protein, 11 aa, Influenza virus
QIQGIKLTQGY

SEQ ID NO: 417364 - protein, 11 aa, Influenza virus
IQGIKLTQGYK

SEQ ID NO: 417365 - protein, 11 aa, Influenza virus
QGIKLTQGYKD

SEQ ID NO: 417366 - protein, 11 aa, Influenza virus
FSFSISCFLLV

SEQ ID NO: 417367 - protein, 11 aa, Influenza virus
ISCFLLIALLL

SEQ ID NO: 417368 - protein, 11 aa, Influenza virus
ALLLTFILWAC

SEQ ID NO: 417369 - protein, 11 aa, Influenza virus
LLLTFILWACQ

SEQ ID NO: 417370 - protein, 11 aa, Influenza virus
LWACQNGNIRW

SEQ ID NO: 417371 - protein, 11 aa, Influenza virus
SDQICVGYHAN

SEQ ID NO: 417372 - protein, 11 aa, Influenza virus
CIGYHANKSTK

SEQ ID NO: 417373 - protein, 11 aa, Influenza virus
IIEKNVTVTHA

SEQ ID NO: 417374 - protein, 11 aa, Influenza virus
EKNITVTHAQD

SEQ ID NO: 417375 - protein, 11 aa, Influenza virus
ESNGNFITPEY

SEQ ID NO: 417376 - protein, 11 aa, Influenza virus
NFIAPEYAYKV

SEQ ID NO: 417377 - protein, 11 aa, Influenza virus
PFHNVHPLAIG

SEQ ID NO: 417378 - protein, 11 aa, Influenza virus
HPLAIGECPKY

SEQ ID NO: 417379 - protein, 11 aa, Influenza virus
TIGECPKYVRS

SEQ ID NO: 417380 - protein, 11 aa, Influenza virus
QGSGYAADRKS

SEQ ID NO: 417381 - protein, 11 aa, Influenza virus
GSGYAADKESS

SEQ ID NO: 417382 - protein, 11 aa, Influenza virus
GYAADRESTQK

SEQ ID NO: 417383 - protein, 11 aa, Influenza virus
YAADRESTQKA

SEQ ID NO: 417384 - protein, 11 aa, Influenza virus
DIWTYNAELLV

SEQ ID NO: 417385 - protein, 11 aa, Influenza virus
FHDSNVKNLYN

SEQ ID NO: 417386 - protein, 11 aa, Influenza virus
HDSNVKNLYNK

SEQ ID NO: 417387 - protein, 11 aa, Influenza virus
VRLQLRDNARE

SEQ ID NO: 417388 - protein, 11 aa, Influenza virus
RLQLRDNAREL

SEQ ID NO: 417389 - protein, 11 aa, Influenza virus
LQLRDNARELG

SEQ ID NO: 417390 - protein, 11 aa, Influenza virus
LSLYSTVASSL

SEQ ID NO: 417391 - protein, 11 aa, Influenza virus
LWMCSHGSLQC

SEQ ID NO: 417392 - protein, 11 aa, Influenza virus
ANNSTEHVDTI

SEQ ID NO: 417393 - protein, 11 aa, Influenza virus
NNSTEHVDTIM

SEQ ID NO: 417394 - protein, 11 aa, Influenza virus
QVDTIMEKNIT

SEQ ID NO: 417395 - protein, 11 aa, Influenza virus
EKNITVTHAQD

SEQ ID NO: 417396 - protein, 11 aa, Influenza virus
KNITVTHAQDI

SEQ ID NO: 417397 - protein, 11 aa, Influenza virus
RPLILKDCSIA

SEQ ID NO: 417398 - protein, 11 aa, Influenza virus
KVQEWSYIVEK

SEQ ID NO: 417399 - protein, 11 aa, Influenza virus
YEELKHLLSRT

SEQ ID NO: 417400 - protein, 11 aa, Influenza virus
THISVGTSTLN

SEQ ID NO: 417401 - protein, 11 aa, Influenza virus
VSIGTSTLNQR

SEQ ID NO: 417402 - protein, 11 aa, Influenza virus
SVGTSTLNQRM

SEQ ID NO: 417403 - protein, 11 aa, Influenza virus
NFESNGNFITP

SEQ ID NO: 417404 - protein, 11 aa, Influenza virus
ESDGNFIAPEN

SEQ ID NO: 417405 - protein, 11 aa, Influenza virus
NFIAPEYAYKV

SEQ ID NO: 417406 - protein, 11 aa, Influenza virus
AINTSMPFHNI

SEQ ID NO: 417407 - protein, 11 aa, Influenza virus
TSMPFHNIHPL

SEQ ID NO: 417408 - protein, 11 aa, Influenza virus
IGKCPKYVKSN

SEQ ID NO: 417409 - protein, 11 aa, Influenza virus
VDGWYGYHHSK

SEQ ID NO: 417410 - protein, 11 aa, Influenza virus
KEQGSGYAADK

SEQ ID NO: 417411 - protein, 11 aa, Influenza virus
STQKAMDGVTN

SEQ ID NO: 417412 - protein, 11 aa, Influenza virus
TQKAMDGVTNK

SEQ ID NO: 417413 - protein, 11 aa, Influenza virus
AMDGVTNKVNS

SEQ ID NO: 417414 - protein, 11 aa, Influenza virus
MDGVTNKVNSI

SEQ ID NO: 417415 - protein, 11 aa, Influenza virus
GITNKINSIID

SEQ ID NO: 417416 - protein, 11 aa, Influenza virus
ITNKINSIIDK

SEQ ID NO: 417417 - protein, 11 aa, Influenza virus
IIDKMNTRFEA

SEQ ID NO: 417418 - protein, 11 aa, Influenza virus
KMNTQFETVGK

SEQ ID NO: 417419 - protein, 11 aa, Influenza virus
MNTQFETVGKE

SEQ ID NO: 417420 - protein, 11 aa, Influenza virus
NIQFEAVGREF

SEQ ID NO: 417421 - protein, 11 aa, Influenza virus
ERRVENLNKKM

SEQ ID NO: 417422 - protein, 11 aa, Influenza virus
RRVENLNKKME

SEQ ID NO: 417423 - protein, 11 aa, Influenza virus
GTYQILSLYST

SEQ ID NO: 417424 - protein, 11 aa, Influenza virus
YSTVVSSLALA

SEQ ID NO: 417425 - protein, 11 aa, Influenza virus
STVVSSLALAI

SEQ ID NO: 417426 - protein, 11 aa, Influenza virus
AGLSLWMCFNG

SEQ ID NO: 417427 - protein, 11 aa, Influenza virus
GLSLWMCFNGS

SEQ ID NO: 417428 - protein, 11 aa, Influenza virus
LWMCSHGSLQC

SEQ ID NO: 417429 - protein, 11 aa, Influenza virus
CFNGSLQCRIC

SEQ ID NO: 417430 - protein, 11 aa, Influenza virus
NQNSTWVSQTY

SEQ ID NO: 417431 - protein, 11 aa, Influenza virus
HSKDNGIRIGS

SEQ ID NO: 417432 - protein, 11 aa, Influenza virus
APFISCSYLEC

SEQ ID NO: 417433 - protein, 11 aa, Influenza virus
PFISCSYLECR

SEQ ID NO: 417434 - protein, 11 aa, Influenza virus
ISCSYLECRTF

SEQ ID NO: 417435 - protein, 11 aa, Influenza virus
SCSHLECRTFS

SEQ ID NO: 417436 - protein, 11 aa, Influenza virus
CSQLECRTFFL

SEQ ID NO: 417437 - protein, 11 aa, Influenza virus
SHLECRTFFLA

SEQ ID NO: 417438 - protein, 11 aa, Influenza virus
HSNGTAKDRSP

SEQ ID NO: 417439 - protein, 11 aa, Influenza virus
KDRSPQRTLMS

SEQ ID NO: 417440 - protein, 11 aa, Influenza virus
DRSPHRSLMSC

SEQ ID NO: 417441 - protein, 11 aa, Influenza virus
RSPHRSLMSCP

SEQ ID NO: 417442 - protein, 11 aa, Influenza virus
GESPSPYNSRF

SEQ ID NO: 417443 - protein, 11 aa, Influenza virus
WSASACHDGAS

SEQ ID NO: 417444 - protein, 11 aa, Influenza virus
SASACHDGASW

SEQ ID NO: 417445 - protein, 11 aa, Influenza virus
ASACHDGASWL

SEQ ID NO: 417446 - protein, 11 aa, Influenza virus
IGISGPDDGAV

SEQ ID NO: 417447 - protein, 11 aa, Influenza virus
GISGPDDGAVA

SEQ ID NO: 417448 - protein, 11 aa, Influenza virus
ISGPDDGAVAV

SEQ ID NO: 417449 - protein, 11 aa, Influenza virus
SGPDDGAVAVL

SEQ ID NO: 417450 - protein, 11 aa, Influenza virus
GPDDGAVAVLK

SEQ ID NO: 417451 - protein, 11 aa, Influenza virus
PDDGAVAVLKY

SEQ ID NO: 417452 - protein, 11 aa, Influenza virus
GSCFTLMTDGP

SEQ ID NO: 417453 - protein, 11 aa, Influenza virus
GYICSGFFGDN

SEQ ID NO: 417454 - protein, 11 aa, Influenza virus
YICSGFFGDNP

SEQ ID NO: 417455 - protein, 11 aa, Influenza virus
ICSGFFGDNPR

SEQ ID NO: 417456 - protein, 11 aa, Influenza virus
CSGFFGDNPRP

SEQ ID NO: 417457 - protein, 11 aa, Influenza virus
YKYGNGVWIGR

SEQ ID NO: 417458 - protein, 11 aa, Influenza virus
SRSGFEMIWDS

SEQ ID NO: 417459 - protein, 11 aa, Influenza virus
ITNWSGYSGSF

SEQ ID NO: 417460 - protein, 11 aa, Influenza virus
FVQHPELTGVD

SEQ ID NO: 417461 - protein, 11 aa, Influenza virus
VQHPELTGVDC

SEQ ID NO: 417462 - protein, 11 aa, Influenza virus
DCIKPCFWVEL

SEQ ID NO: 417463 - protein, 11 aa, Influenza virus
FWIELIRGRPK

SEQ ID NO: 417464 - protein, 11 aa, Influenza virus
WIELIRGRPKE

SEQ ID NO: 417465 - protein, 11 aa, Influenza virus
IWTSGSIISFC

SEQ ID NO: 417466 - protein, 11 aa, Influenza virus
WSWPDDAELPL

SEQ ID NO: 417467 - protein, 11 aa, Influenza virus
CVGYHANNSTK

SEQ ID NO: 417468 - protein, 11 aa, Influenza virus
VGYHANNSTKQ

SEQ ID NO: 417469 - protein, 11 aa, Influenza virus
GHHANNSTEQV

SEQ ID NO: 417470 - protein, 11 aa, Influenza virus
YHANNSKKQID

SEQ ID NO: 417471 - protein, 11 aa, Influenza virus
ANNSPEQVDTI

SEQ ID NO: 417472 - protein, 11 aa, Influenza virus
DTIREKNVTVT

SEQ ID NO: 417473 - protein, 11 aa, Influenza virus
PEWSYIVEKAN

SEQ ID NO: 417474 - protein, 11 aa, Influenza virus
SFFRNIVWLIK

SEQ ID NO: 417475 - protein, 11 aa, Influenza virus
FFRNIVWLIKK

SEQ ID NO: 417476 - protein, 11 aa, Influenza virus
VDGWYGYHHNN

SEQ ID NO: 417477 - protein, 11 aa, Influenza virus
GGGYAADKEST

SEQ ID NO: 417478 - protein, 11 aa, Influenza virus
SGYAANKESTQ

SEQ ID NO: 417479 - protein, 11 aa, Influenza virus
GYGEDNESTQK

SEQ ID NO: 417480 - protein, 11 aa, Influenza virus
YAEGQESPPKA

SEQ ID NO: 417481 - protein, 11 aa, Influenza virus
SYNAELLVLME

SEQ ID NO: 417482 - protein, 11 aa, Influenza virus
YNAEFFVLMEN

SEQ ID NO: 417483 - protein, 11 aa, Influenza virus
NAEFFVLMENE

SEQ ID NO: 417484 - protein, 11 aa, Influenza virus
EFLVLMENERT

SEQ ID NO: 417485 - protein, 11 aa, Influenza virus
FLVLMENERTL

SEQ ID NO: 417486 - protein, 11 aa, Influenza virus
VLMETERTLDF

SEQ ID NO: 417487 - protein, 11 aa, Influenza virus
LMETERTLDFH

SEQ ID NO: 417488 - protein, 11 aa, Influenza virus
MVNERTLDFHD

SEQ ID NO: 417489 - protein, 11 aa, Influenza virus
LHDSNVKNLYN

SEQ ID NO: 417490 - protein, 11 aa, Influenza virus
DNAKEWGNGCF

SEQ ID NO: 417491 - protein, 11 aa, Influenza virus
ANELGNGCFEF

SEQ ID NO: 417492 - protein, 11 aa, Influenza virus
NELGNGCFEFY

SEQ ID NO: 417493 - protein, 11 aa, Influenza virus
ECIESVRNGTY

SEQ ID NO: 417494 - protein, 11 aa, Influenza virus
ILTIYSTVASS

SEQ ID NO: 417495 - protein, 11 aa, Influenza virus
LTIYSTVASSL

SEQ ID NO: 417496 - protein, 11 aa, Influenza virus
LAIIIAGLSFW

SEQ ID NO: 417497 - protein, 11 aa, Influenza virus
VAGLSLWMCSN

SEQ ID NO: 417498 - protein, 11 aa, Influenza virus
KPQCKITGFAP

SEQ ID NO: 417499 - protein, 11 aa, Influenza virus
PQCKITGFAPF

SEQ ID NO: 417500 - protein, 11 aa, Influenza virus
WVTRESYVSCG

SEQ ID NO: 417501 - protein, 11 aa, Influenza virus
PYRTLLMNELG

SEQ ID NO: 417502 - protein, 11 aa, Influenza virus
CIAWSSSSCYD

SEQ ID NO: 417503 - protein, 11 aa, Influenza virus
IAWSRSSCHDG

SEQ ID NO: 417504 - protein, 11 aa, Influenza virus
AWSRSSCHDGK

SEQ ID NO: 417505 - protein, 11 aa, Influenza virus
WSRSSCHDGKA

SEQ ID NO: 417506 - protein, 11 aa, Influenza virus
SRSSCHDGKAW

SEQ ID NO: 417507 - protein, 11 aa, Influenza virus
RSSCHDGKAWL

SEQ ID NO: 417508 - protein, 11 aa, Influenza virus
CHDGRAWLHIC

SEQ ID NO: 417509 - protein, 11 aa, Influenza virus
RTQESECICIN

SEQ ID NO: 417510 - protein, 11 aa, Influenza virus
CTVVLTDGSAS

SEQ ID NO: 417511 - protein, 11 aa, Influenza virus
VTCVCRDNWKS

SEQ ID NO: 417512 - protein, 11 aa, Influenza virus
SSSNCRDSNNE

SEQ ID NO: 417513 - protein, 11 aa, Influenza virus
ENPGVKGWAFD

SEQ ID NO: 417514 - protein, 11 aa, Influenza virus
SRSGYETFRII

SEQ ID NO: 417515 - protein, 11 aa, Influenza virus
HCINRCFYVEL

SEQ ID NO: 417516 - protein, 11 aa, Influenza virus
WPDGADINYMP

SEQ ID NO: 417517 - protein, 11 aa, Influenza virus
ANNSTTQIDTI

SEQ ID NO: 417518 - protein, 11 aa, Influenza virus
VNTILEKNVTV

SEQ ID NO: 417519 - protein, 11 aa, Influenza virus
NTILEKNVTVT

SEQ ID NO: 417520 - protein, 11 aa, Influenza virus
TVTHSVELLED

SEQ ID NO: 417521 - protein, 11 aa, Influenza virus
GNLVAPWYAYR

SEQ ID NO: 417522 - protein, 11 aa, Influenza virus
NRTFQNVSPLW

SEQ ID NO: 417523 - protein, 11 aa, Influenza virus
DGLLDVWTYNA

SEQ ID NO: 417524 - protein, 11 aa, Influenza virus
FLGVWTYNAEL

SEQ ID NO: 417525 - protein, 11 aa, Influenza virus
AEMLVLLENER

SEQ ID NO: 417526 - protein, 11 aa, Influenza virus
ENERTLDQHDA

SEQ ID NO: 417527 - protein, 11 aa, Influenza virus
NERTLDMHDVN

SEQ ID NO: 417528 - protein, 11 aa, Influenza virus
LRDNAMILGNG

SEQ ID NO: 417529 - protein, 11 aa, Influenza virus
RDNAMILGNGC

SEQ ID NO: 417530 - protein, 11 aa, Influenza virus
ISSSLVLVGLI

SEQ ID NO: 417531 - protein, 11 aa, Influenza virus
WMCLNGSMQCR

SEQ ID NO: 417532 - protein, 11 aa, Influenza virus
KSRGYKMNTKI

SEQ ID NO: 417533 - protein, 11 aa, Influenza virus
SRGYKMNIQIL

SEQ ID NO: 417534 - protein, 11 aa, Influenza virus
LTGRGIEVVNA

SEQ ID NO: 417535 - protein, 11 aa, Influenza virus
EVVNATETVEN

SEQ ID NO: 417536 - protein, 11 aa, Influenza virus
NGAFIAPDRAT

SEQ ID NO: 417537 - protein, 11 aa, Influenza virus
GAFIAPDRATF

SEQ ID NO: 417538 - protein, 11 aa, Influenza virus
SILLATGMRNV

SEQ ID NO: 417539 - protein, 11 aa, Influenza virus
LRLATGMRNVP

SEQ ID NO: 417540 - protein, 11 aa, Influenza virus
LQATGMKNVPE

SEQ ID NO: 417541 - protein, 11 aa, Influenza virus
EGLIDGWYGFK

SEQ ID NO: 417542 - protein, 11 aa, Influenza virus
GLIDGWYGFKH

SEQ ID NO: 417543 - protein, 11 aa, Influenza virus
LIDGWYGFKHQ

SEQ ID NO: 417544 - protein, 11 aa, Influenza virus
IDGWYGFKHQN

SEQ ID NO: 417545 - protein, 11 aa, Influenza virus
GWYGYKHQNAQ

SEQ ID NO: 417546 - protein, 11 aa, Influenza virus
WYGYKHQNAQG

SEQ ID NO: 417547 - protein, 11 aa, Influenza virus
YGYKHQNAQGE

SEQ ID NO: 417548 - protein, 11 aa, Influenza virus
GYKHQNAQGEG

SEQ ID NO: 417549 - protein, 11 aa, Influenza virus
TQAAIDQITGK

SEQ ID NO: 417550 - protein, 11 aa, Influenza virus
QAAIDQITGKL

SEQ ID NO: 417551 - protein, 11 aa, Influenza virus
AIDQITGKLNH

SEQ ID NO: 417552 - protein, 11 aa, Influenza virus
DQITGKLNHLI

SEQ ID NO: 417553 - protein, 11 aa, Influenza virus
EKQIGNLINWT

SEQ ID NO: 417554 - protein, 11 aa, Influenza virus
LLVAIENQHTI

SEQ ID NO: 417555 - protein, 11 aa, Influenza virus
VAIENQHTIDL

SEQ ID NO: 417556 - protein, 11 aa, Influenza virus
AIENQHTIDLA

SEQ ID NO: 417557 - protein, 11 aa, Influenza virus
VKRLLRENAEE

SEQ ID NO: 417558 - protein, 11 aa, Influenza virus
KRLLRENAEED

SEQ ID NO: 417559 - protein, 11 aa, Influenza virus
CMASIRNNTYN

SEQ ID NO: 417560 - protein, 11 aa, Influenza virus
MASIRNSTYDH

SEQ ID NO: 417561 - protein, 11 aa, Influenza virus
NGYKDVILWFS

SEQ ID NO: 417562 - protein, 11 aa, Influenza virus
WFSFGASCFTL

SEQ ID NO: 417563 - protein, 11 aa, Influenza virus
ARGDKICLGHH

SEQ ID NO: 417564 - protein, 11 aa, Influenza virus
CGLLGTVTGPP

SEQ ID NO: 417565 - protein, 11 aa, Influenza virus
DLIIERREGSD

SEQ ID NO: 417566 - protein, 11 aa, Influenza virus
LRQVLRRSGGI

SEQ ID NO: 417567 - protein, 11 aa, Influenza virus
RLGPSFYAEMK

SEQ ID NO: 417568 - protein, 11 aa, Influenza virus
SDSSFYAEMKW

SEQ ID NO: 417569 - protein, 11 aa, Influenza virus
TKLYGSGSKLI

SEQ ID NO: 417570 - protein, 11 aa, Influenza virus
ARRIDFNWLLL

SEQ ID NO: 417571 - protein, 11 aa, Influenza virus
RRIDFHWLFLD

SEQ ID NO: 417572 - protein, 11 aa, Influenza virus
QSGRIDFHWLV

SEQ ID NO: 417573 - protein, 11 aa, Influenza virus
SGRIDFHWLVL

SEQ ID NO: 417574 - protein, 11 aa, Influenza virus
GRIDFHWLVLN

SEQ ID NO: 417575 - protein, 11 aa, Influenza virus
GGTIASNLPFQ

SEQ ID NO: 417576 - protein, 11 aa, Influenza virus
IVSSLPFQSIN

SEQ ID NO: 417577 - protein, 11 aa, Influenza virus
AVGKCPKYVKQ

SEQ ID NO: 417578 - protein, 11 aa, Influenza virus
VKQKSILLATG

SEQ ID NO: 417579 - protein, 11 aa, Influenza virus
KSILLATGMRN

SEQ ID NO: 417580 - protein, 11 aa, Influenza virus
LATGMRNIPEK

SEQ ID NO: 417581 - protein, 11 aa, Influenza virus
ATGMRNIPEKP

SEQ ID NO: 417582 - protein, 11 aa, Influenza virus
TGMRNIPEKPK

SEQ ID NO: 417583 - protein, 11 aa, Influenza virus
KLNHLIGKTNQ

SEQ ID NO: 417584 - protein, 11 aa, Influenza virus
LNHLIGKTNQQ

SEQ ID NO: 417585 - protein, 11 aa, Influenza virus
NHLIGKTNQQF

SEQ ID NO: 417586 - protein, 11 aa, Influenza virus
LIGRTNQQFEL

SEQ ID NO: 417587 - protein, 11 aa, Influenza virus
IGRTNQQFELI

SEQ ID NO: 417588 - protein, 11 aa, Influenza virus
TNQQFELIGNE

SEQ ID NO: 417589 - protein, 11 aa, Influenza virus
NQQFELIDSEF

SEQ ID NO: 417590 - protein, 11 aa, Influenza virus
NEFTEIEQQIG

SEQ ID NO: 417591 - protein, 11 aa, Influenza virus
TEIEQQIGNVI

SEQ ID NO: 417592 - protein, 11 aa, Influenza virus
INWTRDSITEV

SEQ ID NO: 417593 - protein, 11 aa, Influenza virus
NWTRDSITEVW

SEQ ID NO: 417594 - protein, 11 aa, Influenza virus
WTRDSITEVWS

SEQ ID NO: 417595 - protein, 11 aa, Influenza virus
TRDSITEVWSY

SEQ ID NO: 417596 - protein, 11 aa, Influenza virus
RDSITEVWSYN

SEQ ID NO: 417597 - protein, 11 aa, Influenza virus
IDLADSEMKKL

SEQ ID NO: 417598 - protein, 11 aa, Influenza virus
DLADSEMKKLY

SEQ ID NO: 417599 - protein, 11 aa, Influenza virus
SEMKKLYERVR

SEQ ID NO: 417600 - protein, 11 aa, Influenza virus
SIRNNTYDHSR

SEQ ID NO: 417601 - protein, 11 aa, Influenza virus
IRNNTYDHSRY

SEQ ID NO: 417602 - protein, 11 aa, Influenza virus
RNNTYDHSRYR

SEQ ID NO: 417603 - protein, 11 aa, Influenza virus
TYREEAMQNRL

SEQ ID NO: 417604 - protein, 11 aa, Influenza virus
KEAMQNRIQID

SEQ ID NO: 417605 - protein, 11 aa, Influenza virus
ESLQNRIQIGP

SEQ ID NO: 417606 - protein, 11 aa, Influenza virus
IQINPVKLSSG

SEQ ID NO: 417607 - protein, 11 aa, Influenza virus
KIDPVKLSSGY

SEQ ID NO: 417608 - protein, 11 aa, Influenza virus
GPVKLSSGYKD

SEQ ID NO: 417609 - protein, 11 aa, Influenza virus
PVKLSGGYKDI

SEQ ID NO: 417610 - protein, 11 aa, Influenza virus
GASCFILLAIV

SEQ ID NO: 417611 - protein, 11 aa, Influenza virus
AMGLVFICMKN

SEQ ID NO: 417612 - protein, 11 aa, Influenza virus
LVFICMKNGNM

SEQ ID NO: 417613 - protein, 11 aa, Influenza virus
VFICMKNGNMQ

SEQ ID NO: 417614 - protein, 11 aa, Influenza virus
FICMKNGNMQC

SEQ ID NO: 417615 - protein, 11 aa, Influenza virus
ICIKNGNVRCT

SEQ ID NO: 417616 - protein, 11 aa, Influenza virus
TIGSVSLTIAA

SEQ ID NO: 417617 - protein, 11 aa, Influenza virus
ERNVTETLYLN

SEQ ID NO: 417618 - protein, 11 aa, Influenza virus
NITKIVYLNST

SEQ ID NO: 417619 - protein, 11 aa, Influenza virus
YKSWSKPQCQI

SEQ ID NO: 417620 - protein, 11 aa, Influenza virus
NSIRLSAGGNI

SEQ ID NO: 417621 - protein, 11 aa, Influenza virus
SIRLSAGGNIW

SEQ ID NO: 417622 - protein, 11 aa, Influenza virus
RLSAGGNIWIT

SEQ ID NO: 417623 - protein, 11 aa, Influenza virus
LSAGGNIWITR

SEQ ID NO: 417624 - protein, 11 aa, Influenza virus
SASGDIWITRE

SEQ ID NO: 417625 - protein, 11 aa, Influenza virus
AGGNIWITREP

SEQ ID NO: 417626 - protein, 11 aa, Influenza virus
GGNIWITREPY

SEQ ID NO: 417627 - protein, 11 aa, Influenza virus
NRCYQFALGQG

SEQ ID NO: 417628 - protein, 11 aa, Influenza virus
ALGQGTTLNNK

SEQ ID NO: 417629 - protein, 11 aa, Influenza virus
LGQGTTLNNKH

SEQ ID NO: 417630 - protein, 11 aa, Influenza virus
GQGTTLNNKHS

SEQ ID NO: 417631 - protein, 11 aa, Influenza virus
QGTTLNNKHSN

SEQ ID NO: 417632 - protein, 11 aa, Influenza virus
GTTLNNKHSNG

SEQ ID NO: 417633 - protein, 11 aa, Influenza virus
TTLNNKHSNGT

SEQ ID NO: 417634 - protein, 11 aa, Influenza virus
KHSNGTTHDRT

SEQ ID NO: 417635 - protein, 11 aa, Influenza virus
DRIPHRTLLMS

SEQ ID NO: 417636 - protein, 11 aa, Influenza virus
RIPHRTLLMSE

SEQ ID NO: 417637 - protein, 11 aa, Influenza virus
IPHRTLLMSEL

SEQ ID NO: 417638 - protein, 11 aa, Influenza virus
WLHVCVTGDDG

SEQ ID NO: 417639 - protein, 11 aa, Influenza virus
LHVCVTGDDGN

SEQ ID NO: 417640 - protein, 11 aa, Influenza virus
HVCVTGDDGNA

SEQ ID NO: 417641 - protein, 11 aa, Influenza virus
VCVTGDDGNAT

SEQ ID NO: 417642 - protein, 11 aa, Influenza virus
SECVCINGSCI

SEQ ID NO: 417643 - protein, 11 aa, Influenza virus
ECVCINGSCIV

SEQ ID NO: 417644 - protein, 11 aa, Influenza virus
CVCINGSCIVV

SEQ ID NO: 417645 - protein, 11 aa, Influenza virus
VCINGSCIVVM

SEQ ID NO: 417646 - protein, 11 aa, Influenza virus
CINGSCIVVMT

SEQ ID NO: 417647 - protein, 11 aa, Influenza virus
INGSCIVVMTD

SEQ ID NO: 417648 - protein, 11 aa, Influenza virus
GTCAVVMTDGS

SEQ ID NO: 417649 - protein, 11 aa, Influenza virus
SCAVVMTDGSA

SEQ ID NO: 417650 - protein, 11 aa, Influenza virus
MTDGSASRKAD

SEQ ID NO: 417651 - protein, 11 aa, Influenza virus
TDGSASRKADT

SEQ ID NO: 417652 - protein, 11 aa, Influenza virus
EGKVVHISPLS

SEQ ID NO: 417653 - protein, 11 aa, Influenza virus
GKVVHISPLSG

SEQ ID NO: 417654 - protein, 11 aa, Influenza virus
VVHISPLSGSA

SEQ ID NO: 417655 - protein, 11 aa, Influenza virus
VHISSLSGSAQ

SEQ ID NO: 417656 - protein, 11 aa, Influenza virus
DTPRNDDSSSN

SEQ ID NO: 417657 - protein, 11 aa, Influenza virus
TPRNEDSSSNS

SEQ ID NO: 417658 - protein, 11 aa, Influenza virus
PRNEDSSSNSN

SEQ ID NO: 417659 - protein, 11 aa, Influenza virus
RNDDSSSNSNC

SEQ ID NO: 417660 - protein, 11 aa, Influenza virus
DPNEERGSPGV

SEQ ID NO: 417661 - protein, 11 aa, Influenza virus
PNEERGSPGVK

SEQ ID NO: 417662 - protein, 11 aa, Influenza virus
NEERGSPGVKG

SEQ ID NO: 417663 - protein, 11 aa, Influenza virus
EERGSPGVKGW

SEQ ID NO: 417664 - protein, 11 aa, Influenza virus
GVKGWAFDNGN

SEQ ID NO: 417665 - protein, 11 aa, Influenza virus
VKGWAFDNGND

SEQ ID NO: 417666 - protein, 11 aa, Influenza virus
NGNDVWMGRTI

SEQ ID NO: 417667 - protein, 11 aa, Influenza virus
YETFKVIGGWT

SEQ ID NO: 417668 - protein, 11 aa, Influenza virus
VIDGWTTANSK

SEQ ID NO: 417669 - protein, 11 aa, Influenza virus
IDGWTTANSKS

SEQ ID NO: 417670 - protein, 11 aa, Influenza virus
VNNNNWSGYSG

SEQ ID NO: 417671 - protein, 11 aa, Influenza virus
PQETKVWWTSN

SEQ ID NO: 417672 - protein, 11 aa, Influenza virus
QETRVWWTSSS

SEQ ID NO: 417673 - protein, 11 aa, Influenza virus
EARVWWTSNSI

SEQ ID NO: 417674 - protein, 11 aa, Influenza virus
LGHHAVTNGTK

SEQ ID NO: 417675 - protein, 11 aa, Influenza virus
GHHAVTNGTKV

SEQ ID NO: 417676 - protein, 11 aa, Influenza virus
VNTLTGRGIEV

SEQ ID NO: 417677 - protein, 11 aa, Influenza virus
TLTGRGIEVVN

SEQ ID NO: 417678 - protein, 11 aa, Influenza virus
LTGRGIEVVNA

SEQ ID NO: 417679 - protein, 11 aa, Influenza virus
TGRGIEVVNAT

SEQ ID NO: 417680 - protein, 11 aa, Influenza virus
GRGIEVVNATE

SEQ ID NO: 417681 - protein, 11 aa, Influenza virus
EVVNATETVEN

SEQ ID NO: 417682 - protein, 11 aa, Influenza virus
CGLLGIITGPP

SEQ ID NO: 417683 - protein, 11 aa, Influenza virus
GLLGIITGPPQ

SEQ ID NO: 417684 - protein, 11 aa, Influenza virus
LLGIITGPPQC

SEQ ID NO: 417685 - protein, 11 aa, Influenza virus
LGIITGPPQCD

SEQ ID NO: 417686 - protein, 11 aa, Influenza virus
LRQILRGSGGV

SEQ ID NO: 417687 - protein, 11 aa, Influenza virus
DSSFYAEMKWL

SEQ ID NO: 417688 - protein, 11 aa, Influenza virus
EMKWLLSNSNN

SEQ ID NO: 417689 - protein, 11 aa, Influenza virus
LYGSENKLITV

SEQ ID NO: 417690 - protein, 11 aa, Influenza virus
SSKCQQSFTPS

SEQ ID NO: 417691 - protein, 11 aa, Influenza virus
SKCQQSFTPSP

SEQ ID NO: 417692 - protein, 11 aa, Influenza virus
KCQQSFTPSPG

SEQ ID NO: 417693 - protein, 11 aa, Influenza virus
VNGQSGRINFH

SEQ ID NO: 417694 - protein, 11 aa, Influenza virus
DGQSGRIDFHW

SEQ ID NO: 417695 - protein, 11 aa, Influenza virus
GQTGRIDFHWL

SEQ ID NO: 417696 - protein, 11 aa, Influenza virus
FNFNGAFIAPD

SEQ ID NO: 417697 - protein, 11 aa, Influenza virus
GGTIASSLPFQ

SEQ ID NO: 417698 - protein, 11 aa, Influenza virus
GTIASSLPFQN

SEQ ID NO: 417699 - protein, 11 aa, Influenza virus
TIASSLPFQNI

SEQ ID NO: 417700 - protein, 11 aa, Influenza virus
IASSLPFQNIN

SEQ ID NO: 417701 - protein, 11 aa, Influenza virus
TGMKNVPEIPR

SEQ ID NO: 417702 - protein, 11 aa, Influenza virus
KKRGLFGAIAG

SEQ ID NO: 417703 - protein, 11 aa, Influenza virus
AYQKQMTRGLF

SEQ ID NO: 417704 - protein, 11 aa, Influenza virus
YQKQMTRGLFG

SEQ ID NO: 417705 - protein, 11 aa, Influenza virus
QKQMTRGLFGA

SEQ ID NO: 417706 - protein, 11 aa, Influenza virus
ITGKLNRLIDR

SEQ ID NO: 417707 - protein, 11 aa, Influenza virus
TGKLNRFIEKT

SEQ ID NO: 417708 - protein, 11 aa, Influenza virus
GKLNRFIEKTN

SEQ ID NO: 417709 - protein, 11 aa, Influenza virus
KLNRLIDRTNH

SEQ ID NO: 417710 - protein, 11 aa, Influenza virus
LNRLIDRTNHQ

SEQ ID NO: 417711 - protein, 11 aa, Influenza virus
NRFIEKTNQQF

SEQ ID NO: 417712 - protein, 11 aa, Influenza virus
IDRTNHQFELI

SEQ ID NO: 417713 - protein, 11 aa, Influenza virus
DRTNHQFELID

SEQ ID NO: 417714 - protein, 11 aa, Influenza virus
IDWTRDSVTEL

SEQ ID NO: 417715 - protein, 11 aa, Influenza virus
WTRDAMTEIWS

SEQ ID NO: 417716 - protein, 11 aa, Influenza virus
TRDAMTEIWSY

SEQ ID NO: 417717 - protein, 11 aa, Influenza virus
RDAMTEIWSYN

SEQ ID NO: 417718 - protein, 11 aa, Influenza virus
DAMTEIWSYNA

SEQ ID NO: 417719 - protein, 11 aa, Influenza virus
SITELWSYNAE

SEQ ID NO: 417720 - protein, 11 aa, Influenza virus
MTEVWSYNAEF

SEQ ID NO: 417721 - protein, 11 aa, Influenza virus
DLANSEMNKLY

SEQ ID NO: 417722 - protein, 11 aa, Influenza virus
ANSEMNKLYER

SEQ ID NO: 417723 - protein, 11 aa, Influenza virus
DSEMNKLHERV

SEQ ID NO: 417724 - protein, 11 aa, Influenza virus
KLYTRVKRQLR

SEQ ID NO: 417725 - protein, 11 aa, Influenza virus
LHERVRKQLRE

SEQ ID NO: 417726 - protein, 11 aa, Influenza virus
HERVRKQLREN

SEQ ID NO: 417727 - protein, 11 aa, Influenza virus
ASIRNNTYDHN

SEQ ID NO: 417728 - protein, 11 aa, Influenza virus
QNRVKIDPVKL

SEQ ID NO: 417729 - protein, 11 aa, Influenza virus
NSGYKDIILWF

SEQ ID NO: 417730 - protein, 11 aa, Influenza virus
NGYKDVILWFS

SEQ ID NO: 417731 - protein, 11 aa, Influenza virus
FSFGASCFIFL

SEQ ID NO: 417732 - protein, 11 aa, Influenza virus
SFGASCFIFLA

SEQ ID NO: 417733 - protein, 11 aa, Influenza virus
FGASCFVLLAI

SEQ ID NO: 417734 - protein, 11 aa, Influenza virus
FICIKDGNMRC

SEQ ID NO: 417735 - protein, 11 aa, Influenza virus
GSVNTVLSIIA

SEQ ID NO: 417736 - protein, 11 aa, Influenza virus
VVNTALSTIAL

SEQ ID NO: 417737 - protein, 11 aa, Influenza virus
VNTVLSIIALL

SEQ ID NO: 417738 - protein, 11 aa, Influenza virus
NTVLSIIALLI

SEQ ID NO: 417739 - protein, 11 aa, Influenza virus
TALSTIALLIG

SEQ ID NO: 417740 - protein, 11 aa, Influenza virus
LSTKALLIGIG

SEQ ID NO: 417741 - protein, 11 aa, Influenza virus
SIIALLIGIGN

SEQ ID NO: 417742 - protein, 11 aa, Influenza virus
IIALLIGIGNL

SEQ ID NO: 417743 - protein, 11 aa, Influenza virus
IGVGNLAFNTV

SEQ ID NO: 417744 - protein, 11 aa, Influenza virus
GIGNLAFNAVI

SEQ ID NO: 417745 - protein, 11 aa, Influenza virus
VGNLAFNTVIH

SEQ ID NO: 417746 - protein, 11 aa, Influenza virus
GNLVFNTVIHG

SEQ ID NO: 417747 - protein, 11 aa, Influenza virus
TYNNTVINNMT

SEQ ID NO: 417748 - protein, 11 aa, Influenza virus
NNHTTINNITN

SEQ ID NO: 417749 - protein, 11 aa, Influenza virus
NHTTINNITNV

SEQ ID NO: 417750 - protein, 11 aa, Influenza virus
HTTINNITNVV

SEQ ID NO: 417751 - protein, 11 aa, Influenza virus
TTINNITNVVL

SEQ ID NO: 417752 - protein, 11 aa, Influenza virus
SLPLCPFKGFF

SEQ ID NO: 417753 - protein, 11 aa, Influenza virus
NCWSFALAQGV

SEQ ID NO: 417754 - protein, 11 aa, Influenza virus
ALAQGVLLGTK

SEQ ID NO: 417755 - protein, 11 aa, Influenza virus
LAQGVLLGTKH

SEQ ID NO: 417756 - protein, 11 aa, Influenza virus
AQGVLLGTKHS

SEQ ID NO: 417757 - protein, 11 aa, Influenza virus
QGVLLGTKHSN

SEQ ID NO: 417758 - protein, 11 aa, Influenza virus
GVLLGTKHSNG

SEQ ID NO: 417759 - protein, 11 aa, Influenza virus
VLLGTKHSNGT

SEQ ID NO: 417760 - protein, 11 aa, Influenza virus
TSYRSLIRFPI

SEQ ID NO: 417761 - protein, 11 aa, Influenza virus
PYRSLIRFPVG

SEQ ID NO: 417762 - protein, 11 aa, Influenza virus
YRSLIRFPVGT

SEQ ID NO: 417763 - protein, 11 aa, Influenza virus
RSLIRFPVGTA

SEQ ID NO: 417764 - protein, 11 aa, Influenza virus
SLIRFPVGTAP

SEQ ID NO: 417765 - protein, 11 aa, Influenza virus
FPVGTAPVLGN

SEQ ID NO: 417766 - protein, 11 aa, Influenza virus
PVGTAPVLGNY

SEQ ID NO: 417767 - protein, 11 aa, Influenza virus
APVLGNYREVC

SEQ ID NO: 417768 - protein, 11 aa, Influenza virus
LGNYREVCIAW

SEQ ID NO: 417769 - protein, 11 aa, Influenza virus
GNYKEMCAAWS

SEQ ID NO: 417770 - protein, 11 aa, Influenza virus
NYKEIRIAWSS

SEQ ID NO: 417771 - protein, 11 aa, Influenza virus
EMCAAWSSSSC

SEQ ID NO: 417772 - protein, 11 aa, Influenza virus
IRIAWSSSSCF

SEQ ID NO: 417773 - protein, 11 aa, Influenza virus
DGKEWMHICMT

SEQ ID NO: 417774 - protein, 11 aa, Influenza virus
GKEWMHICMTG

SEQ ID NO: 417775 - protein, 11 aa, Influenza virus
GRMSDSIKSWR

SEQ ID NO: 417776 - protein, 11 aa, Influenza virus
MSDSIKSWRKD

SEQ ID NO: 417777 - protein, 11 aa, Influenza virus
RTQESECLCID

SEQ ID NO: 417778 - protein, 11 aa, Influenza virus
TQESECQCLYG

SEQ ID NO: 417779 - protein, 11 aa, Influenza virus
GPAANSAHHRV

SEQ ID NO: 417780 - protein, 11 aa, Influenza virus
PAANNADHRVY

SEQ ID NO: 417781 - protein, 11 aa, Influenza virus
AANNADHRVYW

SEQ ID NO: 417782 - protein, 11 aa, Influenza virus
DNKADHRIYWI

SEQ ID NO: 417783 - protein, 11 aa, Influenza virus
NSAHHRVYWIR

SEQ ID NO: 417784 - protein, 11 aa, Influenza virus
SAHHRVYWIRE

SEQ ID NO: 417785 - protein, 11 aa, Influenza virus
IQHLEECSCYT

SEQ ID NO: 417786 - protein, 11 aa, Influenza virus
QHLEECSCYTD

SEQ ID NO: 417787 - protein, 11 aa, Influenza virus
HSEECSCYVDI

SEQ ID NO: 417788 - protein, 11 aa, Influenza virus
SEECSCYVDID

SEQ ID NO: 417789 - protein, 11 aa, Influenza virus
EECSCYVDVDV

SEQ ID NO: 417790 - protein, 11 aa, Influenza virus
ECSCYVDVDVY

SEQ ID NO: 417791 - protein, 11 aa, Influenza virus
CSCYVDTDVYC

SEQ ID NO: 417792 - protein, 11 aa, Influenza virus
DVDVYCICRDN

SEQ ID NO: 417793 - protein, 11 aa, Influenza virus
VDVYCICRDNW

SEQ ID NO: 417794 - protein, 11 aa, Influenza virus
PWVRINNETIL

SEQ ID NO: 417795 - protein, 11 aa, Influenza virus
WVRMNNETILE

SEQ ID NO: 417796 - protein, 11 aa, Influenza virus
VRINNETILET

SEQ ID NO: 417797 - protein, 11 aa, Influenza virus
DPSVVSCDSPS

SEQ ID NO: 417798 - protein, 11 aa, Influenza virus
PSVVSCDSPSN

SEQ ID NO: 417799 - protein, 11 aa, Influenza virus
SCSSPSGIEGR

SEQ ID NO: 417800 - protein, 11 aa, Influenza virus
DDVWLGRTVSI

SEQ ID NO: 417801 - protein, 11 aa, Influenza virus
LGRTISYSSRS

SEQ ID NO: 417802 - protein, 11 aa, Influenza virus
EGWIDSPNHAK

SEQ ID NO: 417803 - protein, 11 aa, Influenza virus
AKSLTQTLVSN

SEQ ID NO: 417804 - protein, 11 aa, Influenza virus
KSLTQTLVSNN

SEQ ID NO: 417805 - protein, 11 aa, Influenza virus
SITQTLVSNSD

SEQ ID NO: 417806 - protein, 11 aa, Influenza virus
ITQTLVSNDDW

SEQ ID NO: 417807 - protein, 11 aa, Influenza virus
FYVELIRGRPI

SEQ ID NO: 417808 - protein, 11 aa, Influenza virus
DDVSWTSNSLV

SEQ ID NO: 417809 - protein, 11 aa, Influenza virus
ADKICLGHHAA

SEQ ID NO: 417810 - protein, 11 aa, Influenza virus
NGIKVDTLTEK

SEQ ID NO: 417811 - protein, 11 aa, Influenza virus
KVNTLTEKGIE

SEQ ID NO: 417812 - protein, 11 aa, Influenza virus
VNTLTEREVEV

SEQ ID NO: 417813 - protein, 11 aa, Influenza virus
NTLTEREVEVV

SEQ ID NO: 417814 - protein, 11 aa, Influenza virus
GFTYTGVRTDG

SEQ ID NO: 417815 - protein, 11 aa, Influenza virus
RLGSSFYAEMK

SEQ ID NO: 417816 - protein, 11 aa, Influenza virus
LGSSFYAEMKW

SEQ ID NO: 417817 - protein, 11 aa, Influenza virus
MNGQSGRIDFY

SEQ ID NO: 417818 - protein, 11 aa, Influenza virus
NDTVTFNFNGA

SEQ ID NO: 417819 - protein, 11 aa, Influenza virus
DTVTFNFNGAF

SEQ ID NO: 417820 - protein, 11 aa, Influenza virus
TFNFNGAFVAP

SEQ ID NO: 417821 - protein, 11 aa, Influenza virus
IDGWYGFKHQN

SEQ ID NO: 417822 - protein, 11 aa, Influenza virus
DGWYGFRHQKA

SEQ ID NO: 417823 - protein, 11 aa, Influenza virus
GWYGFRHQKAQ

SEQ ID NO: 417824 - protein, 11 aa, Influenza virus
WYGFRHQKAQG

SEQ ID NO: 417825 - protein, 11 aa, Influenza virus
YGFRHQKAQGE

SEQ ID NO: 417826 - protein, 11 aa, Influenza virus
GFRHQKAQGEG

SEQ ID NO: 417827 - protein, 11 aa, Influenza virus
TQSAVNQITGK

SEQ ID NO: 417828 - protein, 11 aa, Influenza virus
QSAIDQITRKL

SEQ ID NO: 417829 - protein, 11 aa, Influenza virus
SAVNQITGKLN

SEQ ID NO: 417830 - protein, 11 aa, Influenza virus
QQFKLIDNEFT

SEQ ID NO: 417831 - protein, 11 aa, Influenza virus
QFKLIDNEFTE

SEQ ID NO: 417832 - protein, 11 aa, Influenza virus
EVEKQLGNVIN

SEQ ID NO: 417833 - protein, 11 aa, Influenza virus
VEKQLGNVINW

SEQ ID NO: 417834 - protein, 11 aa, Influenza virus
TEVWSYNADLL

SEQ ID NO: 417835 - protein, 11 aa, Influenza virus
ENQHTIDLTNS

SEQ ID NO: 417836 - protein, 11 aa, Influenza virus
NQHTIDSTDSE

SEQ ID NO: 417837 - protein, 11 aa, Influenza virus
QHTIDSTDSEM

SEQ ID NO: 417838 - protein, 11 aa, Influenza virus
HTIDSTDSEMN

SEQ ID NO: 417839 - protein, 11 aa, Influenza virus
IIDLADSEMNK

SEQ ID NO: 417840 - protein, 11 aa, Influenza virus
CFEIFHKCDDN

SEQ ID NO: 417841 - protein, 11 aa, Influenza virus
FEIFHKCDDRC

SEQ ID NO: 417842 - protein, 11 aa, Influenza virus
EIFHKCDDNCM

SEQ ID NO: 417843 - protein, 11 aa, Influenza virus
CMGSIRNNTYD

SEQ ID NO: 417844 - protein, 11 aa, Influenza virus
MTSIRNNTYDH

SEQ ID NO: 417845 - protein, 11 aa, Influenza virus
IRNNSYDHSKY

SEQ ID NO: 417846 - protein, 11 aa, Influenza virus
RNNSYDHSKYR

SEQ ID NO: 417847 - protein, 11 aa, Influenza virus
IDPVKLSGGYK

SEQ ID NO: 417848 - protein, 11 aa, Influenza virus
VELSSGYKDVI

SEQ ID NO: 417849 - protein, 11 aa, Influenza virus
LSSGYKDVIIW

SEQ ID NO: 417850 - protein, 11 aa, Influenza virus
SSGYKDVIIWF

SEQ ID NO: 417851 - protein, 11 aa, Influenza virus
SGYKEIILWFS

SEQ ID NO: 417852 - protein, 11 aa, Influenza virus
GYKDVIIWFSF

SEQ ID NO: 417853 - protein, 11 aa, Influenza virus
YKEIILWFSFG

SEQ ID NO: 417854 - protein, 11 aa, Influenza virus
KEIILWFSFGA

SEQ ID NO: 417855 - protein, 11 aa, Influenza virus
EIILWFSFGAS

SEQ ID NO: 417856 - protein, 11 aa, Influenza virus
LWFSFGASCFF

SEQ ID NO: 417857 - protein, 11 aa, Influenza virus
WFSFGASCFTL

SEQ ID NO: 417858 - protein, 11 aa, Influenza virus
LIFMCVKNGNM

SEQ ID NO: 417859 - protein, 11 aa, Influenza virus
FICVKNGNMRG

SEQ ID NO: 417860 - protein, 11 aa, Influenza virus
ICVKNGNHAVH

SEQ ID NO: 417861 - protein, 11 aa, Influenza virus
CVKNGNHAVHY

SEQ ID NO: 417862 - protein, 11 aa, Influenza virus
VKNGNMRGTNW

SEQ ID NO: 417863 - protein, 11 aa, Influenza virus
TLSGVAIALSV

SEQ ID NO: 417864 - protein, 11 aa, Influenza virus
ALSVLNLLIGV

SEQ ID NO: 417865 - protein, 11 aa, Influenza virus
VLNLLIGISNI

SEQ ID NO: 417866 - protein, 11 aa, Influenza virus
LNLLIGISNIG

SEQ ID NO: 417867 - protein, 11 aa, Influenza virus
NLLIGISNIGL

SEQ ID NO: 417868 - protein, 11 aa, Influenza virus
LLIGISNIGLN

SEQ ID NO: 417869 - protein, 11 aa, Influenza virus
SNVGLNMSLHL

SEQ ID NO: 417870 - protein, 11 aa, Influenza virus
GNTYVNNTTVI

SEQ ID NO: 417871 - protein, 11 aa, Influenza virus
SLCKIEGWVVV

SEQ ID NO: 417872 - protein, 11 aa, Influenza virus
VEGWVVIAQDN

SEQ ID NO: 417873 - protein, 11 aa, Influenza virus
GWVVIEKDNAV

SEQ ID NO: 417874 - protein, 11 aa, Influenza virus
WVVIAQDNAIR

SEQ ID NO: 417875 - protein, 11 aa, Influenza virus
VVIAQDNAIRF

SEQ ID NO: 417876 - protein, 11 aa, Influenza virus
VIAQDNAIRFG

SEQ ID NO: 417877 - protein, 11 aa, Influenza virus
IEKDNAVRFGE

SEQ ID NO: 417878 - protein, 11 aa, Influenza virus
TREPYVSCDPK

SEQ ID NO: 417879 - protein, 11 aa, Influenza virus
HSNGTIHDRAA

SEQ ID NO: 417880 - protein, 11 aa, Influenza virus
SNGTIHDRAAF

SEQ ID NO: 417881 - protein, 11 aa, Influenza virus
NGTIHDRAAFR

SEQ ID NO: 417882 - protein, 11 aa, Influenza virus
GTIHDRAAFRG

SEQ ID NO: 417883 - protein, 11 aa, Influenza virus
HDRTTFRGLIS

SEQ ID NO: 417884 - protein, 11 aa, Influenza virus
DRTTFRGLIST

SEQ ID NO: 417885 - protein, 11 aa, Influenza virus
DFICVGWSSTT

SEQ ID NO: 417886 - protein, 11 aa, Influenza virus
CHDGVSRMTIC

SEQ ID NO: 417887 - protein, 11 aa, Influenza virus
NNNATATVYYN

SEQ ID NO: 417888 - protein, 11 aa, Influenza virus
VYYDRRLTTTV

SEQ ID NO: 417889 - protein, 11 aa, Influenza virus
RRLTTTIRTWA

SEQ ID NO: 417890 - protein, 11 aa, Influenza virus
RLTTTIRTWAK

SEQ ID NO: 417891 - protein, 11 aa, Influenza virus
LTTTIRTWAKN

SEQ ID NO: 417892 - protein, 11 aa, Influenza virus
TTTVKTWAGNI

SEQ ID NO: 417893 - protein, 11 aa, Influenza virus
TTVKTWAGNIL

SEQ ID NO: 417894 - protein, 11 aa, Influenza virus
TIRTWAKNILR

SEQ ID NO: 417895 - protein, 11 aa, Influenza virus
IRTWAKNILRT

SEQ ID NO: 417896 - protein, 11 aa, Influenza virus
SECVRHNGTCA

SEQ ID NO: 417897 - protein, 11 aa, Influenza virus
ECVRHNGTCAV

SEQ ID NO: 417898 - protein, 11 aa, Influenza virus
HNGTWAVVMTD

SEQ ID NO: 417899 - protein, 11 aa, Influenza virus
NGTWAVVMTDG

SEQ ID NO: 417900 - protein, 11 aa, Influenza virus
VTCGCRDNWQG

SEQ ID NO: 417901 - protein, 11 aa, Influenza virus
ANRPVIEIDMS

SEQ ID NO: 417902 - protein, 11 aa, Influenza virus
LEHTSKYVCTG

SEQ ID NO: 417903 - protein, 11 aa, Influenza virus
YICTGILTDTS

SEQ ID NO: 417904 - protein, 11 aa, Influenza virus
ICTGILTDTSR

SEQ ID NO: 417905 - protein, 11 aa, Influenza virus
ILTDTSRPGDR

SEQ ID NO: 417906 - protein, 11 aa, Influenza virus
PGTKGFGFLNE

SEQ ID NO: 417907 - protein, 11 aa, Influenza virus
DSTWLGRTISP

SEQ ID NO: 417908 - protein, 11 aa, Influenza virus
PRSRSGFEMLR

SEQ ID NO: 417909 - protein, 11 aa, Influenza virus
RSRSGFEMLRI

SEQ ID NO: 417910 - protein, 11 aa, Influenza virus
SRSGFEMLKIH

SEQ ID NO: 417911 - protein, 11 aa, Influenza virus
FEMLRIPNAGI

SEQ ID NO: 417912 - protein, 11 aa, Influenza virus
EMLRIPNAGID

SEQ ID NO: 417913 - protein, 11 aa, Influenza virus
MLKIHNAGTDP

SEQ ID NO: 417914 - protein, 11 aa, Influenza virus
RQEIVDNSNWS

SEQ ID NO: 417915 - protein, 11 aa, Influenza virus
QEIVDNKNWSG

SEQ ID NO: 417916 - protein, 11 aa, Influenza virus
EIVDNSNWSGY

SEQ ID NO: 417917 - protein, 11 aa, Influenza virus
IVDNSNWSGYS

SEQ ID NO: 417918 - protein, 11 aa, Influenza virus
VDNKNWSGYSG

SEQ ID NO: 417919 - protein, 11 aa, Influenza virus
DNKNWSGYSGS

SEQ ID NO: 417920 - protein, 11 aa, Influenza virus
SNWSGYSGSFI

SEQ ID NO: 417921 - protein, 11 aa, Influenza virus
LLASTNAHDRI

SEQ ID NO: 417922 - protein, 11 aa, Influenza virus
NNSTDTVDTLI

SEQ ID NO: 417923 - protein, 11 aa, Influenza virus
NSTDTVNTLTE

SEQ ID NO: 417924 - protein, 11 aa, Influenza virus
STDTVNTLTEQ

SEQ ID NO: 417925 - protein, 11 aa, Influenza virus
TLIEQNIPVTQ

SEQ ID NO: 417926 - protein, 11 aa, Influenza virus
QTMELVETEKN

SEQ ID NO: 417927 - protein, 11 aa, Influenza virus
EKNPAYCNTDL

SEQ ID NO: 417928 - protein, 11 aa, Influenza virus
LAYCNTDLGTP

SEQ ID NO: 417929 - protein, 11 aa, Influenza virus
HLRDQGWSYIV

SEQ ID NO: 417930 - protein, 11 aa, Influenza virus
LKDQAWSYIVE

SEQ ID NO: 417931 - protein, 11 aa, Influenza virus
RDQGWSYIVER

SEQ ID NO: 417932 - protein, 11 aa, Influenza virus
SSGTSKACNAL

SEQ ID NO: 417933 - protein, 11 aa, Influenza virus
KACNASTGAQS

SEQ ID NO: 417934 - protein, 11 aa, Influenza virus
ACNASTGAQSF

SEQ ID NO: 417935 - protein, 11 aa, Influenza virus
CNASTGAQSFY

SEQ ID NO: 417936 - protein, 11 aa, Influenza virus
NASTGAQSFYR

SEQ ID NO: 417937 - protein, 11 aa, Influenza virus
PDIYDFNEGSY

SEQ ID NO: 417938 - protein, 11 aa, Influenza virus
NNKDGDIIFLW

SEQ ID NO: 417939 - protein, 11 aa, Influenza virus
NKDGDIIFLWG

SEQ ID NO: 417940 - protein, 11 aa, Influenza virus
EEGDIIFLWGI

SEQ ID NO: 417941 - protein, 11 aa, Influenza virus
TKEQTALYKNA

SEQ ID NO: 417942 - protein, 11 aa, Influenza virus
VTTNTINRNFQ

SEQ ID NO: 417943 - protein, 11 aa, Influenza virus
TTNTINRNFQP

SEQ ID NO: 417944 - protein, 11 aa, Influenza virus
RSFQPNIGPRA

SEQ ID NO: 417945 - protein, 11 aa, Influenza virus
SFQPNIGPRAL

SEQ ID NO: 417946 - protein, 11 aa, Influenza virus
PRPLVRGQQGW

SEQ ID NO: 417947 - protein, 11 aa, Influenza virus
RPLVRGQQGTM

SEQ ID NO: 417948 - protein, 11 aa, Influenza virus
ALVRGQQGRMD

SEQ ID NO: 417949 - protein, 11 aa, Influenza virus
GYLLKGESHCR

SEQ ID NO: 417950 - protein, 11 aa, Influenza virus
GESHGKIIQNE

SEQ ID NO: 417951 - protein, 11 aa, Influenza virus
ESHGRTIQNED

SEQ ID NO: 417952 - protein, 11 aa, Influenza virus
SHGRTIQNEDI

SEQ ID NO: 417953 - protein, 11 aa, Influenza virus
HGRTIQNEDIP

SEQ ID NO: 417954 - protein, 11 aa, Influenza virus
CKTKCQTYAGA

SEQ ID NO: 417955 - protein, 11 aa, Influenza virus
QTYAGAVNSSK

SEQ ID NO: 417956 - protein, 11 aa, Influenza virus
TYTGAINSSKP

SEQ ID NO: 417957 - protein, 11 aa, Influenza virus
AINSSKPFQNT

SEQ ID NO: 417958 - protein, 11 aa, Influenza virus
INSSKPLQNAS

SEQ ID NO: 417959 - protein, 11 aa, Influenza virus
SSKPFQNTSRH

SEQ ID NO: 417960 - protein, 11 aa, Influenza virus
PFQNTSRHYMG

SEQ ID NO: 417961 - protein, 11 aa, Influenza virus
LQNASRHYMGE

SEQ ID NO: 417962 - protein, 11 aa, Influenza virus
SRHYMGECPEY

SEQ ID NO: 417963 - protein, 11 aa, Influenza virus
KKESLRLAIGL

SEQ ID NO: 417964 - protein, 11 aa, Influenza virus
AIGLRNTPSIE

SEQ ID NO: 417965 - protein, 11 aa, Influenza virus
IGLRNTPSIEP

SEQ ID NO: 417966 - protein, 11 aa, Influenza virus
GLRNTPSIDPK

SEQ ID NO: 417967 - protein, 11 aa, Influenza virus
LRNTPSIDPKG

SEQ ID NO: 417968 - protein, 11 aa, Influenza virus
RNTPSIDPKGL

SEQ ID NO: 417969 - protein, 11 aa, Influenza virus
NTPSIDPKGLF

SEQ ID NO: 417970 - protein, 11 aa, Influenza virus
TPSIDPKGLFG

SEQ ID NO: 417971 - protein, 11 aa, Influenza virus
PSIDPKGLFGA

SEQ ID NO: 417972 - protein, 11 aa, Influenza virus
SIDPKGLFGAI

SEQ ID NO: 417973 - protein, 11 aa, Influenza virus
IDPKGLFGAIA

SEQ ID NO: 417974 - protein, 11 aa, Influenza virus
QEAIEKITNKV

SEQ ID NO: 417975 - protein, 11 aa, Influenza virus
EAIGKITNKVN

SEQ ID NO: 417976 - protein, 11 aa, Influenza virus
AIGKITNKVNN

SEQ ID NO: 417977 - protein, 11 aa, Influenza virus
IEKITNKVNNI

SEQ ID NO: 417978 - protein, 11 aa, Influenza virus
NKITNKVNNIV

SEQ ID NO: 417979 - protein, 11 aa, Influenza virus
EKRINVINDKI

SEQ ID NO: 417980 - protein, 11 aa, Influenza virus
INVINDKIDDQ

SEQ ID NO: 417981 - protein, 11 aa, Influenza virus
DKIDDQIEELW

SEQ ID NO: 417982 - protein, 11 aa, Influenza virus
KIDDQIEELWA

SEQ ID NO: 417983 - protein, 11 aa, Influenza virus
IDDQIEELWAY

SEQ ID NO: 417984 - protein, 11 aa, Influenza virus
DDQIEELWAYN

SEQ ID NO: 417985 - protein, 11 aa, Influenza virus
LFDEVRRRLSV

SEQ ID NO: 417986 - protein, 11 aa, Influenza virus
FDEVRRRLSVN

SEQ ID NO: 417987 - protein, 11 aa, Influenza virus
DEVRRRLSVNA

SEQ ID NO: 417988 - protein, 11 aa, Influenza virus
NAVDTGNGCFD

SEQ ID NO: 417989 - protein, 11 aa, Influenza virus
AIDTGKGCFDI

SEQ ID NO: 417990 - protein, 11 aa, Influenza virus
VDTGNGCFDIL

SEQ ID NO: 417991 - protein, 11 aa, Influenza virus
TIKNGTYNRKE

SEQ ID NO: 417992 - protein, 11 aa, Influenza virus
IKNGTYNRKEY

SEQ ID NO: 417993 - protein, 11 aa, Influenza virus
KNGTYNRKEYE

SEQ ID NO: 417994 - protein, 11 aa, Influenza virus
NGTYDHKDYEE

SEQ ID NO: 417995 - protein, 11 aa, Influenza virus
GTYNHKDYEEE

SEQ ID NO: 417996 - protein, 11 aa, Influenza virus
TYDHKDYEEEA

SEQ ID NO: 417997 - protein, 11 aa, Influenza virus
YDHKDYEEEAK

SEQ ID NO: 417998 - protein, 11 aa, Influenza virus
NHKDYEEEAKL

SEQ ID NO: 417999 - protein, 11 aa, Influenza virus
KLERSKINGVR

SEQ ID NO: 418000 - protein, 11 aa, Influenza virus
LERSKINEVKL

SEQ ID NO: 418001 - protein, 11 aa, Influenza virus
EKSRINGVKLE

SEQ ID NO: 418002 - protein, 11 aa, Influenza virus
RSKINGVRLEE

SEQ ID NO: 418003 - protein, 11 aa, Influenza virus
SKINEVKLEEN

SEQ ID NO: 418004 - protein, 11 aa, Influenza virus
KINGVRLEENT

SEQ ID NO: 418005 - protein, 11 aa, Influenza virus
INEVKLEENTT

SEQ ID NO: 418006 - protein, 11 aa, Influenza virus
NGVILEENTTY

SEQ ID NO: 418007 - protein, 11 aa, Influenza virus
VKLEENTTYRI

SEQ ID NO: 418008 - protein, 11 aa, Influenza virus
ILEENTTYKIL

SEQ ID NO: 418009 - protein, 11 aa, Influenza virus
EGLIYGNPFCD

SEQ ID NO: 418010 - protein, 11 aa, Influenza virus
LKPGQTLRIIS

SEQ ID NO: 418011 - protein, 11 aa, Influenza virus
DRIQDIWAYNA

SEQ ID NO: 418012 - protein, 11 aa, Influenza virus
RIQDIWAYNAE

SEQ ID NO: 418013 - protein, 11 aa, Influenza virus
ELLVLLENQKI

SEQ ID NO: 418014 - protein, 11 aa, Influenza virus
LLENQKPLDEH

SEQ ID NO: 418015 - protein, 11 aa, Influenza virus
EDGKGWFELYH

SEQ ID NO: 418016 - protein, 11 aa, Influenza virus
GKGCFELYHEC

SEQ ID NO: 418017 - protein, 11 aa, Influenza virus
GIYKILSIYST

SEQ ID NO: 418018 - protein, 11 aa, Influenza virus
THKILTIYSTV

SEQ ID NO: 418019 - protein, 11 aa, Influenza virus
LSIYSTVASSL

SEQ ID NO: 418020 - protein, 11 aa, Influenza virus
EGLIYGNPFCD

SEQ ID NO: 418021 - protein, 11 aa, Influenza virus
LKPGQTLRIIS

SEQ ID NO: 418022 - protein, 11 aa, Influenza virus
DRIQDIWAYNA

SEQ ID NO: 418023 - protein, 11 aa, Influenza virus
LLVMLENQKTL

SEQ ID NO: 418024 - protein, 11 aa, Influenza virus
LVLLETKKKLD

SEQ ID NO: 418025 - protein, 11 aa, Influenza virus
VLLENQKTLDD

SEQ ID NO: 418026 - protein, 11 aa, Influenza virus
LLENQKALDEH

SEQ ID NO: 418027 - protein, 11 aa, Influenza virus
EDGKGWFELYH

SEQ ID NO: 418028 - protein, 11 aa, Influenza virus
GKGCFELYHEC

SEQ ID NO: 418029 - protein, 11 aa, Influenza virus
GIYKILSIYST

SEQ ID NO: 418030 - protein, 11 aa, Influenza virus
THKILTIYSTV

SEQ ID NO: 418031 - protein, 11 aa, Influenza virus
LSIYSTVASSL

SEQ ID NO: 418032 - protein, 11 aa, Influenza virus
PHRTLLMNEIG

SEQ ID NO: 418033 - protein, 11 aa, Influenza virus
HRTLLMNEIGV

SEQ ID NO: 418034 - protein, 11 aa, Influenza virus
LLMNELGIPFH

SEQ ID NO: 418035 - protein, 11 aa, Influenza virus
SSSCHDGKEWL

SEQ ID NO: 418036 - protein, 11 aa, Influenza virus
ILRTQESDCVC

SEQ ID NO: 418037 - protein, 11 aa, Influenza virus
GSAKHVEECSC

SEQ ID NO: 418038 - protein, 11 aa, Influenza virus
SAKHVEECSCY

SEQ ID NO: 418039 - protein, 11 aa, Influenza virus
VCWDNWRGSNR

SEQ ID NO: 418040 - protein, 11 aa, Influenza virus
CSGLVGDTPRG

SEQ ID NO: 418041 - protein, 11 aa, Influenza virus
YGTGSWADGAN

SEQ ID NO: 418042 - protein, 11 aa, Influenza virus
LKAEIAQRLEN

SEQ ID NO: 418043 - protein, 11 aa, Influenza virus
KAEIAQRLENV

SEQ ID NO: 418044 - protein, 11 aa, Influenza virus
AEIAQRLENVF

SEQ ID NO: 418045 - protein, 11 aa, Influenza virus
EIAQRLENVFA

SEQ ID NO: 418046 - protein, 11 aa, Influenza virus
IAQRLENVFAG

SEQ ID NO: 418047 - protein, 11 aa, Influenza virus
AQRLENVFAGK

SEQ ID NO: 418048 - protein, 11 aa, Influenza virus
VFSGKNTDLEA

SEQ ID NO: 418049 - protein, 11 aa, Influenza virus
FSGKNTDLEAL

SEQ ID NO: 418050 - protein, 11 aa, Influenza virus
SGKNTDLEALM

SEQ ID NO: 418051 - protein, 11 aa, Influenza virus
NTDLEVLMEWL

SEQ ID NO: 418052 - protein, 11 aa, Influenza virus
TDLEVLMEWLK

SEQ ID NO: 418053 - protein, 11 aa, Influenza virus
DPNNIDRAVKL

SEQ ID NO: 418054 - protein, 11 aa, Influenza virus
PNNIDRAVKLY

SEQ ID NO: 418055 - protein, 11 aa, Influenza virus
NMARAVKLYKK

SEQ ID NO: 418056 - protein, 11 aa, Influenza virus
MARAVKLYKKL

SEQ ID NO: 418057 - protein, 11 aa, Influenza virus
REITFYGAKEI

SEQ ID NO: 418058 - protein, 11 aa, Influenza virus
SLSYSAGALAS

SEQ ID NO: 418059 - protein, 11 aa, Influenza virus
GLIYNRMGTVN

SEQ ID NO: 418060 - protein, 11 aa, Influenza virus
NEQAAEAMEVA

SEQ ID NO: 418061 - protein, 11 aa, Influenza virus
LENLQAYQNRM

SEQ ID NO: 418062 - protein, 11 aa, Influenza virus
QAYQKRMGLQM

SEQ ID NO: 418063 - protein, 11 aa, Influenza virus
YQKRMGVQMHR

SEQ ID NO: 418064 - protein, 11 aa, Influenza virus
ATQGTKRSYEQ

SEQ ID NO: 418065 - protein, 11 aa, Influenza virus
KRSYEQMETGE

SEQ ID NO: 418066 - protein, 11 aa, Influenza virus
YVQMCTELKLS

SEQ ID NO: 418067 - protein, 11 aa, Influenza virus
GRLIQNSITVE

SEQ ID NO: 418068 - protein, 11 aa, Influenza virus
RNRYLEENPSA

SEQ ID NO: 418069 - protein, 11 aa, Influenza virus
NRYLEENPSAG

SEQ ID NO: 418070 - protein, 11 aa, Influenza virus
YLEEHPSAGRD

SEQ ID NO: 418071 - protein, 11 aa, Influenza virus
LEEHPSAGRDP

SEQ ID NO: 418072 - protein, 11 aa, Influenza virus
EEHPSAGRDPK

SEQ ID NO: 418073 - protein, 11 aa, Influenza virus
EHPSAGRDPKK

SEQ ID NO: 418074 - protein, 11 aa, Influenza virus
HPSAGRDPKKT

SEQ ID NO: 418075 - protein, 11 aa, Influenza virus
MMIWHSNLNDA

SEQ ID NO: 418076 - protein, 11 aa, Influenza virus
AGAAIKGIGTM

SEQ ID NO: 418077 - protein, 11 aa, Influenza virus
VMELVRMIKRG

SEQ ID NO: 418078 - protein, 11 aa, Influenza virus
MELIRMIKRGV

SEQ ID NO: 418079 - protein, 11 aa, Influenza virus
TRGAYERMCNI

SEQ ID NO: 418080 - protein, 11 aa, Influenza virus
RGAYERMCNIL

SEQ ID NO: 418081 - protein, 11 aa, Influenza virus
GAYERMCNILK

SEQ ID NO: 418082 - protein, 11 aa, Influenza virus
NAEIEDLIFLT

SEQ ID NO: 418083 - protein, 11 aa, Influenza virus
AEIEDLIFLTR

SEQ ID NO: 418084 - protein, 11 aa, Influenza virus
EIEDLIFLTRS

SEQ ID NO: 418085 - protein, 11 aa, Influenza virus
IEDLIFLTRSA

SEQ ID NO: 418086 - protein, 11 aa, Influenza virus
DLIFLARSALV

SEQ ID NO: 418087 - protein, 11 aa, Influenza virus
LIFLARSALVL

SEQ ID NO: 418088 - protein, 11 aa, Influenza virus
SCLPACVYGLV

SEQ ID NO: 418089 - protein, 11 aa, Influenza virus
DPFRLLQSSQV

SEQ ID NO: 418090 - protein, 11 aa, Influenza virus
NENPVHKSQLV

SEQ ID NO: 418091 - protein, 11 aa, Influenza virus
LTTRGVQIASN

SEQ ID NO: 418092 - protein, 11 aa, Influenza virus
TTRGVQIASNE

SEQ ID NO: 418093 - protein, 11 aa, Influenza virus
IRTRSGGNTNH

SEQ ID NO: 418094 - protein, 11 aa, Influenza virus
SVQPTFSVQRS

SEQ ID NO: 418095 - protein, 11 aa, Influenza virus
VQPTFSVQRSL

SEQ ID NO: 418096 - protein, 11 aa, Influenza virus
EMSFQGRGVFE

SEQ ID NO: 418097 - protein, 11 aa, Influenza virus
VSFQGRGVFEF

SEQ ID NO: 418098 - protein, 11 aa, Influenza virus
GVFEFSDERAA

SEQ ID NO: 418099 - protein, 11 aa, Influenza virus
FQVDCFLWYVR

SEQ ID NO: 418100 - protein, 11 aa, Influenza virus
GDAPFIDRLRR

SEQ ID NO: 418101 - protein, 11 aa, Influenza virus
APFLDRVRRDQ

SEQ ID NO: 418102 - protein, 11 aa, Influenza virus
ALHLLLEVEQE

SEQ ID NO: 418103 - protein, 11 aa, Influenza virus
MGDFVRQCFNP

SEQ ID NO: 418104 - protein, 11 aa, Influenza virus
RQCFNPMIAEL

SEQ ID NO: 418105 - protein, 11 aa, Influenza virus
QCFNPMIAELA

SEQ ID NO: 418106 - protein, 11 aa, Influenza virus
CFNPMIAELAE

SEQ ID NO: 418107 - protein, 11 aa, Influenza virus
TNKFAAVCTHL

SEQ ID NO: 418108 - protein, 11 aa, Influenza virus
AAVCTHLEVCF

SEQ ID NO: 418109 - protein, 11 aa, Influenza virus
MYSDFHFINEL

SEQ ID NO: 418110 - protein, 11 aa, Influenza virus
QNALLKHRFEI

SEQ ID NO: 418111 - protein, 11 aa, Influenza virus
KPKSLPDLYDY

SEQ ID NO: 418112 - protein, 11 aa, Influenza virus
PKSLPDLYDYK

SEQ ID NO: 418113 - protein, 11 aa, Influenza virus
IGVTRREVHMY

SEQ ID NO: 418114 - protein, 11 aa, Influenza virus
GVTRREVHMYY

SEQ ID NO: 418115 - protein, 11 aa, Influenza virus
VTRREVHMYYL

SEQ ID NO: 418116 - protein, 11 aa, Influenza virus
TRREVHMYYLE

SEQ ID NO: 418117 - protein, 11 aa, Influenza virus
RREVHMYYLEK

SEQ ID NO: 418118 - protein, 11 aa, Influenza virus
FSFIGEEMATK

SEQ ID NO: 418119 - protein, 11 aa, Influenza virus
RLFTIRQEMAG

SEQ ID NO: 418120 - protein, 11 aa, Influenza virus
RGEETIEERFA

SEQ ID NO: 418121 - protein, 11 aa, Influenza virus
GEETIEERFAI

SEQ ID NO: 418122 - protein, 11 aa, Influenza virus
FRTYVDGFKPN

SEQ ID NO: 418123 - protein, 11 aa, Influenza virus
IDGFEPNGCIE

SEQ ID NO: 418124 - protein, 11 aa, Influenza virus
FEPNGSIEGKL

SEQ ID NO: 418125 - protein, 11 aa, Influenza virus
CIEGKLSQMPK

SEQ ID NO: 418126 - protein, 11 aa, Influenza virus
KLSIEEPSHEG

SEQ ID NO: 418127 - protein, 11 aa, Influenza virus
LSIEEPSHEGE

SEQ ID NO: 418128 - protein, 11 aa, Influenza virus
SIEEPSHEGEG

SEQ ID NO: 418129 - protein, 11 aa, Influenza virus
IEEPSHEGEGI

SEQ ID NO: 418130 - protein, 11 aa, Influenza virus
PSHEGEGIPLC

SEQ ID NO: 418131 - protein, 11 aa, Influenza virus
SHEGEGIPLCD

SEQ ID NO: 418132 - protein, 11 aa, Influenza virus
LMWALGENMAP

SEQ ID NO: 418133 - protein, 11 aa, Influenza virus
MWALGENMAPE

SEQ ID NO: 418134 - protein, 11 aa, Influenza virus
FNKACELTGSS

SEQ ID NO: 418135 - protein, 11 aa, Influenza virus
NKACELTGSSW

SEQ ID NO: 418136 - protein, 11 aa, Influenza virus
EIGEDLAPIEY

SEQ ID NO: 418137 - protein, 11 aa, Influenza virus
APIEHIASIRR

SEQ ID NO: 418138 - protein, 11 aa, Influenza virus
YFTEEVSHCRA

SEQ ID NO: 418139 - protein, 11 aa, Influenza virus
FTEEVSHCRAT

SEQ ID NO: 418140 - protein, 11 aa, Influenza virus
TEEVSHCRATE

SEQ ID NO: 418141 - protein, 11 aa, Influenza virus
VSHCRATEYII

SEQ ID NO: 418142 - protein, 11 aa, Influenza virus
GVYINTALLNS

SEQ ID NO: 418143 - protein, 11 aa, Influenza virus
VYINTALLNSS

SEQ ID NO: 418144 - protein, 11 aa, Influenza virus
YINTALLNSSC

SEQ ID NO: 418145 - protein, 11 aa, Influenza virus
LLNSSCAAMDD

SEQ ID NO: 418146 - protein, 11 aa, Influenza virus
AAMDDYQLIPM

SEQ ID NO: 418147 - protein, 11 aa, Influenza virus
AMDDFQLIPII

SEQ ID NO: 418148 - protein, 11 aa, Influenza virus
DDFQLIPMISN

SEQ ID NO: 418149 - protein, 11 aa, Influenza virus
LIPMISKSRTK

SEQ ID NO: 418150 - protein, 11 aa, Influenza virus
IPMISKSRTKE

SEQ ID NO: 418151 - protein, 11 aa, Influenza virus
PMISNCRTKEG

SEQ ID NO: 418152 - protein, 11 aa, Influenza virus
MISNCRTKEGR

SEQ ID NO: 418153 - protein, 11 aa, Influenza virus
SKSRTKEGRRK

SEQ ID NO: 418154 - protein, 11 aa, Influenza virus
KSRTKEGRRKT

SEQ ID NO: 418155 - protein, 11 aa, Influenza virus
MFLYMRTNGTS

SEQ ID NO: 418156 - protein, 11 aa, Influenza virus
VESMIEAESSV

SEQ ID NO: 418157 - protein, 11 aa, Influenza virus
ESIIEAESSVK

SEQ ID NO: 418158 - protein, 11 aa, Influenza virus
IIEAESSVKEK

SEQ ID NO: 418159 - protein, 11 aa, Influenza virus
ESSVKEKDLTK

SEQ ID NO: 418160 - protein, 11 aa, Influenza virus
IEEGSIGKVCR

SEQ ID NO: 418161 - protein, 11 aa, Influenza virus
EEGSIGKLCRT

SEQ ID NO: 418162 - protein, 11 aa, Influenza virus
TLLAKSVFNSI

SEQ ID NO: 418163 - protein, 11 aa, Influenza virus
LAKSVFNSIYA

SEQ ID NO: 418164 - protein, 11 aa, Influenza virus
AKSVFNSIYAS

SEQ ID NO: 418165 - protein, 11 aa, Influenza virus
FNSIYASPQLE

SEQ ID NO: 418166 - protein, 11 aa, Influenza virus
NSIYASPQLEG

SEQ ID NO: 418167 - protein, 11 aa, Influenza virus
SIYASPQLEGF

SEQ ID NO: 418168 - protein, 11 aa, Influenza virus
AESRKLLLITQ

SEQ ID NO: 418169 - protein, 11 aa, Influenza virus
ESRKLLLITQA

SEQ ID NO: 418170 - protein, 11 aa, Influenza virus
LRDDLEPGTFD

SEQ ID NO: 418171 - protein, 11 aa, Influenza virus
RDDLEPGTFDI

SEQ ID NO: 418172 - protein, 11 aa, Influenza virus
GLYEAVEECLI

SEQ ID NO: 418173 - protein, 11 aa, Influenza virus
LYEAVEECLIN

SEQ ID NO: 418174 - protein, 11 aa, Influenza virus
YEAVEECLIND

SEQ ID NO: 418175 - protein, 11 aa, Influenza virus
EAVEECLINDP

SEQ ID NO: 418176 - protein, 11 aa, Influenza virus
LNASWFNSFLK

SEQ ID NO: 418177 - protein, 11 aa, Influenza virus
NASWFNSFLKH

SEQ ID NO: 418178 - protein, 11 aa, Influenza virus
SRTHQYSEKGK

SEQ ID NO: 418179 - protein, 11 aa, Influenza virus
ETGAPQLNPVD

SEQ ID NO: 418180 - protein, 11 aa, Influenza virus
TGAPQLNPVDG

SEQ ID NO: 418181 - protein, 11 aa, Influenza virus
CVLEAMAFLED

SEQ ID NO: 418182 - protein, 11 aa, Influenza virus
VLEAMAFLEDS

SEQ ID NO: 418183 - protein, 11 aa, Influenza virus
EAMAFLEDSHP

SEQ ID NO: 418184 - protein, 11 aa, Influenza virus
SHPGIFESSCL

SEQ ID NO: 418185 - protein, 11 aa, Influenza virus
HPGIFESSCLE

SEQ ID NO: 418186 - protein, 11 aa, Influenza virus
ALANTIEVFRA

SEQ ID NO: 418187 - protein, 11 aa, Influenza virus
LANTIEVFRMN

SEQ ID NO: 418188 - protein, 11 aa, Influenza virus
GRLIDFLKDVT

SEQ ID NO: 418189 - protein, 11 aa, Influenza virus
SYIIRALTLNT

SEQ ID NO: 418190 - protein, 11 aa, Influenza virus
QIRGVVYFVET

SEQ ID NO: 418191 - protein, 11 aa, Influenza virus
IRGVVYFVETL

SEQ ID NO: 418192 - protein, 11 aa, Influenza virus
RGVVYFVETLA

SEQ ID NO: 418193 - protein, 11 aa, Influenza virus
NENQSPRMFLA

SEQ ID NO: 418194 - protein, 11 aa, Influenza virus
ENQSPRMFLAM

SEQ ID NO: 418195 - protein, 11 aa, Influenza virus
NQSPRMFLAMI

SEQ ID NO: 418196 - protein, 11 aa, Influenza virus
QSPRMFLAMIT

SEQ ID NO: 418197 - protein, 11 aa, Influenza virus
SPRMFLAMITY

SEQ ID NO: 418198 - protein, 11 aa, Influenza virus
PRTFLAMITYI

SEQ ID NO: 418199 - protein, 11 aa, Influenza virus
RTFLAMITYIT

SEQ ID NO: 418200 - protein, 11 aa, Influenza virus
WFRNALSIAPI

SEQ ID NO: 418201 - protein, 11 aa, Influenza virus
FRNALSIAPIM

SEQ ID NO: 418202 - protein, 11 aa, Influenza virus
RNALSIAPIMF

SEQ ID NO: 418203 - protein, 11 aa, Influenza virus
NALSIAPIMFS

SEQ ID NO: 418204 - protein, 11 aa, Influenza virus
ALSIAPIMFSN

SEQ ID NO: 418205 - protein, 11 aa, Influenza virus
TAYWWDGLQSS

SEQ ID NO: 418206 - protein, 11 aa, Influenza virus
AYWWDGLQSSD

SEQ ID NO: 418207 - protein, 11 aa, Influenza virus
NRFYRTCKLLG

SEQ ID NO: 418208 - protein, 11 aa, Influenza virus
MSVGVTVIKNN

SEQ ID NO: 418209 - protein, 11 aa, Influenza virus
IGVAVIKNNMI

SEQ ID NO: 418210 - protein, 11 aa, Influenza virus
YTYRCHRGDAQ

SEQ ID NO: 418211 - protein, 11 aa, Influenza virus
RLCNPLNPFVG

SEQ ID NO: 418212 - protein, 11 aa, Influenza virus
LCNPLNPFVGH

SEQ ID NO: 418213 - protein, 11 aa, Influenza virus
EDERMYQKCCN

SEQ ID NO: 418214 - protein, 11 aa, Influenza virus
DERMYQKCCNL

SEQ ID NO: 418215 - protein, 11 aa, Influenza virus
ERMYQKCCNLF

SEQ ID NO: 418216 - protein, 11 aa, Influenza virus
MYQKCCNLFER

SEQ ID NO: 418217 - protein, 11 aa, Influenza virus
GISSMVEAMMS

SEQ ID NO: 418218 - protein, 11 aa, Influenza virus
ISSMVEAMMSR

SEQ ID NO: 418219 - protein, 11 aa, Influenza virus
SSMVEAMMSRA

SEQ ID NO: 418220 - protein, 11 aa, Influenza virus
SMVEAMMSRAR

SEQ ID NO: 418221 - protein, 11 aa, Influenza virus
MVEAMMSRARI

SEQ ID NO: 418222 - protein, 11 aa, Influenza virus
VEAMMSRARID

SEQ ID NO: 418223 - protein, 11 aa, Influenza virus
VSRARIDARTD

SEQ ID NO: 418224 - protein, 11 aa, Influenza virus
MSQPRTREILT

SEQ ID NO: 418225 - protein, 11 aa, Influenza virus
PRTREILTKTT

SEQ ID NO: 418226 - protein, 11 aa, Influenza virus
GAFGPVHFRNQ

SEQ ID NO: 418227 - protein, 11 aa, Influenza virus
QVKIRRRVDMN

SEQ ID NO: 418228 - protein, 11 aa, Influenza virus
VKIRRRVDMNP

SEQ ID NO: 418229 - protein, 11 aa, Influenza virus
RRRVDINPGHS

SEQ ID NO: 418230 - protein, 11 aa, Influenza virus
VKEAQDVIMEV

SEQ ID NO: 418231 - protein, 11 aa, Influenza virus
GARILASESQL

SEQ ID NO: 418232 - protein, 11 aa, Influenza virus
TRFLPVVGGTS

SEQ ID NO: 418233 - protein, 11 aa, Influenza virus
GGTGSIYIEVL

SEQ ID NO: 418234 - protein, 11 aa, Influenza virus
GTGSIYIEVLH

SEQ ID NO: 418235 - protein, 11 aa, Influenza virus
TSSMYIEVLHL

SEQ ID NO: 418236 - protein, 11 aa, Influenza virus
SSMYIEVLHLT

SEQ ID NO: 418237 - protein, 11 aa, Influenza virus
CWEQMYNPGGE

SEQ ID NO: 418238 - protein, 11 aa, Influenza virus
WEQMYNPGGEV

SEQ ID NO: 418239 - protein, 11 aa, Influenza virus
IDQSLIIAARS

SEQ ID NO: 418240 - protein, 11 aa, Influenza virus
RNIVRRATVST

SEQ ID NO: 418241 - protein, 11 aa, Influenza virus
NIVRRATVSTD

SEQ ID NO: 418242 - protein, 11 aa, Influenza virus
RRATVSADPLV

SEQ ID NO: 418243 - protein, 11 aa, Influenza virus
RATVSADPLVS

SEQ ID NO: 418244 - protein, 11 aa, Influenza virus
ATVSADPLVSL

SEQ ID NO: 418245 - protein, 11 aa, Influenza virus
VSLLEMCHSTQ

SEQ ID NO: 418246 - protein, 11 aa, Influenza virus
DILRQNSTEEQ

SEQ ID NO: 418247 - protein, 11 aa, Influenza virus
EQAVNICKAAM

SEQ ID NO: 418248 - protein, 11 aa, Influenza virus
QAVNICKAAMG

SEQ ID NO: 418249 - protein, 11 aa, Influenza virus
ICKAAMGMRIS

SEQ ID NO: 418250 - protein, 11 aa, Influenza virus
CKAAMGMRISS

SEQ ID NO: 418251 - protein, 11 aa, Influenza virus
KAAMGMRISSS

SEQ ID NO: 418252 - protein, 11 aa, Influenza virus
AAMGMRISSSF

SEQ ID NO: 418253 - protein, 11 aa, Influenza virus
AMGMRISSSFS

SEQ ID NO: 418254 - protein, 11 aa, Influenza virus
MGMRISSSFSF

SEQ ID NO: 418255 - protein, 11 aa, Influenza virus
ELLTGNLQTLK

SEQ ID NO: 418256 - protein, 11 aa, Influenza virus
IVAMVFSQEDR

SEQ ID NO: 418257 - protein, 11 aa, Influenza virus
VAMVFSQEDRM

SEQ ID NO: 418258 - protein, 11 aa, Influenza virus
CMIKAIRGDLN

SEQ ID NO: 418259 - protein, 11 aa, Influenza virus
LLRHFQKDAKM

SEQ ID NO: 418260 - protein, 11 aa, Influenza virus
LRHFQKDAKML

SEQ ID NO: 418261 - protein, 11 aa, Influenza virus
DRFLRVRDQMG

SEQ ID NO: 418262 - protein, 11 aa, Influenza virus
SPEEISETQGT

SEQ ID NO: 418263 - protein, 11 aa, Influenza virus
PEEISETQGTE

SEQ ID NO: 418264 - protein, 11 aa, Influenza virus
EKLTITYSSPM

SEQ ID NO: 418265 - protein, 11 aa, Influenza virus
KLTITYSSPMM

SEQ ID NO: 418266 - protein, 11 aa, Influenza virus
ITYSSPMMWEI

SEQ ID NO: 418267 - protein, 11 aa, Influenza virus
TYSSPMMWEIN

SEQ ID NO: 418268 - protein, 11 aa, Influenza virus
SSMMWEINGPD

SEQ ID NO: 418269 - protein, 11 aa, Influenza virus
SMMWEINGPDS

SEQ ID NO: 418270 - protein, 11 aa, Influenza virus
KLEFEPFQSLV

SEQ ID NO: 418271 - protein, 11 aa, Influenza virus
LEFEPFQSLVP

SEQ ID NO: 418272 - protein, 11 aa, Influenza virus
PPEQSKMQFSS

SEQ ID NO: 418273 - protein, 11 aa, Influenza virus
QSRMQFSSFTV

SEQ ID NO: 418274 - protein, 11 aa, Influenza virus
RMQFSSFTVNV

SEQ ID NO: 418275 - protein, 11 aa, Influenza virus
SLAVNVRGSGM

SEQ ID NO: 418276 - protein, 11 aa, Influenza virus
LAVNVRGSGMR

SEQ ID NO: 418277 - protein, 11 aa, Influenza virus
TVNVRGSGMRV

SEQ ID NO: 418278 - protein, 11 aa, Influenza virus
VNVRGSGMRVL

SEQ ID NO: 418279 - protein, 11 aa, Influenza virus
RGSGLRILIRG

SEQ ID NO: 418280 - protein, 11 aa, Influenza virus
GMRVLIRGNSP

SEQ ID NO: 418281 - protein, 11 aa, Influenza virus
LVRGNSPVFNH

SEQ ID NO: 418282 - protein, 11 aa, Influenza virus
VRGNSPVFNYS

SEQ ID NO: 418283 - protein, 11 aa, Influenza virus
RGNSPVFNYSK

SEQ ID NO: 418284 - protein, 11 aa, Influenza virus
KRLAVLGKDAG

SEQ ID NO: 418285 - protein, 11 aa, Influenza virus
AGVEFAVLRGF

SEQ ID NO: 418286 - protein, 11 aa, Influenza virus
RGFLILGREDK

SEQ ID NO: 418287 - protein, 11 aa, Influenza virus
RRYGPALSISE

SEQ ID NO: 418288 - protein, 11 aa, Influenza virus
TKRIRMAINYS

SEQ ID NO: 418289 - protein, 742 aa, Influenza virus
  MOD_RES (11)..(14): Any amino acid
  MOD_RES (24)..(31): Any amino acid
  MOD_RES (46)..(74): Any amino acid
  MOD_RES (94)..(154): Any amino acid
  MOD_RES (164)..(223): Any amino acid
  MOD_RES (232)..(233): Any amino acid
  MOD_RES (242)..(280): Any amino acid
  MOD_RES (289)..(298): Any amino acid
  MOD_RES (311)..(341): Any amino acid
  MOD_RES (357)..(358): Any amino acid
  MOD_RES (367)..(369): Any amino acid
  MOD_RES (387)..(393): Any amino acid
  MOD_RES (402)..(422): Any amino acid
  MOD_RES (439)..(440): Any amino acid
  MOD_RES (458)..(459): Any amino acid
  MOD_RES (491)..(496): Any amino acid
  MOD_RES (506)..(641): Any amino acid
  MOD_RES (658)..(681): Any amino acid
  MOD_RES (703)..(718): Any amino acid
  MOD_RES (732)..(732): Any amino acid
  MOD_RES (741)..(742): Any amino acid
KQGKTKATKMXXXXIFIFILLTHXXXXXXXXSQITNGTTGNPIICXXXXXXXXXXXXXXXXXXXXXXXXXXXXXGVIPLTTTPTKSYFANLKGXXXXXXXXXXXXXXXXXXXXXXXXXXXXXXXXXXXXXXXXXXXXXXXXXXXXXXXXXXXXXIMHDRTKIRXXXXXXXXXXXXXXXXXXXXXXXXXXXXXXXXXXXXXXXXXXXXXXXXXXXXXXXXXXXXEKENSYPMXXLTVEVPYVXXXXXXXXXXXXXXXXXXXXXXXXXXXXXXXXXXXXXXXGVTTHYVSXXXXXXXXXXDEGLPQSGRIVVXXXXXXXXXXXXXXXXXXXXXXXXXXXXXXXAPSGIEYNGKSLGIQXXEDIPIGNCXXXPSVKLPMGAIGAIDSSMXXXXXXXGEHAKAIGXXXXXXXXXXXXXXXXXXXXXIPIGERGLRRKKRGLFXXTHKQLTHHMRKKRGLFGXXRMTRGLFGAIGLFGAIAGLFGAIAGFIEGGWXXXXXXGRLVRFRHQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPTFDSLNITAASLNDXXXXXXXXXXXXXXXXXXXXXXXXVTTRQASPSCLVVNHGSLVLSXXXXXXXXXXXXXXXXLCSVEYASKTRISXKFVSSDCSXX

SEQ ID NO: 418290 - protein, 742 aa, Influenza virus
  MOD_RES (1)..(2): Any amino acid
  MOD_RES (11)..(14): Any amino acid
  MOD_RES (24)..(40): Any amino acid
  MOD_RES (49)..(223): Any amino acid
  MOD_RES (232)..(341): Any amino acid
  MOD_RES (354)..(358): Any amino acid
  MOD_RES (367)..(378): Any amino acid
  MOD_RES (387)..(422): Any amino acid
  MOD_RES (449)..(459): Any amino acid
  MOD_RES (477)..(477): Any amino acid
  MOD_RES (491)..(688): Any amino acid
  MOD_RES (702)..(732): Any amino acid
  MOD_RES (741)..(742): Any amino acid
XXSKSRGYKMXXXXIFIFLLLTHXXXXXXXXXXXXXXXXXNNNNNTATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKENSYPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAPSGVEYNGKSLXXXXXEDIPIGSCXXXXXXXXXXXXYGGLNKSKXXXXXXXXXXXXXXXXXXXXXXXXXXXXXXXXXXXXPAKLLKERGFFKKRGLFGAHKQLTHHXXXXXXXXXXXRETRGLFGARGLFGAIAXIFGAIAGFIENGWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPSTGNHGSLVLXXXXXXXXXXXXXXXXXXXXXXXXXXXXXXXKICESRLRXX

SEQ ID NO: 418291 - protein, 742 aa, Influenza virus
  MOD_RES (1)..(2): Any amino acid
  MOD_RES (11)..(14): Any amino acid
  MOD_RES (24)..(43): Any amino acid
  MOD_RES (52)..(223): Any amino acid
  MOD_RES (232)..(341): Any amino acid
  MOD_RES (350)..(358): Any amino acid
  MOD_RES (367)..(383): Any amino acid
  MOD_RES (394)..(424): Any amino acid
  MOD_RES (439)..(440): Any amino acid
  MOD_RES (449)..(459): Any amino acid
  MOD_RES (478)..(732): Any amino acid
  MOD_RES (742)..(742): Any amino acid
XXMKSRGYKMXXXXIFNFILLTHXXXXXXXXXXXXXXXXXXXXNNSTATLCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNNKNATNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNNNKGAVFXXXXXXXXXEDIPIENCXXXXXXXXXXXXXXXXXTSLTSLPFQNXXXXXXXXXXXXXXXXXXXXXXXXXXXXXXXREREGGRRRKRGLFXXIHKQLTHHXXXXXXXXXXXRKTRGLFGARGIFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFVNSDCSKX

SEQ ID NO: 418292 - protein, 742 aa, Influenza virus
  MOD_RES (1)..(17): Any amino acid
  MOD_RES (26)..(43): Any amino acid
  MOD_RES (52)..(430): Any amino acid
  MOD_RES (439)..(459): Any amino acid
  MOD_RES (476)..(732): Any amino acid
XXXXXXXXXXXXXXXXXRFSYVFCLXXXXXXXXXXXXXXXXXXSDNADKICXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRKRGLFGXXXXXXXXXXXXXXXXXXXXXQMTRGLFGRRGLFGAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFRDMRKNTL

SEQ ID NO: 418293 - protein, 742 aa, Influenza virus
  MOD_RES (1)..(17): Any amino acid
  MOD_RES (26)..(430): Any amino acid
  MOD_RES (439)..(461): Any amino acid
  MOD_RES (470)..(732): Any amino acid
XXXXXXXXXXXXXXXXXVLSCIFCLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRKKRGLFXXXXXXXXXXXXXXXXXXXXXXXPRGLFGAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDQNFRNIRK

SEQ ID NO: 418294 - protein, 742 aa, Influenza virus
  MOD_RES (1)..(430): Any amino acid
  MOD_RES (439)..(461): Any amino acid
  MOD_RES (470)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRKRRGLFXXXXXXXXXXXXXXXXXXXXXXXKRGLFGAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418295 - protein, 742 aa, Influenza virus
  MOD_RES (1)..(432): Any amino acid
  MOD_RES (441)..(461): Any amino acid
  MOD_RES (470)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKKRGLFGXXXXXXXXXXXXXXXXXXXXXARGLFGAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418296 - protein, 742 aa, Influenza virus
  MOD_RES (1)..(433): Any amino acid
  MOD_RES (442)..(462): Any amino acid
  MOD_RES (475)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXETRGLFGAXXXXXXXXXXXXXXXXXXXXXTKPRPRRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418297 - protein, 742 aa, Influenza virus
  MOD_RES (1)..(433): Any amino acid
  MOD_RES (442)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRKRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418298 - protein, 742 aa, Influenza virus
  MOD_RES (1)..(433): Any amino acid
  MOD_RES (442)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418299 - protein, 742 aa, Influenza virus
  MOD_RES (1)..(433): Any amino acid
  MOD_RES (442)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418300 - protein, 742 aa, Influenza virus
  MOD_RES (1)..(434): Any amino acid
  MOD_RES (446)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRRQKRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418301 - protein, 742 aa, Influenza virus
  MOD_RES (1)..(434): Any amino acid
  MOD_RES (446)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRRKKRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418302 - protein, 694 aa, Influenza virus
  MOD_RES (26)..(76): Any amino acid
  MOD_RES (87)..(385): Any amino acid
  MOD_RES (397)..(410): Any amino acid
  MOD_RES (420)..(425): Any amino acid
  MOD_RES (434)..(441): Any amino acid
  MOD_RES (453)..(453): Any amino acid
  MOD_RES (462)..(473): Any amino acid
  MOD_RES (482)..(546): Any amino acid
  MOD_RES (556)..(659): Any amino acid
  MOD_RES (676)..(677): Any amino acid
IGLREQKQEFKMNPNKKIIIAIGSVXXXXXXXXXXXXXXXXXXXXXXXXXXXXXXXXXXXXXXXXXXXXXXXXXXXVPLVPCEPIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILRTQESECVCXXXXXXXXXXXXXXIRKGLILEYXXXXXXGKKGKWLNXXXXXXXXIQHLEECSCYVXSYPNVRCVXXXXXXXXXXXXKLDINMADXXXXXXXXXXXXXXXXXXXXXXXXXXXXXXXXXXXXXXXXXXXXXXXXXXXXXXXXXXXXXXXXXNNYGVKGFGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFLWCKIVTTVGWSWPXXRTSISCLYHAYISFRNL

SEQ ID NO: 418303 - protein, 694 aa, Influenza virus
  MOD_RES (19)..(19): Any amino acid
  MOD_RES (30)..(385): Any amino acid
  MOD_RES (397)..(410): Any amino acid
  MOD_RES (420)..(425): Any amino acid
  MOD_RES (434)..(441): Any amino acid
  MOD_RES (450)..(453): Any amino acid
  MOD_RES (462)..(546): Any amino acid
  MOD_RES (555)..(694): Any amino acid
LVFREQKQEFKMNPNQKIXNRDITIGSICXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILRTQESSCTCXXXXXXXXXXXXXXIREGLILEYXXXXXXEKGKVVKSXXXXXXXXIKHLEECSXXXXSYLNVRCVXXXXXXXXXXXXXXXXXXXXXXXXXXXXXXXXXXXXXXXXXXXXXXXXXXXXXXXXXXXXXXXXXXXXXXXXXXXXXXXXXXXXXDNYGVKGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418304 - protein, 694 aa, Influenza virus
  MOD_RES (1)..(1): Any amino acid
  MOD_RES (13)..(385): Any amino acid
  MOD_RES (397)..(411): Any amino acid
  MOD_RES (434)..(441): Any amino acid
  MOD_RES (450)..(694): Any amino acid
XFSGSQKQEFKMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIMRTQESECACXXXXXXXXXXXXXXXVMGQASYKYKIFKNGKRGKWVKXXXXXXXXVQHLEECSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418305 - protein, 694 aa, Influenza virus
  MOD_RES (1)..(5): Any amino acid
  MOD_RES (18)..(387): Any amino acid
  MOD_RES (397)..(441): Any amino acid
  MOD_RES (450)..(694): Any amino acid
XXXXXQKQEIKMNPNQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTQESECQCXXXXXXXXXXXXXXXXXXXXXXXXXXXXXXXXXXXXXXXXXXXXXIRHLEECSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418306 - protein, 694 aa, Influenza virus
  MOD_RES (1)..(5): Any amino acid
  MOD_RES (18)..(387): Any amino acid
  MOD_RES (397)..(443): Any amino acid
  MOD_RES (453)..(694): Any amino acid
XXXXXAKAGVKMNPNQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTQESSCVCXXXXXXXXXXXXXXXXXXXXXXXXXXXXXXXXXXXXXXXXXXXXXXXHYEECSCYPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418307 - protein, 694 aa, Influenza virus
  MOD_RES (1)..(443): Any amino acid
  MOD_RES (453)..(694): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHVEECSCYPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418308 - protein, 694 aa, Influenza virus
  MOD_RES (1)..(443): Any amino acid
  MOD_RES (453)..(694): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHIEECSCYPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418309 - protein, 694 aa, Influenza virus
  MOD_RES (1)..(443): Any amino acid
  MOD_RES (452)..(694): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYYEECSCYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418310 - protein, 694 aa, Influenza virus
  MOD_RES (1)..(444): Any amino acid
  MOD_RES (453)..(694): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIEECSCYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418311 - protein, 502 aa, Influenza virus
  MOD_RES (29)..(43): Any amino acid
  MOD_RES (52)..(110): Any amino acid
  MOD_RES (165)..(165): Any amino acid
  MOD_RES (235)..(237): Any amino acid
  MOD_RES (285)..(289): Any amino acid
  MOD_RES (305)..(307): Any amino acid
  MOD_RES (328)..(330): Any amino acid
  MOD_RES (348)..(364): Any amino acid
  MOD_RES (385)..(389): Any amino acid
  MOD_RES (402)..(416): Any amino acid
  MOD_RES (452)..(454): Any amino acid
  MOD_RES (471)..(472): Any amino acid
  MOD_RES (496)..(502): Any amino acid
IGLREQKQEFKMNPNKKINRDITIGSICXXXXXXXXXXXXXXXASQYGPSHXXXXXXXXXXXXXXXXXXXXXXXXXXXXXXXXXXXXXXXXXXXXXXXXXXXXXXXXXXXGWAIYSKDNSIRIGSKGDVFVIREPFISCSHLECRTFFLTQGALLNDKHSNGTIXDRSPYRTLMSCPIGEVPSPYNSRFESVAWSASACHDGINWLTIGISGPDNGAVAVLKYNGIITDTIKSWXXXILRTQESECACVNGSCFTVMTDGPSVMGQASYKYKIFKNGKKGKWLNXXXXXAPNYHYEECSCYPDSXXXTCVCRDNWHGSNRPWVSFNQXXXYQIGYICSGVFGDNPRPXXXXXXXXXXXXXXXXXGVKGFSFKYGNGVWIGRTKSXXXXXGFEMIWDPNGWTXXXXXXXXXXXXXXXTDWSGYSGSFVQHPELTGLDCIRPCFWVELIRGRPXXXTTIWTSGSSISFCGVNXXIFLWCKIVTTVGWSWPDGAELPFXXXXXXX

SEQ ID NO: 418312 - protein, 502 aa, Influenza virus
  MOD_RES (19)..(43): Any amino acid
  MOD_RES (52)..(110): Any amino acid
  MOD_RES (165)..(165): Any amino acid
  MOD_RES (189)..(195): Any amino acid
  MOD_RES (235)..(237): Any amino acid
  MOD_RES (263)..(276): Any amino acid
  MOD_RES (285)..(289): Any amino acid
  MOD_RES (305)..(307): Any amino acid
  MOD_RES (328)..(330): Any amino acid
  MOD_RES (348)..(364): Any amino acid
  MOD_RES (383)..(389): Any amino acid
  MOD_RES (402)..(416): Any amino acid
  MOD_RES (452)..(454): Any amino acid
  MOD_RES (471)..(483): Any amino acid
  MOD_RES (496)..(502): Any amino acid
LVFREQKQEFKMNPNQKIXXXXXXXXXXXXXXXXXXXXXXXXXDLNMGQPFXXXXXXXXXXXXXXXXXXXXXXXXXXXXXXXXXXXXXXXXXXXXXXXXXXXXXXXXXXXGWAIYTKDNSIRIGSRGDVFVMREPFISCSPLECKTFFLTQGALLNDRHSNGTVXDRSPYRALMSCPLGEAPSPYNSRXXXXXXXASACHDGMSWLTIGISGPDDGAVAVLKYKGIITGTIKSWXXXIMRTQESECVCMNGSCFTIMTDGPSXXXXXXXXXXXXXXGKRGKWVKXXXXXAPNFHYEECSCYPESXXXMCVCRDNWHASNRPWVSFDQXXXYQMGYICSGIFGDNPRPXXXXXXXXXXXXXXXXXGVKGFSYKYGNGVWMGRTXXXXXXXGFEMVWDPNGWTXXXXXXXXXXXXXXXNEWSGYSGSFIQHPELTGMNCIRPCFWVELVRGLPXXXATIWTSGSIISFCGVNXXXXXXXXXXXXXNWSWPDGADLPFXXXXXXX

SEQ ID NO: 418313 - protein, 502 aa, Influenza virus
  MOD_RES (1)..(1): Any amino acid
  MOD_RES (13)..(110): Any amino acid
  MOD_RES (150)..(156): Any amino acid
  MOD_RES (165)..(165): Any amino acid
  MOD_RES (235)..(247): Any amino acid
  MOD_RES (263)..(276): Any amino acid
  MOD_RES (285)..(289): Any amino acid
  MOD_RES (305)..(307): Any amino acid
  MOD_RES (328)..(330): Any amino acid
  MOD_RES (341)..(364): Any amino acid
  MOD_RES (385)..(390): Any amino acid
  MOD_RES (402)..(416): Any amino acid
  MOD_RES (425)..(428): Any amino acid
  MOD_RES (452)..(455): Any amino acid
  MOD_RES (471)..(483): Any amino acid
  MOD_RES (496)..(502): Any amino acid
XFSGSQKQEFKMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAVYSKDNSVRIGSKGDIFVIREPFISCSQMECRTFFLXXXXXXXDKHSNGTVXDRSPHRTLMSCPVGEAPSPYNSKFESVAWSASACHDGTGWLTIGISGPDSGAVAVLKYNGMITETIKSWXXXXXXXXXXXXXCINGSCFTVLTDGPSXXXXXXXXXXXXXXEKGKVVKSXXXXXAPNFYYEECSCYPDTXXXVCVCRDNWHASNRPWISFDQXXXYKIGYICSGIXXXXXXXXXXXXXXXXXXXXXXXXGVKGFSFRYGNGVWIGRTKNXXXXXXFEMIWDPDGWTXXXXXXXXXXXXXXXNDWSGYSGXXXXHPELTGLNCMRPCFWVELIRGQPXXXXTIWASGSSISFCGVDXXXXXXXXXXXXXSWSWPDGAEVPFXXXXXXX

SEQ ID NO: 418314 - protein, 502 aa, Influenza virus
  MOD_RES (1)..(5): Any amino acid
  MOD_RES (18)..(110): Any amino acid
  MOD_RES (137)..(156): Any amino acid
  MOD_RES (165)..(165): Any amino acid
  MOD_RES (186)..(195): Any amino acid
  MOD_RES (235)..(247): Any amino acid
  MOD_RES (260)..(289): Any amino acid
  MOD_RES (305)..(307): Any amino acid
  MOD_RES (316)..(316): Any amino acid
  MOD_RES (328)..(330): Any amino acid
  MOD_RES (348)..(364): Any amino acid
  MOD_RES (382)..(393): Any amino acid
  MOD_RES (402)..(416): Any amino acid
  MOD_RES (425)..(428): Any amino acid
  MOD_RES (452)..(455): Any amino acid
  MOD_RES (471)..(483): Any amino acid
  MOD_RES (496)..(502): Any amino acid
XXXXXQKQEIKMNPNQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAVHSKDNGIRIGSKGDIFVMREPFXXXXXXXXXXXXXXXXXXXXDKHSNGTAXDRSPHRALMSCPIGEAPSPYXXXXXXXXXXASACHDGLGWITIGISGPDNEAVAVLKYNGVITDTVKSWXXXXXXXXXXXXXCLNGSCFTLMTDXXXXXXXXXXXXXXXXXXXXXXXXXXXXXXAPNSHYEECSCYPDAXXXICVCRDNWXGANRPWVSFNHXXXYQVGYICSGVFGDSPRPXXXXXXXXXXXXXXXXXGIKGFSFKYDNGVWIGRXXXXXXXXXXXXIWDPNGWSXXXXXXXXXXXXXXXTNWSGYSGXXXXHPELTGMDCMRPCFWVELVRGRPXXXXTVWTSGSSISFCGVSXXXXXXXXXXXXXDWSWPDGAKLPFXXXXXXX

SEQ ID NO: 418315 - protein, 502 aa, Influenza virus
  MOD_RES (1)..(110): Any amino acid
  MOD_RES (140)..(165): Any amino acid
  MOD_RES (186)..(195): Any amino acid
  MOD_RES (204)..(213): Any amino acid
  MOD_RES (229)..(249): Any amino acid
  MOD_RES (263)..(289): Any amino acid
  MOD_RES (301)..(319): Any amino acid
  MOD_RES (328)..(330): Any amino acid
  MOD_RES (347)..(364): Any amino acid
  MOD_RES (383)..(393): Any amino acid
  MOD_RES (402)..(435): Any amino acid
  MOD_RES (447)..(484): Any amino acid
  MOD_RES (496)..(502): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIHSKDNNIRIGSKGDVFVVREPFISCXXXXXXXXXXXXXXXXXXXXXXXXXXDRSPFRALMSCPVGEVPSPYXXXXXXXXXXASACHDGVXXXXXXXXXXDNGAVAVVKYNGIITXXXXXXXXXXXXXXXXXXXXXNGFCFTVMTDGPNXXXXXXXXXXXXXXXXXXXXXXXXXXXAPNYYYEECSCXXXXXXXXXXXXXXXXXXXRPWISFNQXXXYRIGYICSGVLGDNPRXXXXXXXXXXXXXXXXXXGVKGFSYRYGDGVWIGRTXXXXXXXXXXXIWDPNGWAXXXXXXXXXXXXXXXXXXXXXXXXXXXXXXXXXXNCIKPCFWVELXXXXXXXXXXXXXXXXXXXXXXXXXXXXXXXXXXXXXXWSWPDDAELPFXXXXXXX

SEQ ID NO: 418316 - protein, 502 aa, Influenza virus
  MOD_RES (1)..(176): Any amino acid
  MOD_RES (185)..(249): Any amino acid
  MOD_RES (258)..(332): Any amino acid
  MOD_RES (348)..(366): Any amino acid
  MOD_RES (375)..(502): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPMGEAPSPXXXXXXXXXXXXXXXXXXXXXXXXXXXXXXXXXXXXXXXXXXXXXXXXXXXXXXXXXXXXXXXXXNGYCFTVMXXXXXXXXXXXXXXXXXXXXXXXXXXXXXXXXXXXXXXXXXXXXXXXXXXXXXXXXXXXXXXXXXXXXXXXXXXXMGYICSGVFGDNPRSXXXXXXXXXXXXXXXXXXXKGFSYKYDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418317 - protein, 502 aa, Influenza virus
  MOD_RES (1)..(254): Any amino acid
  MOD_RES (263)..(339): Any amino acid
  MOD_RES (348)..(371): Any amino acid
  MOD_RES (380)..(502): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTIMTDGPNXXXXXXXXXXXXXXXXXXXXXXXXXXXXXXXXXXXXXXXXXXXXXXXXXXXXXXXXXXXXXXXXXXXXXXXXXXXXXVFGDTPRPXXXXXXXXXXXXXXXXXXXXXXXXKYGDGVWIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418318 - protein, 494 aa, Influenza virus
  MOD_RES (21)..(53): Any amino acid
  MOD_RES (62)..(71): Any amino acid
  MOD_RES (80)..(85): Any amino acid
  MOD_RES (95)..(109): Any amino acid
  MOD_RES (127)..(127): Any amino acid
  MOD_RES (140)..(141): Any amino acid
  MOD_RES (155)..(167): Any amino acid
  MOD_RES (211)..(213): Any amino acid
  MOD_RES (222)..(234): Any amino acid
  MOD_RES (250)..(250): Any amino acid
  MOD_RES (263)..(285): Any amino acid
  MOD_RES (301)..(303): Any amino acid
  MOD_RES (328)..(333): Any amino acid
  MOD_RES (347)..(364): Any amino acid
  MOD_RES (375)..(376): Any amino acid
  MOD_RES (385)..(388): Any amino acid
  MOD_RES (399)..(421): Any amino acid
  MOD_RES (432)..(434): Any amino acid
  MOD_RES (449)..(453): Any amino acid
AKAGVKMNPNQKIIIAIGSVXXXXXXXXXXXXXXXXXXXXXXXXXXXXXXXXXKNNQVILCXXXXXXXXXXKTVVHLNSXXXXXXEKEKEICSVXXXXXXXXXXXXXXXGFAPFSKDNSIRLSAGGXIWVTREPYVSCDXXKCYQFALGQGTTLXXXXXXXXXXXXXPYRTLLMNELGVPFHLGTKQVCIAWSSSSCHDGKAWLHVCVTGXXXNATASFIYXXXXXXXXXXXXXNILRTQESECVCINGXCTVVMTDGSASGXXXXXXXXXXXXXXXXXXXXXXXGSAQHVEECSCYPRYXXXVRCVCRDNWKGSNRPIKLDINMADXXXXXXYVCSGLVGDTPRKXXXXXXXXXXXXXXXXXXHGVKGWAFDDXXDVWMGRTIXXXXRSGYETFKVIXXXXXXXXXXXXXXXXXXXXXXXSGYSGIFSVEXXXCINRCFYVELIRGRXXXXXVWWTSNSIVVFCGTSGTYGTGSWPDGADIINLHAYISFRNL

SEQ ID NO: 418319 - protein, 494 aa, Influenza virus
  MOD_RES (1)..(58): Any amino acid
  MOD_RES (69)..(109): Any amino acid
  MOD_RES (126)..(127): Any amino acid
  MOD_RES (140)..(141): Any amino acid
  MOD_RES (150)..(167): Any amino acid
  MOD_RES (211)..(213): Any amino acid
  MOD_RES (222)..(234): Any amino acid
  MOD_RES (250)..(250): Any amino acid
  MOD_RES (263)..(285): Any amino acid
  MOD_RES (301)..(303): Any amino acid
  MOD_RES (320)..(333): Any amino acid
  MOD_RES (347)..(364): Any amino acid
  MOD_RES (375)..(376): Any amino acid
  MOD_RES (385)..(388): Any amino acid
  MOD_RES (399)..(421): Any amino acid
  MOD_RES (432)..(434): Any amino acid
  MOD_RES (449)..(453): Any amino acid
  MOD_RES (493)..(494): Any amino acid
XXXXXXXXXXXXXXXXXXXXXXXXXXXXXXXXXXXXXXXXXXXXXXXXXXXXXXXXXXVPLVPCEPIIXXXXXXXXXXXXXXXXXXXXXXXXXXXXXXXXXXXXXXXXXGFAPFAKDNSIRLAAGXXIWITREPYVSCGXXRCYQFALGXXXXXXXXXXXXXXXXXXPHRTLLMNELGIPFHLGTKQVCMAWSSSSCYDGKAWLHICVTGXXXNATASIIYXXXXXXXXXXXXXKILRTQESECICINGXCAVVMTDGSASEXXXXXXXXXXXXXXXXXXXXXXXGSAQHIEECSCYPQYXXXVRCICRDNWKGSNRPVXXXXXXXXXXXXXXYLCSGLVGDTPRNXXXXXXXXXXXXXXXXXXPGVKGWAFDNXXDIWMGRTIXXXXRSGYETFRVIXXXXXXXXXXXXXXXXXXXXXXXSGYSGVFSVEXXXCVNRCFYVELIRGSXXXXXVLWTSNSIVAFCGTSGTYGSGSWPDGANIINFMPYISFAXX

SEQ ID NO: 418320 - protein, 494 aa, Influenza virus
  MOD_RES (1)..(109): Any amino acid
  MOD_RES (127)..(127): Any amino acid
  MOD_RES (140)..(167): Any amino acid
  MOD_RES (211)..(213): Any amino acid
  MOD_RES (222)..(234): Any amino acid
  MOD_RES (250)..(251): Any amino acid
  MOD_RES (263)..(285): Any amino acid
  MOD_RES (301)..(303): Any amino acid
  MOD_RES (320)..(333): Any amino acid
  MOD_RES (347)..(364): Any amino acid
  MOD_RES (375)..(376): Any amino acid
  MOD_RES (385)..(388): Any amino acid
  MOD_RES (399)..(422): Any amino acid
  MOD_RES (432)..(440): Any amino acid
  MOD_RES (449)..(454): Any amino acid
  MOD_RES (492)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFVPFSKDNSVRLSAGGXIWVTRELYVSCDXXXXXXXXXXXXXXXXXXXXXXXXXXXXPHRTLLMSELGVPFHLATKQVCVAWSSSSCHDGRAWLHVCITGXXXNATASFVYXXXXXXXXXXXXXEILRTQESECVCISGXXTVVMTDGNASGXXXXXXXXXXXXXXXXXXXXXXXGNAQHVEECSCYPRFXXXIRCVCRDNWRGSNRPVXXXXXXXXXXXXXXYMCSGLVGDTPRSXXXXXXXXXXXXXXXXXXQGVKGWAFDSXXDLWMGRTIXXXXRLGYETFKVVXXXXXXXXXXXXXXXXXXXXXXXXGYSGIFSIEXXXXXXXXXYVELVRGRXXXXXXWWTSNSIIVFCGTSGTYGAGSWPDGAEIIKSHAYISFXXX

SEQ ID NO: 418321 - protein, 494 aa, Influenza virus
  MOD_RES (1)..(109): Any amino acid
  MOD_RES (127)..(127): Any amino acid
  MOD_RES (140)..(167): Any amino acid
  MOD_RES (177)..(178): Any amino acid
  MOD_RES (194)..(194): Any amino acid
  MOD_RES (208)..(213): Any amino acid
  MOD_RES (222)..(234): Any amino acid
  MOD_RES (250)..(254): Any amino acid
  MOD_RES (263)..(292): Any amino acid
  MOD_RES (301)..(311): Any amino acid
  MOD_RES (320)..(338): Any amino acid
  MOD_RES (347)..(366): Any amino acid
  MOD_RES (375)..(388): Any amino acid
  MOD_RES (399)..(454): Any amino acid
  MOD_RES (466)..(472): Any amino acid
  MOD_RES (493)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFAPFTKDNSIRLSASGXVWVTREPYVSCSXXXXXXXXXXXXXXXXXXXXXXXXXXXXPYRTLLMSEXXVPFHLGTRQVCIAWSXSSCHDGNAWLHVCXXXXXXNATASLIYXXXXXXXXXXXXXDILRTQESECVCIDGXXXXXMTDGSASDXXXXXXXXXXXXXXXXXXXXXXXXXXXXXXECSCYPRHXXXXXXXXXXXWRGSNRPIXXXXXXXXXXXXXXXXXXXLVGDTPRDXXXXXXXXXXXXXXXXXXXXVKGWAFDYXXXXXXXXXXXXXXRAGYETFRVVXXXXXXXXXXXXXXXXXXXXXXXXXXXXXXXXXXXXXXXXXXXXXXXXXXXXXXXXWWTANSIIVFCXXXXXXXTGTWPDGADIISCLYKLSQFXX

SEQ ID NO: 418322 - protein, 494 aa, Influenza virus
  MOD_RES (1)..(112): Any amino acid
  MOD_RES (122)..(131): Any amino acid
  MOD_RES (140)..(167): Any amino acid
  MOD_RES (176)..(178): Any amino acid
  MOD_RES (187)..(234): Any amino acid
  MOD_RES (250)..(260): Any amino acid
  MOD_RES (270)..(292): Any amino acid
  MOD_RES (301)..(338): Any amino acid
  MOD_RES (347)..(366): Any amino acid
  MOD_RES (375)..(388): Any amino acid
  MOD_RES (398)..(455): Any amino acid
  MOD_RES (470)..(474): Any amino acid
  MOD_RES (491)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLSKDNSIRXXXXXXXXXXREPYVSCEXXXXXXXXXXXXXXXXXXXXXXXXXXXXSHRTLLMNXXXVPFYLGTKXXXXXXXXXXXXXXXXXXXXXXXXXXXXXXXXXXXXXXXXXXXXXXXXSILRTQESECVCINEXXXXXXXXXXXIRKGLILEYXXXXXXXXXXXXXXXXXXXXXXXECSCYPSYXXXXXXXXXXXXXXXXXXXXXXXXXXXXXXXXXXXXXXLVGDTPREXXXXXXXXXXXXXXXXXXXXVKGWAFDVXXXXXXXXXXXXXXRAGYETFKVXXXXXXXXXXXXXXXXXXXXXXXXXXXXXXXXXXXXXXXXXXXXXXXXXXXXXXXXXXWTSNSIIAFCGTSGXXXXXSWPDGADLINLMPIYSXXXX

SEQ ID NO: 418323 - protein, 494 aa, Influenza virus
  MOD_RES (1)..(184): Any amino acid
  MOD_RES (194)..(260): Any amino acid
  MOD_RES (270)..(299): Any amino acid
  MOD_RES (308)..(390): Any amino acid
  MOD_RES (399)..(479): Any amino acid
  MOD_RES (490)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRQVCMAWSXXXXXXXXXXXXXXXXXXXXXXXXXXXXXXXXXXXXXXXXXXXXXXXXXXXXXXXXXXXXXXXXXXXIREGLILEYXXXXXXXXXXXXXXXXXXXXXXXXXXXXXXSYLNVRCVXXXXXXXXXXXXXXXXXXXXXXXXXXXXXXXXXXXXXXXXXXXXXXXXXXXXXXXXXXXXXXXXXXXXXXXXXXXXXXXXXXXGYETFRVTXXXXXXXXXXXXXXXXXXXXXXXXXXXXXXXXXXXXXXXXXXXXXXXXXXXXXXXXXXXXXXXXXXXXXXXXXXXXXXXXXRTSISCLYKLXXXXX

SEQ ID NO: 418324 - protein, 494 aa, Influenza virus
  MOD_RES (1)..(299): Any amino acid
  MOD_RES (308)..(481): Any amino acid
  MOD_RES (490)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSYPNVRCVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDINLHAYIXXXXX

SEQ ID NO: 418325 - protein, 494 aa, Influenza virus
  MOD_RES (1)..(481): Any amino acid
  MOD_RES (490)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDIKSHAYIXXXXX

SEQ ID NO: 418326 - protein, 494 aa, Influenza virus
  MOD_RES (1)..(481): Any amino acid
  MOD_RES (490)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNINFMPYIXXXXX

SEQ ID NO: 418327 - protein, 494 aa, Influenza virus
  MOD_RES (1)..(481): Any amino acid
  MOD_RES (490)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDINLMPIYXXXXX

SEQ ID NO: 418328 - protein, 494 aa, Influenza virus
  MOD_RES (1)..(483): Any amino acid
  MOD_RES (493)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLMGRTRISXX

SEQ ID NO: 418329 - protein, 515 aa, Influenza virus
  MOD_RES (1)..(20): Any amino acid
  MOD_RES (39)..(88): Any amino acid
  MOD_RES (112)..(113): Any amino acid
  MOD_RES (127)..(127): Any amino acid
  MOD_RES (195)..(266): Any amino acid
  MOD_RES (281)..(287): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (413)..(414): Any amino acid
  MOD_RES (430)..(438): Any amino acid
  MOD_RES (458)..(460): Any amino acid
  MOD_RES (478)..(481): Any amino acid
XXXXXXXXXXXXXXXXXXXXALLIGVGNLVFNTVIHEKXXXXXXXXXXXXXXXXXXXXXXXXXXXXXXXXXXXXXXXXXXXXXXXXXXLPLCPFRGFFPFHKDNAIRLGENXXVIVTREPYVSCDNXNCWSFALAQGALLGTKHSNGTIKDRTPYRSLIRFPIGTAPVLGNYKEICIAWSSSSCFDGKEWMHVCXXXXXXXXXXXXXXXXXXXXXXXXXXXXXXXXXXXXXXXXXXXXXXXXXXXXXXXXXXXXXXXXXXXXXXXXKDILRTQESECQCIXXXXXXXVTDGPAANSADHRVYWIRXXXXXXXXXXXXXKIQHLEECSCYVDXDVYCICRDNWKGSNRPWMRINNETILETGYVCSKFHSDTPRPADPSXXXXXXXXXXXXGPGVKGFGFKXGNDVWLGRTVSXXGRSGFEIIKVTEGWIXXXXXXXXXTQTLVSNNDWSGYSGSFIVXXXGCFQPCFYVELIRGRPNXXXXVSWTSNSIVTFCGLDNEPGSGNWPDGSNIGFMPK

SEQ ID NO: 418330 - protein, 515 aa, Influenza virus
  MOD_RES (1)..(20): Any amino acid
  MOD_RES (39)..(88): Any amino acid
  MOD_RES (112)..(113): Any amino acid
  MOD_RES (127)..(127): Any amino acid
  MOD_RES (195)..(266): Any amino acid
  MOD_RES (281)..(287): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (413)..(414): Any amino acid
  MOD_RES (430)..(438): Any amino acid
  MOD_RES (458)..(460): Any amino acid
  MOD_RES (478)..(481): Any amino acid
XXXXXXXXXXXXXXXXXXXXALLIGIGNLIFNTVIHGKXXXXXXXXXXXXXXXXXXXXXXXXXXXXXXXXXXXXXXXXXXXXXXXXXXLPLCPFKGFFPFHKDNALRLAENXXIIVTREPYISCDNXDCWSFALAQGTLLGTNHSNGTNKDRTSYRSLIRFPVGVAPVLGNYREICVAWSSSSCFDGREWMHVCXXXXXXXXXXXXXXXXXXXXXXXXXXXXXXXXXXXXXXXXXXXXXXXXXXXXXXXXXXXXXXXXXXXXXXXXRDILRTQESECQCLXXXXXXXVTDGPAASSADHRIYWIRXXXXXXXXXXXXXKIKHLEECSCYTDXDVYCVCRDNWKGSNRPWVRMNNETILETGYICSKFHSDTPRPDDPSXXXXXXXXXXXXGLGVKGFGFRXGDDVWLGRTISXXGRSGFEVIKVSNGWIXXXXXXXXXTQTLVSNSDWSGYSGSFVIXXXDCFQPCFYIELIRGRTNXXXXVSWASNSIVTFCGLNNEPGSGDWPDGSDIGFMPK

SEQ ID NO: 418331 - protein, 515 aa, Influenza virus
  MOD_RES (1)..(20): Any amino acid
  MOD_RES (39)..(88): Any amino acid
  MOD_RES (112)..(113): Any amino acid
  MOD_RES (123)..(127): Any amino acid
  MOD_RES (195)..(266): Any amino acid
  MOD_RES (276)..(287): Any amino acid
  MOD_RES (306)..(318): Any amino acid
  MOD_RES (327)..(332): Any amino acid
  MOD_RES (342)..(342): Any amino acid
  MOD_RES (366)..(367): Any amino acid
  MOD_RES (379)..(390): Any amino acid
  MOD_RES (400)..(401): Any amino acid
  MOD_RES (413)..(414): Any amino acid
  MOD_RES (430)..(438): Any amino acid
  MOD_RES (447)..(449): Any amino acid
  MOD_RES (458)..(460): Any amino acid
  MOD_RES (478)..(481): Any amino acid
  MOD_RES (503)..(503): Any amino acid
XXXXXXXXXXXXXXXXXXXXALFIGVGNLIFNAVIHGKXXXXXXXXXXXXXXXXXXXXXXXXXXXXXXXXXXXXXXXXXXXXXXXXXXLPLCPFQGFFPFHKDNAVRLGENXXVLVTREPYIXXXXXGCWSFALAQGVLLGTRHSNGTVKDRTPYRSLIQFPIGTAPILGNYKEMCAAWSSSSCFDGKEWLHVCXXXXXXXXXXXXXXXXXXXXXXXXXXXXXXXXXXXXXXXXXXXXXXXXXXXXXXXXXXXXXXXXXXXXXXXXNNILRTQESXXXXXXXXXXXXVTDGPADNKADHRIYWVRXXXXXXXXXXXXXRIQHLEECXXXXXXDIYCICRDNXKGSNRPWIRINNETIIETGYVCSXXHSDTPRPVDPSXXXXXXXXXXXXRRGVKGFGFXXQNDVWLGRTMSXXSRSGFEVIRVAEGWIXXXXXXXXXIQTLVSNNXXXGYSGSFIIXXXACFQPCFYVELTRGVPNXXXXVSWTSNSMVTFCGLDNEPGSEXWPDGANIGFMPK

SEQ ID NO: 418332 - protein, 515 aa, Influenza virus
  MOD_RES (1)..(20): Any amino acid
  MOD_RES (39)..(103): Any amino acid
  MOD_RES (112)..(113): Any amino acid
  MOD_RES (127)..(127): Any amino acid
  MOD_RES (163)..(164): Any amino acid
  MOD_RES (173)..(173): Any amino acid
  MOD_RES (182)..(185): Any amino acid
  MOD_RES (195)..(266): Any amino acid
  MOD_RES (275)..(287): Any amino acid
  MOD_RES (306)..(318): Any amino acid
  MOD_RES (328)..(332): Any amino acid
  MOD_RES (342)..(344): Any amino acid
  MOD_RES (366)..(367): Any amino acid
  MOD_RES (379)..(390): Any amino acid
  MOD_RES (399)..(401): Any amino acid
  MOD_RES (411)..(414): Any amino acid
  MOD_RES (425)..(438): Any amino acid
  MOD_RES (449)..(449): Any amino acid
  MOD_RES (458)..(467): Any amino acid
  MOD_RES (478)..(482): Any amino acid
  MOD_RES (491)..(496): Any amino acid
  MOD_RES (515)..(515): Any amino acid
XXXXXXXXXXXXXXXXXXXXALIIGVGNLAFNAVIHEKXXXXXXXXXXXXXXXXXXXXXXXXXXXXXXXXXXXXXXXXXXXXXXXXXXXXXXXXXXXXXXXXXNAIRLGETXXVIITREPYVSCDYXHCWSFALAQGALVGTKHSNGTIEDRTPYRSLIKFPXXAAPVLGNYXEMCVAWSSXXXXDGKEWMHICXXXXXXXXXXXXXXXXXXXXXXXXXXXXXXXXXXXXXXXXXXXXXXXXXXXXXXXXXXXXXXXXXXXXXXXXKNILRTQEXXXXXXXXXXXXXITDGPAANNADYRVYWIRXXXXXXXXXXXXXKVQHLEECSXXXXXDIYCVCRDNXXXSNRPWVRINNETIVETGYVCSXXHSDTPRPSDPSXXXXXXXXXXXXEPGVKGFGXXXGSDVWLGRTXXXXWRSGFEIIRVXXXXXXXXXXXXXXTQTLVANNDWXGYSGSFSVXXXXXXXXXXYIELIRGKPNXXXXXSWTSNSIIXXXXXXNEPGSGNGPDGSKIGFMPX

SEQ ID NO: 418333 - protein, 515 aa, Influenza virus
  MOD_RES (1)..(20): Any amino acid
  MOD_RES (39)..(113): Any amino acid
  MOD_RES (127)..(127): Any amino acid
  MOD_RES (136)..(145): Any amino acid
  MOD_RES (165)..(165): Any amino acid
  MOD_RES (182)..(266): Any amino acid
  MOD_RES (275)..(287): Any amino acid
  MOD_RES (306)..(318): Any amino acid
  MOD_RES (329)..(345): Any amino acid
  MOD_RES (367)..(367): Any amino acid
  MOD_RES (379)..(390): Any amino acid
  MOD_RES (399)..(401): Any amino acid
  MOD_RES (410)..(421): Any amino acid
  MOD_RES (430)..(469): Any amino acid
  MOD_RES (478)..(496): Any amino acid
  MOD_RES (512)..(515): Any amino acid
XXXXXXXXXXXXXXXXXXXXALLVGIGNLVFNTVIHERXXXXXXXXXXXXXXXXXXXXXXXXXXXXXXXXXXXXXXXXXXXXXXXXXXXXXXXXXXXXXXXXXXXXXXXXXXXAIVTREPYVSCDSXVCWSFALAXXXXXXXXXXNGTIRDRTPYRSLIQFPMGXAPVLGNCKEMCIAWSSXXXXXXXXXXXXXXXXXXXXXXXXXXXXXXXXXXXXXXXXXXXXXXXXXXXXXXXXXXXXXXXXXXXXXXXXXXXXXXXXXXXXXNDILRTQEXXXXXXXXXXXXXVTDDPAANSADHRIYWIKXXXXXXXXXXXXXKIRHLEECSCXXXXXXXXXXXXXXXXXNRPWMRISNETILETGYVCGKXHSDTPRPTDPSXXXXXXXXXXXXRPGVKGFGXXXSNDVWLGRXXXXXXXXXXXXIKVAEGWIXXXXXXXXXXXXXXXXXXXXXXXXXXXXXXXXXXXXXXXXELIRGRLNXXXXXXXXXXXXXXXXXXXNEPGSGSWPDGPKIGXXXX

SEQ ID NO: 418334 - protein, 515 aa, Influenza virus
  MOD_RES (1)..(24): Any amino acid
  MOD_RES (33)..(133): Any amino acid
  MOD_RES (142)..(149): Any amino acid
  MOD_RES (161)..(421): Any amino acid
  MOD_RES (430)..(500): Any amino acid
  MOD_RES (509)..(515): Any amino acid
XXXXXXXXXXXXXXXXXXXXXXXXGIGNLAFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSQGALLGXXXXXXXXKDRAPYRSLIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIKVTDGWIXXXXXXXXXXXXXXXXXXXXXXXXXXXXXXXXXXXXXXXXXXXXXXXXXXXXXXXXXXXXXXXXXXXXXXXSGNWPDGAXXXXXXX

SEQ ID NO: 418335 - protein, 515 aa, Influenza virus
  MOD_RES (1)..(500): Any amino acid
  MOD_RES (509)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGNWPDGPXXXXXXX

SEQ ID NO: 418336 - protein, 515 aa, Influenza virus
  MOD_RES (1)..(505): Any amino acid
  MOD_RES (515)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGSNIKFMPX

SEQ ID NO: 418337 - protein, 470 aa, Influenza virus
  MOD_RES (15)..(16): Any amino acid
  MOD_RES (44)..(47): Any amino acid
  MOD_RES (74)..(89): Any amino acid
  MOD_RES (264)..(266): Any amino acid
  MOD_RES (335)..(335): Any amino acid
MNPNQKIITIGSISXXLTTVGLLLQITSLCSIWFSHYNQVTQTXXXXCSNNTTNYYNETFVNVTNVQNNYTTVXXXXXXXXXXXXXXXXLCPIRGWAPLSKDNGIRIGSRGEVFVIREPFISCSISECRTFFLTQGALLNDKHSNGTVKDRSPFRTLMSCPIGVAPSPSNSRFESVAWSATACSDGPGWLTLGITGPDATAVAVLKYNGIITDTLKSWKGNIMRTQESECVCQDEFCYTLITDGPSDAQAFYKILKIRKGKIVXXXDVDATGFHFEECSCYPSGTDIECVCRDNWRGSNRPWIRFNSDLDYQIGYVCSGIFGDNPRPVDGTGSCXSPVNNGKGRYGVKGFSFRYGDGVWIGRTKSLESRSGFEMVWDANGWVSTDKDSNGVQDIIDNDNWSGYSGSFSIRGETTGRNCTVPCFWVEMIRGQPKEKTIWTSGSSIAFCGVNSDTTGWSWPDGALLPFDIDK

SEQ ID NO: 418338 - protein, 470 aa, Influenza virus
  MOD_RES (15)..(16): Any amino acid
  MOD_RES (28)..(32): Any amino acid
  MOD_RES (44)..(47): Any amino acid
  MOD_RES (74)..(89): Any amino acid
  MOD_RES (102)..(112): Any amino acid
  MOD_RES (134)..(154): Any amino acid
  MOD_RES (170)..(179): Any amino acid
  MOD_RES (223)..(233): Any amino acid
  MOD_RES (264)..(266): Any amino acid
  MOD_RES (295)..(295): Any amino acid
  MOD_RES (335)..(335): Any amino acid
  MOD_RES (346)..(362): Any amino acid
  MOD_RES (468)..(470): Any amino acid
MNPNQSIITIGSVSXXLTTIGLLLQITXXXXXWFSHYNQMTQAXXXXCSNDTINYYNETFVNITNVQNDYTTVXXXXXXXXXXXXXXXXLCPVKGWAPLSKXXXXXXXXXXXVFVIREPCISCSINECRTFFLXXXXXXXXXXXXXXXXXXXXXRTLMSCPMGVAPSPSXXXXXXXXXXATACSDGSGWLTLGITGPDSTAVAVIKYNGIITDTFKSWKGNIXXXXXXXXXXXDEFCYTLMTDGPSDAQAFYKLLKIKKGKIVXXXDVDATGYHFEECSCYPSGENVECVCRDNXQGSNRPWIRFNSNLDYQIGYICSGVFGDNPRPADGTGSCXGPINNGKGRYXXXXXXXXXXXXXXXXXTKSLESRRGFEMIWDANGWVTADKDSNGVQDIIDNNNWSGYSGSFSIRWETTGRNCTIPCFWVEMIRGQPKERTIWTSGSSIAFCGVDSDTTGWPWPDGALLPLTXXX

SEQ ID NO: 418339 - protein, 470 aa, Influenza virus
  MOD_RES (13)..(18): Any amino acid
  MOD_RES (44)..(57): Any amino acid
  MOD_RES (74)..(89): Any amino acid
  MOD_RES (101)..(113): Any amino acid
  MOD_RES (134)..(154): Any amino acid
  MOD_RES (170)..(184): Any amino acid
  MOD_RES (218)..(233): Any amino acid
  MOD_RES (249)..(250): Any amino acid
  MOD_RES (264)..(266): Any amino acid
  MOD_RES (294)..(301): Any amino acid
  MOD_RES (335)..(335): Any amino acid
  MOD_RES (344)..(363): Any amino acid
  MOD_RES (395)..(428): Any amino acid
  MOD_RES (444)..(444): Any amino acid
  MOD_RES (465)..(470): Any amino acid
MNPNQKIVTIGSXXXXXXTIGPLLQIISLCSIWFSHYNQMKQAXXXXXXXXXXXXXXETFVNVTHVQNNYTTIXXXXXXXXXXXXXXXXLCPIKGWAPLSXXXXXXXXXXXXXFVIREPFVSCSIHECRTFFLXXXXXXXXXXXXXXXXXXXXXRTLMSCPVGVAPSPSXXXXXXXXXXXXXXXDGPGWLTIGITGPDATAVAVIKYNGVITDTLKSXXXXXXXXXXXXXXXXDEFCYTLVTDGPSDAXXFYKILKIKKGKLVXXXDVNATGFHLEECSCYPSGESVECVCRDXXXXXXXXWIRFNSDPDYQIGYVCSGVFGDNPRPMDSTGSCXSPINNGKGXXXXXXXXXXXXXXXXXXXXKNLESRSGFEMIWDDNGWVSTDKNSNGVQDIXXXXXXXXXXXXXXXXXXXXXXXXXXXXXXXXXXRGQPKEKAIWTSGSSXAFCGVNFDTTSWSWPDGALFXXXXXX

SEQ ID NO: 418340 - protein, 470 aa, Influenza virus
  MOD_RES (1)..(1): Any amino acid
  MOD_RES (15)..(19): Any amino acid
  MOD_RES (30)..(33): Any amino acid
  MOD_RES (44)..(57): Any amino acid
  MOD_RES (71)..(117): Any amino acid
  MOD_RES (133)..(157): Any amino acid
  MOD_RES (168)..(191): Any amino acid
  MOD_RES (213)..(239): Any amino acid
  MOD_RES (255)..(255): Any amino acid
  MOD_RES (264)..(266): Any amino acid
  MOD_RES (294)..(302): Any amino acid
  MOD_RES (311)..(319): Any amino acid
  MOD_RES (335)..(381): Any amino acid
  MOD_RES (391)..(429): Any amino acid
  MOD_RES (441)..(445): Any amino acid
  MOD_RES (459)..(462): Any amino acid
XNPNQMIITIGSASXXXXXVGLLLQIISLXXXXFSHYNQVAQTXXXXXXXXXXXXXXETFVNMTNVQNNYXXXXXXXXXXXXXXXXXXXXXXXXXXXXXXXXXXXXXXXXXXXXXXXEPFISCSVSECRTFFXXXXXXXXXXXXXXXXXXXXXXXXXMSCHIGVAPSXXXXXXXXXXXXXXXXXXXXXXXXLGITGPDTTAVAVLKYNGVITXXXXXXXXXXXXXXXXXXXXXXXXXXXLITDGPSNAQAFYKIXKIRKGKIMXXXDVDAPGFHFEECSCYPSGEDVECVCRDXXXXXXXXXVRFNSDLDXXXXXXXXXIFGDSPRPVDGIGSCXXXXXXXXXXXXXXXXXXXXXXXXXXXXXXXXXXXXXXXXXXXXXXXVSTDKSSNGXXXXXXXXXXXXXXXXXXXXXXXXXXXXXXXXXXXXXXXGQPNERTIWTSXXXXXFCGVNSNTTGWSWXXXXLLPFDIDR

SEQ ID NO: 418341 - protein, 470 aa, Influenza virus
  MOD_RES (1)..(3): Any amino acid
  MOD_RES (13)..(19): Any amino acid
  MOD_RES (28)..(35): Any amino acid
  MOD_RES (44)..(61): Any amino acid
  MOD_RES (71)..(120): Any amino acid
  MOD_RES (134)..(160): Any amino acid
  MOD_RES (169)..(246): Any amino acid
  MOD_RES (255)..(266): Any amino acid
  MOD_RES (278)..(285): Any amino acid
  MOD_RES (294)..(302): Any amino acid
  MOD_RES (317)..(320): Any amino acid
  MOD_RES (334)..(447): Any amino acid
  MOD_RES (459)..(470): Any amino acid
XXXRSKIITIGSXXXXXXXIGLLLQIIXXXXXXXXHYNQVTQPXXXXXXXXXXXXXXXXXXNVTNVQNDYXXXXXXXXXXXXXXXXXXXXXXXXXXXXXXXXXXXXXXXXXXXXXXXXXXISCSIDECRTFFLXXXXXXXXXXXXXXXXXXXXXXXXXXXPIGVVPSPXXXXXXXXXXXXXXXXXXXXXXXXXXXXXXXXXXXXXXXXXXXXXXXXXXXXXXXXXXXXXXXXXXXXXXXXXXXXXXDGQAFYKIXXXXXXXXXXXXDVDAIGFHFEEXXXXXXXXSIECVCRDXXXXXXXXXIRFNSDLNYQIGYIXXXXFGDNPRSVDGTGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVDSDTTSWSWXXXXXXXXXXXX

SEQ ID NO: 418342 - protein, 470 aa, Influenza virus
  MOD_RES (1)..(19): Any amino acid
  MOD_RES (30)..(270): Any amino acid
  MOD_RES (279)..(326): Any amino acid
  MOD_RES (335)..(447): Any amino acid
  MOD_RES (457)..(470): Any amino acid
XXXXXXXXXXXXXXXXXXXVGLLLQVTSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGFHFEECXXXXXXXXXXXXXXXXXXXXXXXXXXXXXXXXXXXXXXXXXXXXXXXXPMDGTGSCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVNSDTTSWXXXXXXXXXXXXXX

SEQ ID NO: 418343 - protein, 470 aa, Influenza virus
  MOD_RES (1)..(448): Any amino acid
  MOD_RES (460)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVNSDTTCWSWPXXXXXXXXXXX

SEQ ID NO: 418344 - protein, 473 aa, Influenza virus
  MOD_RES (19)..(20): Any amino acid
  MOD_RES (30)..(47): Any amino acid
  MOD_RES (71)..(79): Any amino acid
  MOD_RES (234)..(234): Any amino acid
  MOD_RES (257)..(264): Any amino acid
  MOD_RES (302)..(308): Any amino acid
  MOD_RES (329)..(335): Any amino acid
  MOD_RES (383)..(393): Any amino acid
  MOD_RES (416)..(418): Any amino acid
MNPNQKIITIGSVSLALVXXNILLHIASIXXXXXXXXXXXXXXXXXXTTEVYNETVRLETITIPINNTVYXXXXXXXXXEFLNNTEPLCNVSGFAIVSKDNGIRIGSRGHVFVIREPFVACGPTECRTFFLTQGALLNDKHSNNTVKDRSPYRALMSVPLGSSPNAYQAKFESVAWSATACHDGKEWLAVGISGADDDAYAVIHYGGMPTDVVRSWRKQILRTQESSCVCMKGXCYWVMTDGPANNQASYKIFKSHXXXXXXXXEVSFQGGHIEECSCYPNLGKVECVCRDNWNGMNRPILXXXXXXXYEVGYLCAGIPTDTPRVQDSXXXXXXXNAVGGSGTNNYGVKGFGFRQGNSVWAGRTVSISSRSGFEILLIEDGWXXXXXXXXXXXEVLNNKNWSGYSGAFTIPITMTXXXCLVPCFWLEMIRGKPEERTSIWTSSSSTVFCGVSSEVPGWSWDDGAILPFDIDKM

SEQ ID NO: 418345 - protein, 473 aa, Influenza virus
  MOD_RES (1)..(5): Any amino acid
  MOD_RES (19)..(20): Any amino acid
  MOD_RES (30)..(47): Any amino acid
  MOD_RES (71)..(79): Any amino acid
  MOD_RES (132)..(132): Any amino acid
  MOD_RES (148)..(152): Any amino acid
  MOD_RES (200)..(200): Any amino acid
  MOD_RES (234)..(237): Any amino acid
  MOD_RES (257)..(264): Any amino acid
  MOD_RES (274)..(274): Any amino acid
  MOD_RES (290)..(292): Any amino acid
  MOD_RES (302)..(308): Any amino acid
  MOD_RES (329)..(335): Any amino acid
  MOD_RES (346)..(349): Any amino acid
  MOD_RES (383)..(393): Any amino acid
  MOD_RES (416)..(418): Any amino acid
  MOD_RES (445)..(445): Any amino acid
  MOD_RES (472)..(473): Any amino acid
XXXXXKIITIGSISLGLVXXNILLHVASIXXXXXXXXXXXXXXXXXXTTEIYNETVRLETVTIPINNTIYXXXXXXXXXDFLNNTEPLCEVSGFAIISKDNGIRVGSRGHVFVIREPFVSCGPSECRTFFLXQGALLNDRHSNNTVKXXXXXRALMSVPMGSSPNAYQARFESVGWSATACHDGKKWLAVGVSGADDDAXAVIHYGGVPTDVVRSWKKQILRTQESSCVCVKGXXXXVMTDGPASNQASYKIFKSQXXXXXXXXEISFQGGHIXECSCYPNMGKVECVCXXXWNGMNRPVLXXXXXXXYNVGYLCAGIPTDTPRIQDSXXXXXXXNAIGGSGTNNXXXXGFGFRQGTSVWAGRTISTSSRSGFEVLLIEDGWXXXXXXXXXXXEILNNKNWSGYSGSFTIPTAMTXXXCIVPCFWLEMIRGRPEERNSIWTSSSXTVFCGVSGEVPGWSWGDGAILPFGIDXX

SEQ ID NO: 418346 - protein, 473 aa, Influenza virus
  MOD_RES (1)..(5): Any amino acid
  MOD_RES (19)..(20): Any amino acid
  MOD_RES (30)..(47): Any amino acid
  MOD_RES (71)..(79): Any amino acid
  MOD_RES (130)..(133): Any amino acid
  MOD_RES (143)..(154): Any amino acid
  MOD_RES (234)..(238): Any amino acid
  MOD_RES (257)..(264): Any amino acid
  MOD_RES (290)..(308): Any amino acid
  MOD_RES (318)..(320): Any amino acid
  MOD_RES (329)..(335): Any amino acid
  MOD_RES (383)..(393): Any amino acid
  MOD_RES (416)..(426): Any amino acid
  MOD_RES (442)..(449): Any amino acid
  MOD_RES (473)..(473): Any amino acid
XXXXXKIITIGSASLGLVXXNILLHIVSIXXXXXXXXXXXXXXXXXXITEIYNETVRVETVIIPVNNTIYXXXXXXXXXEFFNNTEPLCDVSGFAIFSKDNGIRIGSRGHIFVIREPFVACSPSECRTFXXXXCVLLNDKHSXXXXXXXXXXXXLMSVLLGSSPNAYQAQFESVEWSATACHDGKGWLALGISGADNDAYAVIHYGGIPTDVVRSWRRQILRTQESSCVCIKGXXXXXMTDGPANSQASYKIFKSYXXXXXXXXEVLFQGGHIEECSCYPNSGKVECVCXXXXXXXXXXXXXXXXXXXYKVGYLCAGXXXDTPRVQDNXXXXXXXDAVGGSGTDNYGVKGFAFKQGNSVWAGRTMSVSSRSGFEVLFIEDGWXXXXXXXXXXXEVLNNMNWSGYSGAFTVPITMTXXXXXXXXXXXEMIRGKPKERTSIWTXXXXXXXXGVSSEAPGWSWDDGAILPLTSIRX

SEQ ID NO: 418347 - protein, 473 aa, Influenza virus
  MOD_RES (1)..(5): Any amino acid
  MOD_RES (18)..(47): Any amino acid
  MOD_RES (70)..(79): Any amino acid
  MOD_RES (103)..(116): Any amino acid
  MOD_RES (128)..(156): Any amino acid
  MOD_RES (175)..(180): Any amino acid
  MOD_RES (200)..(205): Any amino acid
  MOD_RES (221)..(224): Any amino acid
  MOD_RES (234)..(238): Any amino acid
  MOD_RES (257)..(264): Any amino acid
  MOD_RES (276)..(276): Any amino acid
  MOD_RES (292)..(308): Any amino acid
  MOD_RES (318)..(320): Any amino acid
  MOD_RES (329)..(335): Any amino acid
  MOD_RES (346)..(353): Any amino acid
  MOD_RES (362)..(365): Any amino acid
  MOD_RES (383)..(393): Any amino acid
  MOD_RES (416)..(428): Any amino acid
  MOD_RES (444)..(450): Any amino acid
  MOD_RES (462)..(473): Any amino acid
XXXXXKIITIGSMSLALXXXXXXXXXXXXXXXXXXXXXXXXXXXXXXTTEVYSETVRVETVTIPVNNTIXXXXXXXXXXKFLNNTEPLCEVSGFVIVSKDNGXXXXXXXXXXXXXXPFVACGPSECRXXXXXXXXXXXXXXXXXXXXXXXXXXXXXSVPLGSSSNAYQAKFESIXXXXXXCHDGKEWMAIGVSGADNDAXXXXXXGGVPTDVIRSWRKQIXXXXESSCVCMNGXXXXXMTDGPANKQASYKIFKSRXXXXXXXXEVSFRGGHIEEXSCYPNLGQVECVCRDXXXXXXXXXXXXXXXXXYDVGYLCAGXXXDTPRVQDDXXXXXXXNAVGRSGTNNXXXXXXXXRQGNNVWAXXXXSISSRNGFEILLIEEGWXXXXXXXXXXXEVLNNKHWSGYSGAFTIPTTMTXXXXXXXXXXXXXIRGKPEEGTSIWTSSXXXXXXXVSSEVPGCTMGXXXXXXXXXXXX

SEQ ID NO: 418348 - protein, 473 aa, Influenza virus
  MOD_RES (1)..(7): Any amino acid
  MOD_RES (19)..(47): Any amino acid
  MOD_RES (70)..(88): Any amino acid
  MOD_RES (103)..(116): Any amino acid
  MOD_RES (132)..(180): Any amino acid
  MOD_RES (189)..(190): Any amino acid
  MOD_RES (203)..(205): Any amino acid
  MOD_RES (227)..(243): Any amino acid
  MOD_RES (257)..(265): Any amino acid
  MOD_RES (289)..(320): Any amino acid
  MOD_RES (329)..(335): Any amino acid
  MOD_RES (344)..(365): Any amino acid
  MOD_RES (382)..(393): Any amino acid
  MOD_RES (416)..(432): Any amino acid
  MOD_RES (444)..(451): Any amino acid
  MOD_RES (465)..(473): Any amino acid
XXXXXXXMTIGSVSLTLVXXXXXXXXXXXXXXXXXXXXXXXXXXXXXTTEMYNETVRVKTVVIPVNNTIXXXXXXXXXXXXXXXXXXXCEVSGFAVVSKDNGXXXXXXXXXXXXXXPFVACGPAECRTFFLXXXXXXXXXXXXXXXXXXXXXXXXXXXXXXXXXXXXXXXXXXXXXXXXXCHDGKKWMXXGVSGTDDDAYAVXXXGGVPTDVMRSWRKKILRTQESXXXXXXXXXXXXXXXXXANNQASYRIFKSHXXXXXXXXXISFQSGHIEECSCYPNLCQVECVXXXXXXXXXXXXXXXXXXXXXXXXXXXXXXXXDTPRFQDSXXXXXXXSAVGGSGTXXXXXXXXXXXXXXXXXXXXXXNISSRSGFEVLLIENGXXXXXXXXXXXXEVLNNRNWSGYSGAFTIPVTMTXXXXXXXXXXXXXXXXXPEEKTSIWTSSXXXXXXXXSSEVPEWSWDDGAXXXXXXXXX

SEQ ID NO: 418349 - protein, 473 aa, Influenza virus
  MOD_RES (1)..(8): Any amino acid
  MOD_RES (19)..(48): Any amino acid
  MOD_RES (62)..(88): Any amino acid
  MOD_RES (104)..(186): Any amino acid
  MOD_RES (195)..(206): Any amino acid
  MOD_RES (215)..(281): Any amino acid
  MOD_RES (291)..(336): Any amino acid
  MOD_RES (345)..(366): Any amino acid
  MOD_RES (375)..(394): Any amino acid
  MOD_RES (405)..(434): Any amino acid
  MOD_RES (443)..(473): Any amino acid
XXXXXXXXTLGSVSLALAXXXXXXXXXXXXXXXXXXXXXXXXXXXXXXTKVYNETVRVEIAXXXXXXXXXXXXXXXXXXXXXXXXXXXCEISGFAIASKDNGIXXXXXXXXXXXXXXXXXXXXXXXXXXXXXXXXXXXXXXXXXXXXXXXXXXXXXXXXXXXXXXXXXXXXXXXXXXXXXXXXXXXWLAIGISGXXXXXXXXXXXXGIPTDVIRXXXXXXXXXXXXXXXXXXXXXXXXXXXXXXXXXXXXXXXXXXXXXXXXXXXXXXXXXXXXXXXXXXXLGIVECVCRXXXXXXXXXXXXXXXXXXXXXXXXXXXXXXXXXXXXXXXXXXXXXXAIGGSGTDXXXXXXXXXXXXXXXXXXXXXXTASRSGFEXXXXXXXXXXXXXXXXXXXXVLDNKNWSGYXXXXXXXXXXXXXXXXXXXXXXXXXXXXXXERPSIWTSXXXXXXXXXXXXXXXXXXXXXXXXXXXXXXX

SEQ ID NO: 418350 - protein, 473 aa, Influenza virus
  MOD_RES (1)..(211): Any amino acid
  MOD_RES (221)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVRSWRKKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418351 - protein, 471 aa, Influenza virus
  MOD_RES (37)..(55): Any amino acid
  MOD_RES (64)..(87): Any amino acid
  MOD_RES (128)..(128): Any amino acid
  MOD_RES (173)..(174): Any amino acid
  MOD_RES (210)..(214): Any amino acid
  MOD_RES (253)..(271): Any amino acid
  MOD_RES (286)..(288): Any amino acid
  MOD_RES (309)..(311): Any amino acid
  MOD_RES (334)..(343): Any amino acid
  MOD_RES (387)..(397): Any amino acid
  MOD_RES (416)..(417): Any amino acid
MNPNQKIICISATGMTLSVVSLLIGLANLGLNIGLHXXXXXXXXXXXXXXXXXXXTTTTIINNXXXXXXXXXXXXXXXXXXXXXXXXLSKPLCEVNSWHILSKDNAIRIGEDAHILVTREPYLSCGPXECRMFALSQGTTLRGRHANGTIHDRSPFRALISWEMGQAPSPYNXXVECVGWSSTSCHDGISRMSICMSGPNNNASAVVWYXXXXXTEIASWAGNILRTQESECVCHNGICPVVMTDGPANNRAXXXXXXXXXXXXXXXXXXXGSAQHIEECSCYGAXXXIKCICRDNWKGANRPVITINXXXMTHTSKYLCSKILTDTSRPNDPXXXXXXXXXXGGSPDPGVKGFAFLDGGNSWLGRTISKDSRSGYEMLKVPNAETXXXXXXXXXXXIVNNQNWSGYSGAFIDYWXXRECFNPCFYVELIRGRPKESSVLWTSNSIVALCGSKERLGSWSWHDGAEIIYFK

SEQ ID NO: 418352 - protein, 471 aa, Influenza virus
  MOD_RES (37)..(87): Any amino acid
  MOD_RES (104)..(104): Any amino acid
  MOD_RES (128)..(128): Any amino acid
  MOD_RES (173)..(174): Any amino acid
  MOD_RES (210)..(214): Any amino acid
  MOD_RES (226)..(228): Any amino acid
  MOD_RES (253)..(271): Any amino acid
  MOD_RES (286)..(288): Any amino acid
  MOD_RES (309)..(311): Any amino acid
  MOD_RES (334)..(343): Any amino acid
  MOD_RES (387)..(397): Any amino acid
  MOD_RES (416)..(417): Any amino acid
MNPNQKITCISATGVTLSVVSLLVGIANLGLNIGIHXXXXXXXXXXXXXXXXXXXXXXXXXXXXXXXXXXXXXXXXXXXXXXXXXXXLTKPLCEVSSWHILSKXNAIRIGENAHILVTREPYLSCDPXGCRMFALSQGTTLKGRHANGTMHDRSPFRALVSWEMGQAPSPYTXXVECIGWSSTSCHDGMSRMSICISGPNNNASAVIWYXXXXXTEIPSWAGNILXXXESECVCHKGICPVVMTDGPASNKAXXXXXXXXXXXXXXXXXXXGNAQHIEECSCYGSXXXVKCICRDNWRGANRPVIIIDXXXMTHMSKYLCSKVLTDTSRPSDPXXXXXXXXXXGGGPDPGVKGFAFLNGENSWLGRTTSKDSRSGYEVLKVPNAEIXXXXXXXXXXXIVNNQDWSGYSGAFMDYWXXKECFNPCFYVELIRGMPKESSVFWTSNSIVALCGSRERLGSWSWHDGAEITYFK

SEQ ID NO: 418353 - protein, 471 aa, Influenza virus
  MOD_RES (24)..(24): Any amino acid
  MOD_RES (34)..(87): Any amino acid
  MOD_RES (102)..(104): Any amino acid
  MOD_RES (120)..(128): Any amino acid
  MOD_RES (171)..(174): Any amino acid
  MOD_RES (202)..(214): Any amino acid
  MOD_RES (229)..(230): Any amino acid
  MOD_RES (251)..(271): Any amino acid
  MOD_RES (280)..(288): Any amino acid
  MOD_RES (309)..(311): Any amino acid
  MOD_RES (334)..(343): Any amino acid
  MOD_RES (387)..(397): Any amino acid
  MOD_RES (416)..(427): Any amino acid
  MOD_RES (463)..(463): Any amino acid
MNPNQKIMCISATGMALSVVSLLXGVANLGLNIXXXXXXXXXXXXXXXXXXXXXXXXXXXXXXXXXXXXXXXXXXXXXXXXXXXXXXLTKPLCAVNSWHILXXXNAIRIGEEAHILVTRXXXXXXXXXSCRMFALSQGTTLRGQHANGTIHDRSQFRALISWGMGQAPSPXXXXIECIGWSSTSCHDGVSRMSVCMSGPNNXXXXXXXXXXXXXTEIPSWEGNILRTQXXECVCHKGVCPVVMTDGPADNXXXXXXXXXXXXXXXXXXXXXGTAQHIEEXXXXXXXXXIKCVCRDNWKGANRPIITINXXXMTHTSRYLCSRILTDTSRPTDPXXXXXXXXXXGGNPDPGVKGFAFLDEKNSWLGRTISKDLRSGYEMLKVPDAETXXXXXXXXXXXIINNQNWSGYSGSFIDYWXXXXXXXXXXXXELIRGRPRESNVLWTSNSMVALCGSKEQLGSWSWHXGAEIIYFE

SEQ ID NO: 418354 - protein, 471 aa, Influenza virus
  MOD_RES (1)..(4): Any amino acid
  MOD_RES (35)..(87): Any amino acid
  MOD_RES (120)..(143): Any amino acid
  MOD_RES (159)..(159): Any amino acid
  MOD_RES (173)..(174): Any amino acid
  MOD_RES (209)..(214): Any amino acid
  MOD_RES (225)..(230): Any amino acid
  MOD_RES (253)..(271): Any amino acid
  MOD_RES (281)..(300): Any amino acid
  MOD_RES (309)..(311): Any amino acid
  MOD_RES (330)..(343): Any amino acid
  MOD_RES (387)..(397): Any amino acid
  MOD_RES (416)..(429): Any amino acid
  MOD_RES (447)..(449): Any amino acid
  MOD_RES (462)..(471): Any amino acid
XXXXQKIICISTTGMTLSVVNLLIGLVNLGLNIGXXXXXXXXXXXXXXXXXXXXXXXXXXXXXXXXXXXXXXXXXXXXXXXXXXXXXLTKSLCEVNSWHIFSKDNAIRIGEGAHILVTRXXXXXXXXXXXXXXXXXXXXXXXXRHANGTINDRSPFRAXISWEMGLAPSPYNXXIECVGWSSTSCHDGRSRMSICMSGPNDNASAVVWXXXXXXIEIPSWAGNVXXXXXXECVCHNGVCPVVMTDGPANDRAXXXXXXXXXXXXXXXXXXXGKAQHIEECXXXXXXXXXXXXXXXXXXXXNRPVITIDXXXMTHSSKYLCSRVLTDTSRXXXXXXXXXXXXXXGGTPDPGVKGFAFLDRANSWLGRTISKDTRSGYEMLKVPNAEAXXXXXXXXXXXIVNNPNWSGYSGAFVDYWXXXXXXXXXXXXXXIRGRPKENSVLWTSNSVXXXCGSKKRLGSWSWXXXXXXXXXX

SEQ ID NO: 418355 - protein, 471 aa, Influenza virus
  MOD_RES (1)..(6): Any amino acid
  MOD_RES (24)..(25): Any amino acid
  MOD_RES (37)..(87): Any amino acid
  MOD_RES (96)..(105): Any amino acid
  MOD_RES (123)..(148): Any amino acid
  MOD_RES (164)..(181): Any amino acid
  MOD_RES (194)..(217): Any amino acid
  MOD_RES (226)..(234): Any amino acid
  MOD_RES (253)..(272): Any amino acid
  MOD_RES (281)..(300): Any amino acid
  MOD_RES (309)..(311): Any amino acid
  MOD_RES (331)..(350): Any amino acid
  MOD_RES (359)..(359): Any amino acid
  MOD_RES (368)..(370): Any amino acid
  MOD_RES (386)..(398): Any amino acid
  MOD_RES (408)..(429): Any amino acid
  MOD_RES (448)..(471): Any amino acid
XXXXXXIICISAAGMILSVVSLLXXLANLGLNVGLHXXXXXXXXXXXXXXXXXXXXXXXXXXXXXXXXXXXXXXXXXXXXXXXXXXXLVKPLCEVXXXXXXXXXXAVRIGEDAHVLVTREPYXXXXXXXXXXXXXXXXXXXXXXXXXXTIHDRSPYRALISWEXXXXXXXXXXXXXXXXXXSTSCHDGKSRMSXXXXXXXXXXXXXXXXXXXXXXXXPTWAGNILXXXXXXXXXHDGICPVVMTDGPANSRAXXXXXXXXXXXXXXXXXXXXSAEHIEECXXXXXXXXXXXXXXXXXXXXNRPVIIINXXXMTHISKYLCSKTLTDTSRPXXXXXXXXXXXXXXXXXXXXIKGFAFLDXDNSWLGRTXXXDSRSGYEILKVPNAEXXXXXXXXXXXXXVNNQKWSGYXXXXXXXXXXXXXXXXXXXXXXIRGRPEESSVWWTSNSIVXXXXXXXXXXXXXXXXXXXXXXXX

SEQ ID NO: 418356 - protein, 471 aa, Influenza virus
  MOD_RES (1)..(8): Any amino acid
  MOD_RES (21)..(25): Any amino acid
  MOD_RES (34)..(241): Any amino acid
  MOD_RES (253)..(375): Any amino acid
  MOD_RES (386)..(436): Any amino acid
  MOD_RES (446)..(471): Any amino acid
XXXXXXXXCISATGMILSVVXXXXXITNLGLNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIMTDGPANNKAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYEVLKVPDAEXXXXXXXXXXXXXXXXXXXXXXXXXXXXXXXXXXXXXXXXXXXXXXXXXXXSGVLWTSNSXXXXXXXXXXXXXXXXXXXXXXXXXX

SEQ ID NO: 418357 - protein, 471 aa, Influenza virus
  MOD_RES (16)..(19): Any amino acid
  MOD_RES (39)..(61): Any amino acid
  MOD_RES (73)..(82): Any amino acid
  MOD_RES (167)..(168): Any amino acid
  MOD_RES (254)..(267): Any amino acid
  MOD_RES (285)..(285): Any amino acid
  MOD_RES (308)..(311): Any amino acid
  MOD_RES (332)..(333): Any amino acid
  MOD_RES (387)..(391): Any amino acid
  MOD_RES (400)..(400): Any amino acid
  MOD_RES (416)..(416): Any amino acid
MNPNQKLFALSGVAIXXXXLNLLIGISNVGLNVSLHLKXXXXXXXXXXXXXXXXXXXXXXXENTYVNNTTVIXXXXXXXXXXYLMLNKSLCKVEGWVVVAKDNAIRFGESEQIIVTREPYVSCDPLGCKMYALHQGTTIRNKHSNGTIHDRTAFRGLISTPLGSPPXXSNSDFLCVGWSSTSCHDGIGRMTICVQGNNDNATATVYYDRRLTTTIKTWAGNILRTQESECVCHNGTCVVIMTDGSASSQAYTKXXXXXXXXXXXXXXLKGSARHIEECSCYGHNXKVTCVCRDNWQGANRPVIEIDMXXXXHTSQYLCTGVLTDTSRPSDKXXGDCNNPITGSPGAPGVKGFGFLDSGNTWLGRTISPRSRSGFEMLKIPNAGTDPXXXXXERQEIVDNXNWSGYSGSFIDYWDEXSECYNPCFYVELIRGRPEEAKYVWWTSNSLVALCGSPISVGSGSFPDGAQIQYFS

SEQ ID NO: 418358 - protein, 471 aa, Influenza virus
  MOD_RES (13)..(19): Any amino acid
  MOD_RES (37)..(61): Any amino acid
  MOD_RES (73)..(82): Any amino acid
  MOD_RES (167)..(168): Any amino acid
  MOD_RES (254)..(267): Any amino acid
  MOD_RES (285)..(285): Any amino acid
  MOD_RES (294)..(294): Any amino acid
  MOD_RES (308)..(311): Any amino acid
  MOD_RES (332)..(333): Any amino acid
  MOD_RES (384)..(391): Any amino acid
  MOD_RES (400)..(400): Any amino acid
  MOD_RES (416)..(416): Any amino acid
  MOD_RES (425)..(430): Any amino acid
  MOD_RES (470)..(471): Any amino acid
MNPSQKLFALSEXXXXXXXLNLIIGISNVGLNMSLHXXXXXXXXXXXXXXXXXXXXXXXXXKNTYVNNTTIIXXXXXXXXXXYLLLNKSLCNVEGWVVIAKDNAVRFGESEQVIVTREPYVSCDPTGCRMYALHQGTTIRNRHSNGTIHDRNAFRGLISTHLGTPPXXSNSDFMCVGWSSTTCHDGIARMTICIQGNNNNATATVYYNRRLTTTIRTWARNILRTQESECVRHNGTCAVVMTDGSASGQAYTKXXXXXXXXXXXXXXLKGSAKHIEECSCYGHSXRVTCVCRDXWQGANRPIIEIDMXXXXHTSRYVCTGILTDTSRPGDKXXGDCSNPITGSPSAPGIKGFGFLNGDNTWLGRTFSPRSRNGFEMLKIHNAGXXXXXXXXGRQEIVDNXNRSGYSGSFIDYWNDXNECYNPCFXXXXXXGRPEEVKYVWWTSNSLIALCGSPFPVGSGSFPNGAQIQYXX

SEQ ID NO: 418359 - protein, 471 aa, Influenza virus
  MOD_RES (16)..(19): Any amino acid
  MOD_RES (39)..(61): Any amino acid
  MOD_RES (72)..(82): Any amino acid
  MOD_RES (106)..(106): Any amino acid
  MOD_RES (118)..(118): Any amino acid
  MOD_RES (135)..(138): Any amino acid
  MOD_RES (167)..(168): Any amino acid
  MOD_RES (225)..(227): Any amino acid
  MOD_RES (254)..(267): Any amino acid
  MOD_RES (282)..(285): Any amino acid
  MOD_RES (295)..(296): Any amino acid
  MOD_RES (308)..(311): Any amino acid
  MOD_RES (321)..(321): Any amino acid
  MOD_RES (332)..(333): Any amino acid
  MOD_RES (387)..(391): Any amino acid
  MOD_RES (400)..(400): Any amino acid
  MOD_RES (416)..(416): Any amino acid
  MOD_RES (426)..(432): Any amino acid
MNPKSKLFASSGIAIXXXXINLLIGISNMSLNISLYSKXXXXXXXXXXXXXXXXXXXXXXXENKYVNNTTIXXXXXXXXXXXYLVLNKSLCKIEGWVAVAKDNAIXFGEGEQIIVTRXPYVSCDPSSCKMYALHXXXXIRNKHSNSTTHDRTAFRGLMSTPLGTPPXXSNSDFICVGWSSTSCHDGVGRMTICIQGDNENATATVYYNKRLTTTIKPWARNILRXXXSECVCHNSTCVVVMTDGPANNQAFTKXXXXXXXXXXXXXXLRGSARHIEEWSCYXXXXKATCVCRDNXXGANRPVIKIDMXXXXHTSRYICTGXLTDTSRPKDKXXGECFNPITGSPGVPGVKGFGFLNESNTWLGRTISPKLRSGFEMLRIPNAETDPXXXXXERQEIVSNXNLSGYSGSFIDYWDDXSVCYNPCFYXXXXXXXPEEAKYVEWTSNSLIALCGSPIPVGPGSFPDGARIQYFS

SEQ ID NO: 418360 - protein, 471 aa, Influenza virus
  MOD_RES (1)..(1): Any amino acid
  MOD_RES (16)..(19): Any amino acid
  MOD_RES (39)..(61): Any amino acid
  MOD_RES (70)..(82): Any amino acid
  MOD_RES (107)..(118): Any amino acid
  MOD_RES (135)..(140): Any amino acid
  MOD_RES (167)..(168): Any amino acid
  MOD_RES (199)..(201): Any amino acid
  MOD_RES (224)..(227): Any amino acid
  MOD_RES (254)..(267): Any amino acid
  MOD_RES (283)..(285): Any amino acid
  MOD_RES (295)..(298): Any amino acid
  MOD_RES (308)..(311): Any amino acid
  MOD_RES (321)..(323): Any amino acid
  MOD_RES (332)..(338): Any amino acid
  MOD_RES (347)..(349): Any amino acid
  MOD_RES (387)..(391): Any amino acid
  MOD_RES (400)..(416): Any amino acid
  MOD_RES (425)..(434): Any amino acid
  MOD_RES (455)..(455): Any amino acid
  MOD_RES (469)..(471): Any amino acid
XNPNQKLFTLSGVAIXXXXMNLLIGISNVVLNVSLHLRXXXXXXXXXXXXXXXXXXXXXXXENTYVNKTXXXXXXXXXXXXXYLMLSKSLCKVEEWVVIAKDNAIRXXXXXXXXXXXXPYVSCDPIGCKMFALHXXXXXXNKHSNGTTHDRTTFRGLISTQLGTPPXXSNSEFICVGWSSTTCHDGVSRMTICVQGDNXXXTATVYYNGRLTTTIKTWARNILXXXXSECVCHDGTCVVVMTDGPASSQAHTKXXXXXXXXXXXXXXLQGSARHIEECPCYGXXXKITCVCRDNXXXXNRPVIEINMXXXXHTSRYMCTGXXXDTSRPGDRXXXXXXXPITGSPEAXXXKGFGFLDGNNTWLGRTISPHSRSGFEMLKVPNAGTDPXXXXXERQEIVGNXXXXXXXXXXXXXXXXXSKCYNPCFXXXXXXXXXXEAKYVWWASNSLIALCGSPVXVGSGSLPDGAQIQXXX

SEQ ID NO: 418361 - protein, 471 aa, Influenza virus
  MOD_RES (1)..(2): Any amino acid
  MOD_RES (13)..(19): Any amino acid
  MOD_RES (39)..(62): Any amino acid
  MOD_RES (73)..(84): Any amino acid
  MOD_RES (107)..(144): Any amino acid
  MOD_RES (156)..(158): Any amino acid
  MOD_RES (167)..(168): Any amino acid
  MOD_RES (180)..(182): Any amino acid
  MOD_RES (205)..(207): Any amino acid
  MOD_RES (228)..(228): Any amino acid
  MOD_RES (238)..(238): Any amino acid
  MOD_RES (254)..(270): Any amino acid
  MOD_RES (285)..(285): Any amino acid
  MOD_RES (296)..(323): Any amino acid
  MOD_RES (332)..(339): Any amino acid
  MOD_RES (349)..(349): Any amino acid
  MOD_RES (358)..(360): Any amino acid
  MOD_RES (387)..(416): Any amino acid
  MOD_RES (426)..(446): Any amino acid
  MOD_RES (455)..(458): Any amino acid
  MOD_RES (468)..(471): Any amino acid
XXPNQKLFASSGXXXXXXXLNLLIGVSNVGLNISLHLKXXXXXXXXXXXXXXXXXXXXXXXXNTYINNTTIIXXXXXXXXXXXXLLNKSLCSVEGWVVIEKDNAVRXXXXXXXXXXXXXXXXXXXXXXXXXXXXXXXXXXXXXXNGTINDRTAFRXXXSTPLGNPPXXSNSEFLCVGWSXXXCHDGVNRMTICVQGNNENATATXXXERRLTTTIKTWAKNILRTQEXECVSHNGTWXAVMTDGSANSQAYTKXXXXXXXXXXXXXXXXXSARHVEECSCYGHDXKVSCVCRDNWXXXXXXXXXXXXXXXXXXXXXXXXXXXXDTSRPSDRXXXXXXXXITGSPCAPGXKGFGFLDNXXXWLGGTISPRSRNGFEVLKVPNAEKDPXXXXXXXXXXXXXXXXXXXXXXXXXXXXXXSACYNPCFYXXXXXXXXXXXXXXXXXXXXXVALCGSPVXXXXGFFPDGPQIXXXX

SEQ ID NO: 418362 - protein, 471 aa, Influenza virus
  MOD_RES (1)..(7): Any amino acid
  MOD_RES (16)..(26): Any amino acid
  MOD_RES (36)..(62): Any amino acid
  MOD_RES (73)..(146): Any amino acid
  MOD_RES (156)..(194): Any amino acid
  MOD_RES (205)..(209): Any amino acid
  MOD_RES (229)..(230): Any amino acid
  MOD_RES (239)..(239): Any amino acid
  MOD_RES (248)..(271): Any amino acid
  MOD_RES (281)..(288): Any amino acid
  MOD_RES (297)..(362): Any amino acid
  MOD_RES (386)..(459): Any amino acid
  MOD_RES (471)..(471): Any amino acid
XXXXXXXFALSGVAVXXXXXXXXXXXSNIGLNVSLXXXXXXXXXXXXXXXXXXXXXXXXXXXNTYINNATIIXXXXXXXXXXXXXXXXXXXXXXXXXXXXXXXXXXXXXXXXXXXXXXXXXXXXXXXXXXXXXXXXXXXXXXXXXXTIHDRTTFRXXXXXXXXXXXXXXXXXXXXXXXXXXXXXXXXXXXXXXXQGNNKNATATXXXXXRLTTTVKTWAGKILRTQESXXVCHNGTCAXIMTDGSANXXXXXXXXXXXXXXXXXXXXXXXXAMHIEECSCXXXXXXXXCGCRDNWQXXXXXXXXXXXXXXXXXXXXXXXXXXXXXXXXXXXXXXXXXXXXXXXXXXXXXXXXXXXXXXXXXXGRTISPRLRSGFEMLKIPNAETDXXXXXXXXXXXXXXXXXXXXXXXXXXXXXXXXXXXXXXXXXXXXXXXXXXXXXXXXXXXXXXXXXXXXXXXXXXSFPDGAKIQYFX

SEQ ID NO: 418363 - protein, 471 aa, Influenza virus
  MOD_RES (1)..(28): Any amino acid
  MOD_RES (38)..(146): Any amino acid
  MOD_RES (159)..(210): Any amino acid
  MOD_RES (223)..(230): Any amino acid
  MOD_RES (239)..(241): Any amino acid
  MOD_RES (250)..(289): Any amino acid
  MOD_RES (298)..(365): Any amino acid
  MOD_RES (374)..(375): Any amino acid
  MOD_RES (384)..(460): Any amino acid
XXXXXXXXXXXXXXXXXXXXXXXXXXXXVGLKVSLHLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTIHDGTAFRGLIXXXXXXXXXXXXXXXXXXXXXXXXXXXXXXXXXXXXXXXXXXXXXXXXXXXXPTTTIKTWAGKIXXXXXXXXVCHNGTCGXXXTDGPANSQXXXXXXXXXXXXXXXXXXXXXXXXXXXXXXXXXXXXXXXXICRDNWQGXXXXXXXXXXXXXXXXXXXXXXXXXXXXXXXXXXXXXXXXXXXXXXXXXXXXXXXXXXXXXXXXXXXXISTRSRSGXXMLKVPNAEXXXXXXXXXXXXXXXXXXXXXXXXXXXXXXXXXXXXXXXXXXXXXXXXXXXXXXXXXXXXXXXXXXXXXXXXXXXXXFPDGAQIKYFS

SEQ ID NO: 418364 - protein, 471 aa, Influenza virus
  MOD_RES (1)..(147): Any amino acid
  MOD_RES (158)..(234): Any amino acid
  MOD_RES (245)..(376): Any amino acid
  MOD_RES (387)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIHDRAAFRGLXXXXXXXXXXXXXXXXXXXXXXXXXXXXXXXXXXXXXXXXXXXXXXXXXXXXXXXXXXXXXXXXXXXXXXXXXXXXXGTCVAVMTDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKIPNAGIDPXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418365 - protein, 548 aa, Influenza virus
  MOD_RES (1)..(50): Any amino acid
  MOD_RES (61)..(168): Any amino acid
  MOD_RES (201)..(201): Any amino acid
  MOD_RES (274)..(291): Any amino acid
  MOD_RES (326)..(344): Any amino acid
  MOD_RES (408)..(417): Any amino acid
  MOD_RES (450)..(470): Any amino acid
  MOD_RES (489)..(491): Any amino acid
  MOD_RES (510)..(510): Any amino acid
  MOD_RES (527)..(528): Any amino acid
XXXXXXXXXXXXXXXXXXXXXXXXXXXXXXXXXXXXXXXXXXXXXXXXXXREYNETVRVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGFAPFSKDNGIRIGSRGHVFVIREPFVSCSPXECRTFFLTQGSLLNDKHSNGTVKDRSPYRTLMSVEIGQSPNVYQARFEAVAWSATACHDGKKWMTIGVTGPDXXXXXXXXXXXXXXXXXXSWAGDILRTQESSCTCIQGECYWVMTDGPANRQAXXXXXXXXXXXXXXXXXXXFNGGHIEECSCYPNEGKVECVCRDNWTGTNRPVLVISPDLSYRVGYLCAGLPSDTPRGEDSQFXXXXXXXXXXQGYGVKGFGFRQGNDVWMGRTISRTSRSGFEIXXXXXXXXXXXXXXXXXXXXXDNLNWSGYSGSFTLPVELXXXNCLVPCFWVEMIRGKPEEXTIWTSSSSIVMCGVDHXXADWSWHDGAILPFDIDKIIT

SEQ ID NO: 418366 - protein, 548 aa, Influenza virus
  MOD_RES (1)..(50): Any amino acid
  MOD_RES (61)..(168): Any amino acid
  MOD_RES (177)..(177): Any amino acid
  MOD_RES (193)..(201): Any amino acid
  MOD_RES (274)..(291): Any amino acid
  MOD_RES (326)..(344): Any amino acid
  MOD_RES (367)..(369): Any amino acid
  MOD_RES (408)..(417): Any amino acid
  MOD_RES (450)..(470): Any amino acid
  MOD_RES (489)..(491): Any amino acid
  MOD_RES (510)..(510): Any amino acid
  MOD_RES (527)..(528): Any amino acid
  MOD_RES (545)..(548): Any amino acid
XXXXXXXXXXXXXXXXXXXXXXXXXXXXXXXXXXXXXXXXXXXXXXXXXXKEYNETVRIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQGFAPFSKXNGIRIGSKGHVFVIRXXXXXXXXXGCRTFFLTHGSLLNDKHFNGTIKDRSPYRTLMSVKIGQSANVYQAKFESVAWSATACHDGRKWMTVGVTGPDXXXXXXXXXXXXXXXXXXSWAGNILRTQESSCTCIKGDCYWVMTDGPANKQAXXXXXXXXXXXXXXXXXXXFSGGHIEECSCYPNDGKVECVCXXXWTGTNRPILVISSDLSYTVGYLCAGIPTDTPRGEDAQFXXXXXXXXXXKGYGVKGFGFRQGTDVWAGRTISQTSRSGFEVXXXXXXXXXXXXXXXXXXXXXDDPNWSGYSGSFTLPIELXXXDCLVPCFWVEMIRGEPEEXTVWTSSSSVVMCGVDHXXASWSWHDGAVLPFDIDXXXX

SEQ ID NO: 418367 - protein, 548 aa, Influenza virus
  MOD_RES (1)..(50): Any amino acid
  MOD_RES (61)..(168): Any amino acid
  MOD_RES (177)..(180): Any amino acid
  MOD_RES (196)..(201): Any amino acid
  MOD_RES (254)..(258): Any amino acid
  MOD_RES (274)..(291): Any amino acid
  MOD_RES (326)..(344): Any amino acid
  MOD_RES (354)..(354): Any amino acid
  MOD_RES (408)..(417): Any amino acid
  MOD_RES (449)..(470): Any amino acid
  MOD_RES (489)..(491): Any amino acid
  MOD_RES (510)..(510): Any amino acid
  MOD_RES (520)..(528): Any amino acid
  MOD_RES (545)..(548): Any amino acid
XXXXXXXXXXXXXXXXXXXXXXXXXXXXXXXXXXXXXXXXXXXXXXXXXXREYNETIRIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGFAPFSKXXXXRIGSRGHIFVIREPFXXXXXXDCRTFFLTQGSLLNDRHSNGTVKDRSPFRTLMSVEVGQSPNVYQSRFEAVAWXXXXXHDGKKWMAVGVTGPDXXXXXXXXXXXXXXXXXXSWEGDILRTQESSCTCIRGECFWVMTDGPANSQAXXXXXXXXXXXXXXXXXXXFDGGHIEECXCYPNNGKVECICRDNWTGTNRPVLIISPDLSYKVGYLCAGIPSDTPRGEDNQFXXXXXXXXXXLGYGVKGFGFRQGDDVWIGRTISKTSRSGFEXXXXXXXXXXXXXXXXXXXXXXDNSNWSGYSGSFTLPVGLXXXGCLVPCFWVEMIRGRPEEXAIWTSSSSVXXXXXXXXXANWSWHDGAILPLTSIXXXX

SEQ ID NO: 418368 - protein, 548 aa, Influenza virus
  MOD_RES (1)..(50): Any amino acid
  MOD_RES (61)..(168): Any amino acid
  MOD_RES (177)..(188): Any amino acid
  MOD_RES (198)..(207): Any amino acid
  MOD_RES (255)..(258): Any amino acid
  MOD_RES (274)..(291): Any amino acid
  MOD_RES (326)..(344): Any amino acid
  MOD_RES (355)..(357): Any amino acid
  MOD_RES (367)..(372): Any amino acid
  MOD_RES (395)..(397): Any amino acid
  MOD_RES (408)..(425): Any amino acid
  MOD_RES (449)..(470): Any amino acid
  MOD_RES (480)..(480): Any amino acid
  MOD_RES (489)..(491): Any amino acid
  MOD_RES (500)..(517): Any amino acid
  MOD_RES (527)..(528): Any amino acid
  MOD_RES (545)..(548): Any amino acid
XXXXXXXXXXXXXXXXXXXXXXXXXXXXXXXXXXXXXXXXXXXXXXXXXXREYNETVKVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGFAPFSKXXXXXXXXXXXXFIIREPFVSXXXXXXXXXXITQGSLLNDKHSSGTMKDRSPYRTLMSVGIGQSPNVYQAKFEAVAWSXXXXHDGKKWTTIGVTGSDXXXXXXXXXXXXXXXXXXSWAGDIMRTQESSCTCILGNCYWVMTDGPANNQAXXXXXXXXXXXXXXXXXXXFNEGHIEECSXXXNEGKVECICXXXXXXTNRPVLVVSPDLSYQVGYLCAGXXXDTPRGEDGQFXXXXXXXXXXXXXXXXXXGFRQGSDVWVGRTISLTSRSGFEXXXXXXXXXXXXXXXXXXXXXXDNPNWSGYSXSFTLPVEMXXXSCLVPCFWXXXXXXXXXXXXXXXXXXSIVMCGVNYXXADWSWQDGAILPFGIDXXXX

SEQ ID NO: 418369 - protein, 548 aa, Influenza virus
  MOD_RES (1)..(212): Any amino acid
  MOD_RES (227)..(229): Any amino acid
  MOD_RES (241)..(242): Any amino acid
  MOD_RES (255)..(262): Any amino acid
  MOD_RES (274)..(292): Any amino acid
  MOD_RES (301)..(344): Any amino acid
  MOD_RES (354)..(377): Any amino acid
  MOD_RES (395)..(431): Any amino acid
  MOD_RES (450)..(491): Any amino acid
  MOD_RES (500)..(518): Any amino acid
  MOD_RES (527)..(534): Any amino acid
  MOD_RES (543)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPNDKHSNGTIKDRXXXRTLMSVKVGQSXXVYQARFESVAWSXXXXXXXXKWMTIGITGPDXXXXXXXXXXXXXXXXXXXWAGDTLRTXXXXXXXXXXXXXXXXXXXXXXXXXXXXXXXXXXXXXXXXXXXXFTEGHIEECXXXXXXXXXXXXXXXXXXXXXXXXLVISTDLSYSVGYLCAGXXXXXXXXXXXXXXXXXXXXXXXXXXXXXXXXXXXXXDVWMGRTLSRTSRTGFEIXXXXXXXXXXXXXXXXXXXXXXXXXXXXXXXXXXXXXXXXXXECLVPCFWXXXXXXXXXXXXXXXXXXXIVMCGVDYXXXXXXXXDGAILPFAXXXXXX

SEQ ID NO: 418370 - protein, 548 aa, Influenza virus
  MOD_RES (1)..(215): Any amino acid
  MOD_RES (228)..(236): Any amino acid
  MOD_RES (247)..(263): Any amino acid
  MOD_RES (272)..(293): Any amino acid
  MOD_RES (302)..(518): Any amino acid
  MOD_RES (527)..(535): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDKHSNGTMKDRSXXXXXXXXXIGLSPNVYQAXXXXXXXXXXXXXXXXXWMIIGVTGXXXXXXXXXXXXXXXXXXXXXXAEDILRTQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVMCGVEHXXXXXXXXXGAILPFDFDKISQ

SEQ ID NO: 418371 - protein, 548 aa, Influenza virus
  MOD_RES (1)..(263): Any amino acid
  MOD_RES (272)..(536): Any amino acid
  MOD_RES (545)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWMTIGVSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAILPFDINXXXX

SEQ ID NO: 418372 - protein, 470 aa, Influenza virus
  MOD_RES (16)..(24): Any amino acid
  MOD_RES (40)..(53): Any amino acid
  MOD_RES (76)..(84): Any amino acid
  MOD_RES (286)..(288): Any amino acid
  MOD_RES (310)..(310): Any amino acid
MNPNQKILCTSATAIXXXXXXXXXGIANLGLNIGLHLKPXXXXXXXXXXXXXXSQTIINNYYNETNITQISNTNIXXXXXXXXXFNNLTKGLCTINSWHIYGKDNAVRIGEDSDVLVTREPYVSCDPDECRFYALSQGTTIRGKHSNGTIHDRSQYRALISWPLSSPPTVYNSRVECIGWSSTSCHDGRARMSICISGPNNNASAVIWYNRRPVTEINTWARNILRTQESECVCHNGVCPVVFTDGSATGPAETRVYYFKEGKILKWEPLTGTAKHIEECSCYGEXXXITCTCRDNWQGSNRPVIQIDPXAMTHTSQYICSPVLTDNPRPNDPAVGKCNDPYPGNNNNGVKGFSYLDGGNTWLGRTISTASRSGYEMLKVPNALTDDRSKPTQGQTIVLNTDWSGYSGSFMDYWAEGECYRACFYVELIRGRPKEDKVWWTSNSIVSMCSSTEFLGQWNWPDGAKIEYFL

SEQ ID NO: 418373 - protein, 470 aa, Influenza virus
  MOD_RES (16)..(24): Any amino acid
  MOD_RES (40)..(53): Any amino acid
  MOD_RES (65)..(66): Any amino acid
  MOD_RES (75)..(84): Any amino acid
  MOD_RES (134)..(136): Any amino acid
  MOD_RES (223)..(228): Any amino acid
  MOD_RES (283)..(288): Any amino acid
  MOD_RES (298)..(298): Any amino acid
  MOD_RES (310)..(310): Any amino acid
  MOD_RES (319)..(326): Any amino acid
  MOD_RES (378)..(378): Any amino acid
  MOD_RES (424)..(428): Any amino acid
  MOD_RES (470)..(470): Any amino acid
MNPNQRILCTSATALXXXXXXXXXGVANLGLNVGLHLKPXXXXXXXXXXXXXXSQTVINNYYNEXXVTQISNTNXXXXXXXXXXFNNLTRELCTINSWHIFGKDNAIRIGENSDVLVTREPYVSCEPDECRFYXXXQGTTIRGRHSNGTIHDRSQYRSLISWPLSSPPTVYNTRIECIGWSSTSCHDGKSRMSICVSGPNNNASAIVWYNRRPVAEINTWARXXXXXXESECVCHSGICPVVFTDGSATGPADTRIYYFKEGKTLKWEPLAGTAKHIEECSSXXXXXXIICTCRDNWXGSNRPVIRIDPXVMTHTSQYXXXXXXXXNPRPNDPTIGKCNDPYPGSNNNGVKGFAYLDGVNTWLGRTTSTASRSGYEVXKVPNALIDDRSKPIQGQTIVLDTDWSGYSGSFIDYWAKGECYRACXXXXXIRGRPKEEKVWWTSNSIISMCSSTEFLGQWDWPDGAKIETLX

SEQ ID NO: 418374 - protein, 470 aa, Influenza virus
  MOD_RES (1)..(1): Any amino acid
  MOD_RES (16)..(24): Any amino acid
  MOD_RES (40)..(53): Any amino acid
  MOD_RES (75)..(84): Any amino acid
  MOD_RES (98)..(99): Any amino acid
  MOD_RES (119)..(120): Any amino acid
  MOD_RES (136)..(152): Any amino acid
  MOD_RES (175)..(182): Any amino acid
  MOD_RES (222)..(230): Any amino acid
  MOD_RES (244)..(248): Any amino acid
  MOD_RES (260)..(260): Any amino acid
  MOD_RES (286)..(288): Any amino acid
  MOD_RES (297)..(300): Any amino acid
  MOD_RES (310)..(310): Any amino acid
  MOD_RES (319)..(326): Any amino acid
  MOD_RES (426)..(429): Any amino acid
  MOD_RES (445)..(457): Any amino acid
XNPNQKILFASATAIXXXXXXXXXGIVNLGLNIGLHLRPXXXXXXXXXXXXXXSQIIINNYYNKTNLTQISNTNXXXXXXXXXXFNNLTRGLCTINSXXIFGKDNAVRIGENSGVLVTXXPYVSCDPNECRFYALXXXXXXXXXXXXXXXXXRSQYRALVSWPLSSPPTVYNNRXXXXXXXXTSCHDGKARMSVCISGPNNNASAVVWYNGRPITEINTWAXXXXXXXXXECVCHNGICPVVFXXXXXTGPAETRIYYFXEGRILKWEPLNGTAKHIEECSCYGVXXXVTCTCRDNXXXXNRPVIQINPXMMTHTSQYXXXXXXXXNPRPNDPNVGKCNEPYPGNNNKGVKGFSYLNGDNTWLGRTINTASRSGYEILKVPNALTDNRSKPVQGQTIVSNTDWSGYSGSFVDYWAEGDCYRACFYXXXXRGRPKEDRVWWTSNSXXXXXXXXXXXXXWNWPDGAEIEYFL

SEQ ID NO: 418375 - protein, 470 aa, Influenza virus
  MOD_RES (1)..(1): Any amino acid
  MOD_RES (11)..(24): Any amino acid
  MOD_RES (33)..(54): Any amino acid
  MOD_RES (76)..(84): Any amino acid
  MOD_RES (99)..(99): Any amino acid
  MOD_RES (137)..(156): Any amino acid
  MOD_RES (182)..(182): Any amino acid
  MOD_RES (194)..(199): Any amino acid
  MOD_RES (210)..(210): Any amino acid
  MOD_RES (219)..(230): Any amino acid
  MOD_RES (242)..(248): Any amino acid
  MOD_RES (271)..(277): Any amino acid
  MOD_RES (286)..(310): Any amino acid
  MOD_RES (319)..(326): Any amino acid
  MOD_RES (335)..(340): Any amino acid
  MOD_RES (354)..(358): Any amino acid
  MOD_RES (377)..(380): Any amino acid
  MOD_RES (405)..(408): Any amino acid
  MOD_RES (418)..(430): Any amino acid
  MOD_RES (445)..(461): Any amino acid
  MOD_RES (470)..(470): Any amino acid
XNPNQKIQCTXXXXXXXXXXXXXXGITNLGLNXXXXXXXXXXXXXXXXXXXXXXQTIINNYHNETNITQISNINIXXXXXXXXXFNNLTKRLCTINSWXIYGKDNAIRIGEDSDILVTREPYVSCDPDGCRFYALSXXXXXXXXXXXXXXXXXXXXRALISWPQSSPPTVYNSKVECIGWSXTSCHDGKFRMSXXXXXXNNNASTVIWYXKRPVTEINXXXXXXXXXXXXECVCQNGVCPVXXXXXXXTGPADTRVYYFREGKIIKWEPLXXXXXXXEECSCYGKXXXXXXXXXXXXXXXXXXXXXXXXXTMTHTSQYXXXXXXXXNPRPNDPVXXXXXXPYPGNNBNGVKGFXXXXXSNTWLGRTISIASRSGYEXXXXPNALTDDKSKPTQGQTVVLNTDWSXXXXSFIDYWAEGXXXXXXXXXXXXXGRPKEDEVWWTSNSXXXXXXXXXXXXXXXXXDGAKIEYSX

SEQ ID NO: 418376 - protein, 470 aa, Influenza virus
  MOD_RES (1)..(2): Any amino acid
  MOD_RES (16)..(24): Any amino acid
  MOD_RES (33)..(57): Any amino acid
  MOD_RES (76)..(86): Any amino acid
  MOD_RES (102)..(104): Any amino acid
  MOD_RES (113)..(166): Any amino acid
  MOD_RES (175)..(182): Any amino acid
  MOD_RES (191)..(200): Any amino acid
  MOD_RES (209)..(210): Any amino acid
  MOD_RES (222)..(231): Any amino acid
  MOD_RES (243)..(253): Any amino acid
  MOD_RES (275)..(310): Any amino acid
  MOD_RES (321)..(326): Any amino acid
  MOD_RES (335)..(340): Any amino acid
  MOD_RES (350)..(358): Any amino acid
  MOD_RES (375)..(380): Any amino acid
  MOD_RES (404)..(409): Any amino acid
  MOD_RES (425)..(462): Any amino acid
XXPNQKILCASATAIXXXXXXXXXGTANLGLNXXXXXXXXXXXXXXXXXXXXXXXXXINNYYNDTNITQVSNTNIXXXXXXXXXXXNLTRGLCKINSWHIFXXXNAVRIGEKXXXXXXXXXXXXXXXXXXXXXXXXXXXXXXXXXXXXXXXXXXXXXXXXXXXXXXPPTVYNTKXXXXXXXXTSCHDGKTXXXXXXXXXXNNASAIIWXXGRPTTEINTWAXXXXXXXXXXCVCHDGVCPVVXXXXXXXXXXXTRVYYFKGGKILKWESLTGTAXXXXXXXXXXXXXXXXXXXXXXXXXXXXXXXXXXXXAMKHTSQYICXXXXXXNPRPNDPSXXXXXXPYPGNSNNGXXXXXXXXXFNTWLGRTLNTASRSGXXXXXXPNALTDERSKPAQGQTIVLTTDWXXXXXXFIDYWAKEECYRACFXXXXXXXXXXXXXXXXXXXXXXXXXXXXXXXXXXXXXXGAKIKYFL

SEQ ID NO: 418377 - protein, 470 aa, Influenza virus
  MOD_RES (1)..(3): Any amino acid
  MOD_RES (16)..(88): Any amino acid
  MOD_RES (97)..(105): Any amino acid
  MOD_RES (120)..(202): Any amino acid
  MOD_RES (211)..(234): Any amino acid
  MOD_RES (243)..(253): Any amino acid
  MOD_RES (263)..(265): Any amino acid
  MOD_RES (275)..(341): Any amino acid
  MOD_RES (350)..(360): Any amino acid
  MOD_RES (380)..(381): Any amino acid
  MOD_RES (397)..(411): Any amino acid
  MOD_RES (424)..(470): Any amino acid
XXXSQKILCTSAIAIXXXXXXXXXXXXXXXXXXXXXXXXXXXXXXXXXXXXXXXXXXXXXXXXXXXXXXXXXXXXXXXXXXXXXXXXXTKGLCIINXXXXXXXXXAVRIGESSDVLVTRXXXXXXXXXXXXXXXXXXXXXXXXXXXXXXXXXXXXXXXXXXXXXXXXXXXXXXXXXXXXXXXXXXXXXXXXXXXXXXXXXXXASAVIWYKXXXXXXXXXXXXXXXXXXXXXXXXHNGICPVAXXXXXXXXXXXTRVYYFKKGXXXKWESLAGTAXXXXXXXXXXXXXXXXXXXXXXXXXXXXXXXXXXXXXXXXXXXXXXXXXXXXXXXXXXXXXXXXXXXYPGNNNGVXXXXXXXXXXXTWVGRTISIASRYGYEMLKXXNALTNDRSKPMQGQTXXXXXXXXXXXXXXXDYWAKGDCYRACXXXXXXXXXXXXXXXXXXXXXXXXXXXXXXXXXXXXXXXXXXXXXXX

SEQ ID NO: 418378 - protein, 470 aa, Influenza virus
  MOD_RES (1)..(89): Any amino acid
  MOD_RES (98)..(107): Any amino acid
  MOD_RES (118)..(202): Any amino acid
  MOD_RES (211)..(235): Any amino acid
  MOD_RES (244)..(265): Any amino acid
  MOD_RES (275)..(365): Any amino acid
  MOD_RES (381)..(382): Any amino acid
  MOD_RES (399)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXKELCTINSXXXXXXXXXXRIGGNSDVLVXXXXXXXXXXXXXXXXXXXXXXXXXXXXXXXXXXXXXXXXXXXXXXXXXXXXXXXXXXXXXXXXXXXXXXXXXXXXXXXXXXXXXASPVIWYNXXXXXXXXXXXXXXXXXXXXXXXXXSGVCPVVFXXXXXXXXXXXXXXXXXXXXXXKWESLNGTAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTISTASRAGYEMLKVXXALTDDRSTPIQGQTVVXXXXXXXXXXXXXXXXXXXXXXXXXXXXXXXXXXXXXXXXXXXXXXXXXXXXXXXXXXXXXXXXXXXXXXXX

SEQ ID NO: 418379 - protein, 470 aa, Influenza virus
  MOD_RES (1)..(366): Any amino acid
  MOD_RES (375)..(388): Any amino acid
  MOD_RES (401)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISTASRYGXXXXXXXXXXXXXXSKPIQGQIIVLNXXXXXXXXXXXXXXXXXXXXXXXXXXXXXXXXXXXXXXXXXXXXXXXXXXXXXXXXXXXXXXXXXXXXXX

SEQ ID NO: 418380 - protein, 568 aa, Influenza virus
  MOD_RES (1)..(15): Any amino acid
  MOD_RES (38)..(39): Any amino acid
  MOD_RES (53)..(65): Any amino acid
  MOD_RES (77)..(85): Any amino acid
  MOD_RES (99)..(101): Any amino acid
  MOD_RES (128)..(153): Any amino acid
  MOD_RES (166)..(166): Any amino acid
  MOD_RES (184)..(188): Any amino acid
  MOD_RES (199)..(199): Any amino acid
  MOD_RES (246)..(247): Any amino acid
  MOD_RES (271)..(271): Any amino acid
  MOD_RES (280)..(285): Any amino acid
  MOD_RES (337)..(337): Any amino acid
  MOD_RES (486)..(486): Any amino acid
  MOD_RES (542)..(546): Any amino acid
XXXXXXXXXXXXXXXGLDKICLGHHAVSNGTIVKTLTXXKEEVTNATETVESXXXXXXXXXXXXXKDLGNCHPIGMXXXXXXXXXHLTGTWDTLIERDXXXAYCYPGATVNEEALRQKIMESGGIDKXXXXXXXXXXXXXXXXXXXXXXXXXXSFYAELKWLVSKXKGQNFPQTTNTYRNTDSXXXXXIWGIHHPSSTXEKNDLYGTQSLSISVGSSTYQNNFVPVVGARPQVNGQSGRIDFHWTXXQPGDNITFSHNGGLIAPSRVSKLXGRGLGIQSXXXXXXDCESKCFWKGGSINTKLPFQNLSPRTVGQCPKYVNKKSLLLATGMRNVPEVXQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDXNCMESIRNNTYDHTQYREEALLNRLNINPVKLSSGYKDVILWFSFGASCFVLLAVXXXXXFFCLKNGNMRCTISLVKTTLFL

SEQ ID NO: 418381 - protein, 568 aa, Influenza virus
  MOD_RES (1)..(15): Any amino acid
  MOD_RES (38)..(39): Any amino acid
  MOD_RES (53)..(65): Any amino acid
  MOD_RES (77)..(85): Any amino acid
  MOD_RES (98)..(101): Any amino acid
  MOD_RES (128)..(153): Any amino acid
  MOD_RES (166)..(166): Any amino acid
  MOD_RES (184)..(188): Any amino acid
  MOD_RES (199)..(199): Any amino acid
  MOD_RES (246)..(247): Any amino acid
  MOD_RES (271)..(271): Any amino acid
  MOD_RES (280)..(285): Any amino acid
  MOD_RES (309)..(312): Any amino acid
  MOD_RES (337)..(337): Any amino acid
  MOD_RES (347)..(351): Any amino acid
  MOD_RES (394)..(403): Any amino acid
  MOD_RES (419)..(427): Any amino acid
  MOD_RES (442)..(443): Any amino acid
  MOD_RES (486)..(486): Any amino acid
  MOD_RES (542)..(546): Any amino acid
  MOD_RES (557)..(568): Any amino acid
XXXXXXXXXXXXXXXGIDKICLGHHAVPNGTTVKTLTXXQEEVTNATETVENXXXXXXXXXXXXXKDLGSCHPIGMXXXXXXXXXHLAGTWDTIIERXXXXAYCYPGTTINEEALRQKIMESGEIDKXXXXXXXXXXXXXXXXXXXXXXXXXXSFYTELKWLVSGXKGQSFPQTTNTYRNTDTXXXXXVWGIHHPSNTXEKNDLYGAQSLSISVESSTYQNNFVPVIGARPQVNGQRGRIDFHWAXXRPGDNITFLHNGGLIAPDRVSKLXGKGIGIQSXXXXXXNCESKCFWRGGSINTRLPFQNLSXXXXGQCPKYVSKRSLLLATGMRNVPEIXQERGLFGAIXXXXXNGWEGMIDGWYGFRHQNAQGIGQAADYKSTQTAIVQITGKLNXXXXXXXXXXESIESEFNEIEHQIGXXXXXXXXXITYIWTYQAELLIAXXNQHTIDMGDSEMLNLYDRVRKQLRQNAEEDGRGCFEIYHACDXSCMESIRNNTYNHTQYREESLLNRLSINPVTLSSGYKDIILWFSFGASSFVLLAVXXXXXFFCLRNGNMRXXXXXXXXXXXX

SEQ ID NO: 418382 - protein, 568 aa, Influenza virus
  MOD_RES (1)..(15): Any amino acid
  MOD_RES (38)..(39): Any amino acid
  MOD_RES (48)..(65): Any amino acid
  MOD_RES (77)..(85): Any amino acid
  MOD_RES (99)..(101): Any amino acid
  MOD_RES (128)..(153): Any amino acid
  MOD_RES (166)..(166): Any amino acid
  MOD_RES (184)..(188): Any amino acid
  MOD_RES (199)..(199): Any amino acid
  MOD_RES (246)..(247): Any amino acid
  MOD_RES (271)..(271): Any amino acid
  MOD_RES (280)..(285): Any amino acid
  MOD_RES (309)..(312): Any amino acid
  MOD_RES (337)..(338): Any amino acid
  MOD_RES (354)..(367): Any amino acid
  MOD_RES (394)..(405): Any amino acid
  MOD_RES (421)..(432): Any amino acid
  MOD_RES (441)..(444): Any amino acid
  MOD_RES (457)..(475): Any amino acid
  MOD_RES (486)..(486): Any amino acid
  MOD_RES (525)..(529): Any amino acid
  MOD_RES (542)..(546): Any amino acid
  MOD_RES (557)..(568): Any amino acid
XXXXXXXXXXXXXXXGLDRICLGHHAVANGTVVKTLTXXHEEVTNATXXXXXXXXXXXXXXXXXXKDLDNCHPIGMXXXXXXXXXHLTGKWDTLIEREXXXAHCYPGATVNEGALRQKIMESGGVNKXXXXXXXXXXXXXXXXXXXXXXXXXXSFYGELKWLISKXKGQNFPRTTNTYRNTDPXXXXXMWGIHHPSSAXEKNELYGTQPLSISVGSSTYHNSFVPVVGARPKVNGQSGRIEFHWTXXQPGDSITFSHNGGRIAPSRVTKLXGKGLGIQSXXXXXXGCESKCFWKGGTINTELPFQNLSXXXXGQCPKYVKKKSLMLATGMRNVPETXXGRGLFGAKAGFIENGXXXXXXXXXXXXXXNDQGTGQAADYESTQAAINQITGKLNXXXXXXXXXXXXIESEFSETEHQIGNVXXXXXXXXXXXXTYNAELLVXXXXQHTIEMTDSEMLXXXXXXXXXXXXXXXXXXXGCFEIYHTCDXNCMESIRDNTYDHSQYREEALLNRLSINSVKLSSGYKNXXXXXSFGASCFILLAVXXXXXFLCLKNGNMQXXXXXXXXXXXX

SEQ ID NO: 418383 - protein, 568 aa, Influenza virus
  MOD_RES (1)..(15): Any amino acid
  MOD_RES (38)..(39): Any amino acid
  MOD_RES (48)..(65): Any amino acid
  MOD_RES (77)..(85): Any amino acid
  MOD_RES (99)..(101): Any amino acid
  MOD_RES (118)..(119): Any amino acid
  MOD_RES (128)..(153): Any amino acid
  MOD_RES (166)..(166): Any amino acid
  MOD_RES (183)..(188): Any amino acid
  MOD_RES (199)..(199): Any amino acid
  MOD_RES (246)..(247): Any amino acid
  MOD_RES (271)..(271): Any amino acid
  MOD_RES (280)..(285): Any amino acid
  MOD_RES (301)..(313): Any amino acid
  MOD_RES (330)..(368): Any amino acid
  MOD_RES (396)..(407): Any amino acid
  MOD_RES (423)..(434): Any amino acid
  MOD_RES (443)..(445): Any amino acid
  MOD_RES (456)..(475): Any amino acid
  MOD_RES (486)..(486): Any amino acid
  MOD_RES (502)..(503): Any amino acid
  MOD_RES (526)..(533): Any amino acid
  MOD_RES (542)..(546): Any amino acid
  MOD_RES (557)..(568): Any amino acid
XXXXXXXXXXXXXXXSLDKICLGHHAVTNGTFVKTLTXXKEKVTNATXXXXXXXXXXXXXXXXXXRDLGNCHPVGMXXXXXXXXXYLTGTWDTLIERGXXXAYCYPGSTVSEEALRQXXMESGGISKXXXXXXXXXXXXXXXXXXXXXXXXXXSFYAELRWLVSKXKEQNFPQTANTYRNTDXXXXXXTWGIHHPSSIXERNDLYGTQSLSISIGSSTYQNSFVPVVRARPQVNGQSGRINFHWTXXQPGDHITFSHNGGLIAPNRVSKLXGRGLGVQSXXXXXXSCESKCFWREGSINTXXXXXXXXXXXXXQCPKYVNQRSLMLATGXXXXXXXXXXXXXXXXXXXXXXXXXXXXXXXXXXXXXXXAQGTGLAADYKSTQKTIDQVTGKLNRLXXXXXXXXXXXXSEFNEIEYQIGNVINXXXXXXXXXXXXQEELLVAMXXXHTIDLADSEMXXXXXXXXXXXXXXXXXXXXGCFEIYHNCDXSCMERIRNNTYDHSQXXEEAPLNRLNINSVKLFSGYKDIXXXXXXXXSCFVLLAAXXXXXFFCLKDGNMRXXXXXXXXXXXX

SEQ ID NO: 418384 - protein, 568 aa, Influenza virus
  MOD_RES (1)..(39): Any amino acid
  MOD_RES (48)..(68): Any amino acid
  MOD_RES (77)..(85): Any amino acid
  MOD_RES (99)..(101): Any amino acid
  MOD_RES (118)..(119): Any amino acid
  MOD_RES (128)..(153): Any amino acid
  MOD_RES (162)..(166): Any amino acid
  MOD_RES (176)..(188): Any amino acid
  MOD_RES (197)..(199): Any amino acid
  MOD_RES (208)..(213): Any amino acid
  MOD_RES (246)..(247): Any amino acid
  MOD_RES (259)..(261): Any amino acid
  MOD_RES (270)..(271): Any amino acid
  MOD_RES (280)..(287): Any amino acid
  MOD_RES (307)..(313): Any amino acid
  MOD_RES (330)..(377): Any amino acid
  MOD_RES (393)..(410): Any amino acid
  MOD_RES (420)..(449): Any amino acid
  MOD_RES (459)..(475): Any amino acid
  MOD_RES (484)..(486): Any amino acid
  MOD_RES (513)..(513): Any amino acid
  MOD_RES (527)..(533): Any amino acid
  MOD_RES (542)..(547): Any amino acid
  MOD_RES (556)..(568): Any amino acid
XXXXXXXXXXXXXXXXXXXXXXXXXXXXXXXXXXXXXXXMEEVTNATXXXXXXXXXXXXXXXXXXXXXGNCHPIGIXXXXXXXXXHLTGTWNTLIERDXXXAYCYPGVTINEGALRQXXMESGGINKXXXXXXXXXXXXXXXXXXXXXXXXXXSFYSELKWXXXXXKGRNFPQTTXXXXXXXXXXXXXLWGIHHPSXXXEKNNLYGTXXXXXXVGSSTYQSNFVPVVRARPLVNGQRGRIVFHWTXXQPGDNIIFSHNXXXIAPSRVGKXXGRDLGIQSXXXXXXXXKSKCFWRGGSIITELPFQNXXXXXXXQCPKYVSQGSLLLATGXXXXXXXXXXXXXXXXXXXXXXXXXXXXXXXXXXXXXXXXXXXXXXXXYKSTQAAVDQITGKLXXXXXXXXXXXXXXXXXXSEIEHQISNXXXXXXXXXXXXXXXXXXXXXXXXXXXXXXMADSTMLNLXXXXXXXXXXXXXXXXXGCFEIYHVXXXDCMESIRNNTYDHAQYREEALLNRINXNPVKLSSSYKDIIXXXXXXXSCFVLLAIXXXXXXFCLKNGNTXXXXXXXXXXXXX

SEQ ID NO: 418385 - protein, 568 aa, Influenza virus
  MOD_RES (1)..(88): Any amino acid
  MOD_RES (98)..(154): Any amino acid
  MOD_RES (166)..(167): Any amino acid
  MOD_RES (176)..(219): Any amino acid
  MOD_RES (245)..(248): Any amino acid
  MOD_RES (258)..(262): Any amino acid
  MOD_RES (271)..(291): Any amino acid
  MOD_RES (307)..(476): Any amino acid
  MOD_RES (485)..(493): Any amino acid
  MOD_RES (509)..(513): Any amino acid
  MOD_RES (522)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXGKWDTPIERXXXXXXXXXXXXXXXXXXXXXXXXXXXXXXXXXXXXXXXXXXXXXXXXXXXXXXXXXFYAEVKWLVSKXXGQNFPQTAXXXXXXXXXXXXXXXXXXXXXXXXXXXXXXXXXXXXXXXXXXXXQNNFVPVMGARPQVNGQSGRIVFHWXXXXPGHNITFSHXXXXXAPSRVSKFXXXXXXXXXXXXXXXXXXXXXFWKGGSIKTKLPFQNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWFEIYHTCXXXXXXXXXNNTYDHSHYREEALLXXXXXNPVELSSGXXXXXXXXXXXXXXXXXXXXXXXXXXXXXXXXXXXXXXXXXXXXXXX

SEQ ID NO: 418386 - protein, 568 aa, Influenza virus
  MOD_RES (1)..(88): Any amino acid
  MOD_RES (99)..(220): Any amino acid
  MOD_RES (240)..(250): Any amino acid
  MOD_RES (264)..(294): Any amino acid
  MOD_RES (303)..(477): Any amino acid
  MOD_RES (486)..(514): Any amino acid
  MOD_RES (525)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXGMWDTLIERKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNNFVPVVRDRPLVNGQSGRXXXXXXXXXXXDNITFSDNGGLIAXXXXXXXXXXXXXXXXXXXXXXXXXXXXXXXSGSINTKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFEIYHKCNXXXXXXXXXXXXXXXXXXXXXXXXXXXXXPVRLSSGYKDXXXXXXXXXXXXXXXXXXXXXXXXXXXXXXXXXXXXXXXXXXXX

SEQ ID NO: 418387 - protein, 568 aa, Influenza virus
  MOD_RES (1)..(225): Any amino acid
  MOD_RES (234)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVGARPLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418388 - protein, 568 aa, Influenza virus
  MOD_RES (1)..(226): Any amino acid
  MOD_RES (235)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGDRPLVNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418389 - protein, 561 aa, Influenza virus
  MOD_RES (1)..(15): Any amino acid
  MOD_RES (54)..(64): Any amino acid
  MOD_RES (131)..(131): Any amino acid
  MOD_RES (145)..(150): Any amino acid
  MOD_RES (184)..(184): Any amino acid
  MOD_RES (282)..(283): Any amino acid
  MOD_RES (337)..(337): Any amino acid
XXXXXXXXXXXXXXXGLDKICLGHHAVSNGTIVKTLTNEKEEVTNATETVESKXXXXXXXXXXXYKDLGNCHPIGMVIGTPACDLHLTGTWDTLIERDNSIAYCYPGATVNEEALRQKIMESGGIDKISTXFTYGSSINSAGTTXXXXXXGGNSFYAELKWLVSKSKGQNFPQTTNTYRNTDSXEHLIIWGIHHPSSTQEKNDLYGTQSLSISVGSSTYQNNFVPVVGARPQVNGQSGRIDFHWTMVQPGDNITFSHNGGLIAPSRVSKLKGRGLGIQSGAXXDNDCESKCFWKGGSINTKLPFQNLSPRTVGQCPKYVNKKSLLLATGMRNVPEVXQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDDNCMESIRNNTYDHTQYREEALLNRLNINPVKLSSGYKDVILWFSFGASCFVLLAVIMGLVFFCLKNGNMRCTICI

SEQ ID NO: 418390 - protein, 561 aa, Influenza virus
  MOD_RES (1)..(15): Any amino acid
  MOD_RES (54)..(64): Any amino acid
  MOD_RES (116)..(118): Any amino acid
  MOD_RES (131)..(131): Any amino acid
  MOD_RES (142)..(150): Any amino acid
  MOD_RES (184)..(184): Any amino acid
  MOD_RES (223)..(233): Any amino acid
  MOD_RES (281)..(283): Any amino acid
  MOD_RES (302)..(312): Any amino acid
  MOD_RES (337)..(337): Any amino acid
  MOD_RES (354)..(371): Any amino acid
  MOD_RES (396)..(403): Any amino acid
  MOD_RES (419)..(432): Any amino acid
  MOD_RES (443)..(446): Any amino acid
  MOD_RES (559)..(561): Any amino acid
XXXXXXXXXXXXXXXGIDKICLGHHAVPNGTIVKTLTSEKEEVINATETVENKXXXXXXXXXXXYKDLGSCHPIGMVVGTPACDLYLTGTWDTLIERENAIAYCYPGTTVNEEALXXXIMESGGISKISTXFIYGSSINSTXXXXXXXXXGGDSFYAELKWLISKSKEQNFPQTANTYRNTDTXEHLIVWGIHHPSSAQEKNDLYGAQSLSISVESSTYQNNXXXXXXXXXXXNGQSGRINFHWTVVQPGDNIIFSHNGGLVAPSRVSKLRGRDLGIQSEXXXDNNCESKCFWRGGSINTKXXXXXXXXXXXGQCPKYVSKRSLLLATGMRNVPEIXQERGLFGAIAGFLENGXXXXXXXXXXXXXXXXXXTGQAADYESTQAAIDQVTGKLNRLXXXXXXXXESIESEFNEIEHQIGXXXXXXXXXXXXXXTYNAELLVAMXXXXTIDMADSTMLNLYDRVRKQLRQNAEEDGRGCFEIYHACDDSCMESIRNNTYDHAQYREEALLNRLSINPVKLSSGYKDIILWFSFGASCFILLAVIVGLVFFCLRNGNMRCTXXX

SEQ ID NO: 418391 - protein, 561 aa, Influenza virus
  MOD_RES (1)..(15): Any amino acid
  MOD_RES (54)..(64): Any amino acid
  MOD_RES (116)..(120): Any amino acid
  MOD_RES (131)..(131): Any amino acid
  MOD_RES (145)..(150): Any amino acid
  MOD_RES (184)..(184): Any amino acid
  MOD_RES (230)..(237): Any amino acid
  MOD_RES (269)..(271): Any amino acid
  MOD_RES (282)..(283): Any amino acid
  MOD_RES (307)..(313): Any amino acid
  MOD_RES (337)..(342): Any amino acid
  MOD_RES (353)..(375): Any amino acid
  MOD_RES (392)..(405): Any amino acid
  MOD_RES (421)..(433): Any amino acid
  MOD_RES (442)..(447): Any amino acid
  MOD_RES (462)..(475): Any amino acid
  MOD_RES (523)..(533): Any amino acid
  MOD_RES (554)..(561): Any amino acid
XXXXXXXXXXXXXXXGLDRICLGHHAVANGTIVKTLTNEQEEVTNATETVESTXXXXXXXXXXXHKDLGNCHPVGMLIGTPVCDPHLTGTWDTLIERGSSVAYCYPGSTVNEEALXXXXXESGGISKMSTXFAYGSSINSAGDTXXXXXXGKNSFYAELKWLVSKTKGQNFPRTTNTYRNTDPXEHLIMWGIHHPSSTKEKNDLYGTQPLSISVGSSIYQNSFVPVVGAXXXXXXXXGRIDFHWALVQPGDNITFSDNGGLIAPDRVSXXXGKGLGIQSGSXXDNSCESKCFWKGGSIKTKLPFQNXXXXXXXQCPKYVNQKSLMLATGMRNVPETXXXXXXFGAKAGFIENXXXXXXXXXXXXXXXXXXXXXXXADYKSTQKTIDQVTGKXXXXXXXXXXXXXXIESEFSETEHQIGNVXXXXXXXXXXXXXYQAELLIAXXXXXXIDLADSEMLNLYDRXXXXXXXXXXXXXXGCFEIYHTCDNNCMESIRDNTYDHSQYREEALLNRLNINSVKLSSGYXXXXXXXXXXXSCFVLLAAIMGLFFFCLKNGXXXXXXXX

SEQ ID NO: 418392 - protein, 561 aa, Influenza virus
  MOD_RES (1)..(15): Any amino acid
  MOD_RES (54)..(64): Any amino acid
  MOD_RES (118)..(120): Any amino acid
  MOD_RES (131)..(131): Any amino acid
  MOD_RES (145)..(150): Any amino acid
  MOD_RES (178)..(184): Any amino acid
  MOD_RES (226)..(245): Any amino acid
  MOD_RES (282)..(293): Any amino acid
  MOD_RES (309)..(313): Any amino acid
  MOD_RES (330)..(377): Any amino acid
  MOD_RES (393)..(407): Any amino acid
  MOD_RES (423)..(453): Any amino acid
  MOD_RES (462)..(475): Any amino acid
  MOD_RES (502)..(509): Any amino acid
  MOD_RES (525)..(533): Any amino acid
  MOD_RES (550)..(561): Any amino acid
XXXXXXXXXXXXXXXSLDKICLGHHAIPNGTIIKTLTNEKEKVTNATETVESRXXXXXXXXXXXYKDLDNCHPIGMIIGAPACDLHLTGIWDTLIERENSIAHCYPGATINEEALRQXXXESGGIDKVSTXFTYESSINPAGTTXXXXXXGRNSFYAELKWLVSKNKGQSFPQTTNTXXXXXXXEHLITWGIHHPSSTKEKNELYGTQSLSISIGSSTYQNSFVPXXXXXXXXXXXXXXXXXXXXTVQPGDNITFLHNGGLIAPSRVTKLKGRGLGIQSDAXXXXXXXXXXXXRGGSINTRLPFQNLSXXXXXQCPKYVSQRSLMLATGXXXXXXXXXXXXXXXXXXXXXXXXXXXXXXXXXXXXXXXXXXXXXXXXYKSTQAAVDQITGKLXXXXXXXXXXXXXXXSEFNEIEYQIGNVINXXXXXXXXXXXXXXXXXXXXXXXXXXXXXXXEMLNLYEGXXXXXXXXXXXXXXGCFEIYHNCDDNCMERIRNNTYDHSQXXXXXXXXRLNINPVTLSSGYKDXXXXXXXXXSCFVLLAIVMGLVFFCXXXXXXXXXXXX

SEQ ID NO: 418393 - protein, 561 aa, Influenza virus
  MOD_RES (1)..(21): Any amino acid
  MOD_RES (48)..(64): Any amino acid
  MOD_RES (121)..(121): Any amino acid
  MOD_RES (131)..(131): Any amino acid
  MOD_RES (145)..(151): Any amino acid
  MOD_RES (177)..(184): Any amino acid
  MOD_RES (194)..(195): Any amino acid
  MOD_RES (209)..(213): Any amino acid
  MOD_RES (228)..(245): Any amino acid
  MOD_RES (256)..(263): Any amino acid
  MOD_RES (282)..(321): Any amino acid
  MOD_RES (330)..(380): Any amino acid
  MOD_RES (392)..(477): Any amino acid
  MOD_RES (493)..(516): Any amino acid
  MOD_RES (525)..(534): Any amino acid
  MOD_RES (546)..(561): Any amino acid
XXXXXXXXXXXXXXXXXXXXXLGHHAVTNGTIVKTLTNEREEVTNATXXXXXXXXXXXXXXXXXHRDLGNCHPIGMLIGAPSCDLHLTGKWDTLIERDNAIAHCYPGATVNEGALRQKIMXSGGIDKIGTXFTYGSSITSAGTTXXXXXXXENSFYAELKWLVSKDKGRNFPQTTNXXXXXXXXEHLVMWGIHXXSSTQERNDLYGTQXXXXXVGSSTYHNSFVPVVXXXXXXXXXXXXXXXXXXIVRPGDNITFXXXXXXXXPSRVSKLTGRGLGIQSEAXXXXXXXXXXXXXXXXXXXXXXXXXXXXXXXXXXXXXXXXGSLLLATGXXXXXXXXXXXXXXXXXXXXXXXXXXXXXXXXXXXXXXXXXXXXXXXXXXXTQATIDQITGKXXXXXXXXXXXXXXXXXXXXXXXXXXXXXXXXXXXXXXXXXXXXXXXXXXXXXXXXXXXXXXXXXXXXXXXXXXXXXXXXXXXXXXFEIYHKCNDNCMESIXXXXXXXXXXXXXXXXXXXXXXXXRLSSGYKDXXXXXXXXXXCFVLLAVVMGLXXXXXXXXXXXXXXXX

SEQ ID NO: 418394 - protein, 561 aa, Influenza virus
  MOD_RES (1)..(27): Any amino acid
  MOD_RES (47)..(84): Any amino acid
  MOD_RES (97)..(100): Any amino acid
  MOD_RES (109)..(134): Any amino acid
  MOD_RES (145)..(186): Any amino acid
  MOD_RES (195)..(196): Any amino acid
  MOD_RES (211)..(246): Any amino acid
  MOD_RES (255)..(263): Any amino acid
  MOD_RES (273)..(273): Any amino acid
  MOD_RES (282)..(486): Any amino acid
  MOD_RES (495)..(534): Any amino acid
  MOD_RES (546)..(561): Any amino acid
XXXXXXXXXXXXXXXXXXXXXXXXXXXANGTVVKTLTNEHEEVTNAXXXXXXXXXXXXXXXXXXXXXXXXXXXXXXXXXXXXXXLHLTGMWDTLIEXXXXIAYCYPGSXXXXXXXXXXXXXXXXXXXXXXXXXXGASINSAGATXXXXXXXXXXXXXXXXXXXXXXXXXXXXXXXXXXXXXXXXXXIIMWGIHHXXSTQEKNALYGTQSLXXXXXXXXXXXXXXXXXXXXXXXXXXXXXXXXXXXXIQPGDNITXXXXXXXXXPSRVSKLIGXGLGIQSGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPCMESIRNXXXXXXXXXXXXXXXXXXXXXXXXXXXXXXXXXXXXXXXXCFVLLADVMGLXXXXXXXXXXXXXXXX

SEQ ID NO: 418395 - protein, 561 aa, Influenza virus
  MOD_RES (1)..(100): Any amino acid
  MOD_RES (109)..(561): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIANCYPGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418396 - protein, 561 aa, Influenza virus
  MOD_RES (1)..(102): Any amino acid
  MOD_RES (111)..(561): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYCYPGATMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418397 - protein, 471 aa, Influenza virus
  MOD_RES (19)..(19): Any amino acid
  MOD_RES (47)..(53): Any amino acid
  MOD_RES (75)..(82): Any amino acid
  MOD_RES (308)..(308): Any amino acid
  MOD_RES (332)..(333): Any amino acid
  MOD_RES (389)..(389): Any amino acid
  MOD_RES (416)..(416): Any amino acid
MNPNQKLFALSGVAIALSXLNLLIGISNVGLNVSLHLKEKGTKQEEXXXXXXXTQNNTTLIENTYVNNTTVINKXXXXXXXXYLMLNKSLCKVEGWVVVAKDNAIRFGESEQIIVTREPYVSCDPLGCKMYALHQGTTIRNKHSNGTIHDRTAFRGLISTPLGSPPIVSNSDFLCVGWSSTSCHDGIGRMTICVQGNNDNATATVYYDRRLTTTIKTWAGNILRTQESECVCHNGTCVVIMTDGSASSQAYTKVLYFHKGLVIKEEALKGSARHIEECSCYGHNSKVTCVCRDNWQGANRPVIEIDMXAMEHTSQYLCTGVLTDTSRPSDKXXGDCNNPITGSPGAPGVKGFGFLDSGNTWLGRTISPRSRSGFEMLKIPNAGTDPNSXITERQEIVDNNNWSGYSGSFIDYWDEXSECYNPCFYVELIRGRPEEAKYVWWTSNSLVALCGSPISVGSGSFPDGAQIQYFS

SEQ ID NO: 418398 - protein, 471 aa, Influenza virus
  MOD_RES (17)..(19): Any amino acid
  MOD_RES (47)..(53): Any amino acid
  MOD_RES (75)..(82): Any amino acid
  MOD_RES (134)..(134): Any amino acid
  MOD_RES (150)..(150): Any amino acid
  MOD_RES (228)..(230): Any amino acid
  MOD_RES (308)..(308): Any amino acid
  MOD_RES (332)..(333): Any amino acid
  MOD_RES (387)..(389): Any amino acid
  MOD_RES (416)..(416): Any amino acid
  MOD_RES (425)..(428): Any amino acid
MNPKSKLFTLSGVAIAXXXLNLIIGISNVGLNISLHLKEKGPKQEEXXXXXXXTQNNTTVVENTYVNNTTIITKXXXXXXXXYLLLNKSLCNVEGWVVIAKDNAVRFGESEQVIVTREPYVSCDPTGCKMYALXQGTTIRNRHSNGTIHXRTAFRGLMSTPLGSPPVVSNSDFICVGWSSTTCHDGIGRMTICIQGNNDNATATVYYNRRLTTTIKPWARNILRTQEXXXVCHNGTCAVVMTDGSASGQAYTKVMYFHKGLVVKEEPLKGSAKHIEECSCYGHDSKVTCICRDNWQGANRPIIEIDMXTLEHTSRYVCTGILTDTSRPGDKXXGDCSNPITGSPSAPGVKGFGFLNGDNTWLGRTFSPRSRSGFEMLKVPNAGTDPXXXITGRQEIVDNSNWSGYSGSFIDYWNDXNECYNPCFXXXXIRGRPEEVKYVWWTSNSLIALCGSPFPVGSGSFPDGARIQYFS

SEQ ID NO: 418399 - protein, 471 aa, Influenza virus
  MOD_RES (1)..(1): Any amino acid
  MOD_RES (19)..(19): Any amino acid
  MOD_RES (47)..(53): Any amino acid
  MOD_RES (75)..(82): Any amino acid
  MOD_RES (93)..(97): Any amino acid
  MOD_RES (118)..(118): Any amino acid
  MOD_RES (134)..(156): Any amino acid
  MOD_RES (225)..(232): Any amino acid
  MOD_RES (295)..(296): Any amino acid
  MOD_RES (308)..(308): Any amino acid
  MOD_RES (319)..(323): Any amino acid
  MOD_RES (332)..(349): Any amino acid
  MOD_RES (374)..(375): Any amino acid
  MOD_RES (389)..(389): Any amino acid
  MOD_RES (416)..(416): Any amino acid
  MOD_RES (426)..(446): Any amino acid
  MOD_RES (470)..(471): Any amino acid
XNPNQKLFTLSGVAVALSXMNLLIGISNVGLKVSLHLKEKGAKQEEXXXXXXXNQNNTTVVENKYVNNTTIINKXXXXXXXXYLVLNKSLCKXXXXXVIAKDNAIRFGEGEQIIVTRXPYVSCDPSGCKMYALXXXXXXXXXXXXXXXXXXXXXXXLISTPLGTPPTVSNSDFMCVGWSSTSCHDGVGRMTICVQGNNNNATATVYYERRLTTTIKTWARNILRXXXXXXXXHNGTCVVVMTDGSANSQAYTKVLYFHKGIVIKEEALQGSARHIEECPCYGHNQKITCVCRDNXXGANRPVIKIDMXVMEHTSQYICXXXXXDTSKPSDKXXXXXXXXXXXXXXXXXXKGFGFLDGSNTWLGRTISPHSRSGXXMLKIPNAETDPNSXIAERQEIVDNRNWSGYSGSFIDYWDDXSVCYNPCFYXXXXXXXXXXXXXXXXXXXXXVALCGSPVSVGSGSFPNGAQIQYXX

SEQ ID NO: 418400 - protein, 471 aa, Influenza virus
  MOD_RES (1)..(1): Any amino acid
  MOD_RES (19)..(19): Any amino acid
  MOD_RES (28)..(38): Any amino acid
  MOD_RES (47)..(53): Any amino acid
  MOD_RES (75)..(82): Any amino acid
  MOD_RES (95)..(121): Any amino acid
  MOD_RES (137)..(159): Any amino acid
  MOD_RES (174)..(186): Any amino acid
  MOD_RES (229)..(237): Any amino acid
  MOD_RES (293)..(298): Any amino acid
  MOD_RES (308)..(308): Any amino acid
  MOD_RES (332)..(349): Any amino acid
  MOD_RES (358)..(358): Any amino acid
  MOD_RES (372)..(376): Any amino acid
  MOD_RES (389)..(389): Any amino acid
  MOD_RES (409)..(416): Any amino acid
  MOD_RES (426)..(447): Any amino acid
  MOD_RES (471)..(471): Any amino acid
XNPNQNLFTLSGVAITLSXFNLLIGISXXXXXXXXXXXERGTKQEEXXXXXXXTGTAKQNYENTYVNKTTVINKXXXXXXXXYLMLSKSLCKVEXXXXXXXXXXXXXXXXXXXXXXXXXXXSCDPLGCRMYALHQGXXXXXXXXXXXXXXXXXXXXXXXTPLGSPPMVSNSDFXXXXXXXXXXXXXVGRMTICIQGNNKNATATVYYNGRLTTTIKTWAGKILRTQESXXXXXXXXXVVIMTDGPANSQAYTKIMYFHKGLIIKEEVLKGSARHVEECSCYGHSQKVTCVCRXXXXXXNRPVIEINMXAMDHTSQYLCTGILTDTSRPGDRXXXXXXXXXXXXXXXXXXKGFGFLDNXNTWLGGTISPRSRXXXXXLKIPNAGIDPNSXITERQEVVDNNNLSGYSGSXXXXXXXXSKCYNPCFYXXXXXXXXXXXXXXXXXXXXXXALCGSPVPVGSGSFPDGAKIQYFX

SEQ ID NO: 418401 - protein, 471 aa, Influenza virus
  MOD_RES (1)..(7): Any amino acid
  MOD_RES (17)..(65): Any amino acid
  MOD_RES (74)..(84): Any amino acid
  MOD_RES (100)..(122): Any amino acid
  MOD_RES (133)..(164): Any amino acid
  MOD_RES (180)..(189): Any amino acid
  MOD_RES (199)..(203): Any amino acid
  MOD_RES (216)..(239): Any amino acid
  MOD_RES (248)..(248): Any amino acid
  MOD_RES (263)..(263): Any amino acid
  MOD_RES (275)..(277): Any amino acid
  MOD_RES (290)..(298): Any amino acid
  MOD_RES (307)..(309): Any amino acid
  MOD_RES (319)..(379): Any amino acid
  MOD_RES (389)..(389): Any amino acid
  MOD_RES (409)..(416): Any amino acid
  MOD_RES (426)..(471): Any amino acid
XXXXXXXFALSGVAVAXXXXXXXXXXXXXXXXXXXXXXXXXXXXXXXXXXXXXXXXXXXXXXXXXVNNTTVISXXXXXXXXXXXLLNKSLCSVEGWVVIXXXXXXXXXXXXXXXXXXXXXXXCDPIGCKMYAXXXXXXXXXXXXXXXXXXXXXXXXXXXXXXXXPPIVSNSEFLCVGWSXXXXXXXXXXMIICIQGNNXXXXXTVYYNRRPTTTIXXXXXXXXXXXXXXXXXXXXXXXXIMTDGSANXQAHTKVLYFHKGLIXKEETLKGSARHXXXCSCYGHNQKVTCXXXXXXXXXNRPIIEINXXXMKHTSQYLCXXXXXXXXXXXXXXXXXXXXXXXXXXXXXXXXXXXXXXXXXXXXXXXXXXXXXXXXXXXXXPNAETDPSSXIIERQEIVDNSDWSGYSGSXXXXXXXXSACYNPCFYXXXXXXXXXXXXXXXXXXXXXXXXXXXXXXXXXXXXXXXXXXXXXX

SEQ ID NO: 418402 - protein, 471 aa, Influenza virus
  MOD_RES (1)..(8): Any amino acid
  MOD_RES (19)..(66): Any amino acid
  MOD_RES (75)..(87): Any amino acid
  MOD_RES (97)..(125): Any amino acid
  MOD_RES (134)..(191): Any amino acid
  MOD_RES (202)..(240): Any amino acid
  MOD_RES (267)..(279): Any amino acid
  MOD_RES (289)..(299): Any amino acid
  MOD_RES (308)..(471): Any amino acid
XXXXXXXXALSGMAIALSXXXXXXXXXXXXXXXXXXXXXXXXXXXXXXXXXXXXXXXXXXXXXXXXNNTTIISKXXXXXXXXXXXXXKRLCKVEGWXXXXXXXXXXXXXXXXXXXXXXXXXXXXXLGCKTYALXXXXXXXXXXXXXXXXXXXXXXXXXXXXXXXXXXXXXXXXXXXXXXXXXXXXXXXXXXICVQGNNKNAXXXXXXXXXXXXXXXXXXXXXXXXXXXXXXXXXXXXXXXMTDGPASSQAYTKILYFHKGLLIKEEXXXXXXXXXXXXXCYGHSQKATXXXXXXXXXXXRPAIEIDMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418403 - protein, 471 aa, Influenza virus
  MOD_RES (1)..(8): Any amino acid
  MOD_RES (17)..(243): Any amino acid
  MOD_RES (255)..(471): Any amino acid
XXXXXXXXALSGVAITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSASSQAHTKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418404 - protein, 471 aa, Influenza virus
  MOD_RES (1)..(9): Any amino acid
  MOD_RES (19)..(248): Any amino acid
  MOD_RES (259)..(471): Any amino acid
XXXXXXXXXLSGVAISLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQAHTKILYFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418405 - protein, 565 aa, Influenza virus
  MOD_RES (1)..(14): Any amino acid
  MOD_RES (113)..(113): Any amino acid
  MOD_RES (122)..(157): Any amino acid
  MOD_RES (177)..(177): Any amino acid
  MOD_RES (190)..(204): Any amino acid
  MOD_RES (215)..(234): Any amino acid
  MOD_RES (250)..(254): Any amino acid
  MOD_RES (275)..(275): Any amino acid
  MOD_RES (286)..(289): Any amino acid
  MOD_RES (387)..(394): Any amino acid
  MOD_RES (403)..(414): Any amino acid
  MOD_RES (424)..(430): Any amino acid
  MOD_RES (522)..(523): Any amino acid
  MOD_RES (550)..(551): Any amino acid
XXXXXXXXXXXXXXQADEICIGYLSNNSTEKVDTIIESNVTVTSSVELVENEHTGSFCSIDGKAPISLGDCSFAGWILGNPMCDDLIGKTSWSYIVEKPNPTNGICYPGTLEXEEELRLKFXXXXXXXXXXXXXXXXXXXXXXXXXXXXXXXXXXXXSFFRNMVWLIHQSGTYPVIXRTFNNTKGRDVLXXXXXXXXXXXXXXXDLYKKDSSYVXXXXXXXXXXXXXXXXXXXXVNGQAGRMTFYWTIVXXXXXITFESNGAFLAPRYAFELVSXGNGKLFRSDLXXXXCSTKCQSEIGGINTNRSFHNVHRNTIGDCPKYVNVKSLKLATGLRNVPAIATRGLFGAIAGFIEGGWPGLINGWYGFQHRNEEGTGIAADKESTQKAXXXXXXXXNNIVDRMNXXXXXXXXXXXXIEERINQLSXXXXXXXIDIWSYNAQLLVLLENEKTLDLHDSNVRNLHEKVRRMLKDNAKDEGNGCFTFYHKCDNECIEKVRNGTYDHKEFEEESKLNRQEIEGVKLDXXGNVYKILSIYSCIASSLVLAAIIMGFXXWACSNGSCRCTICI

SEQ ID NO: 418406 - protein, 565 aa, Influenza virus
  MOD_RES (1)..(14): Any amino acid
  MOD_RES (113)..(113): Any amino acid
  MOD_RES (122)..(157): Any amino acid
  MOD_RES (177)..(177): Any amino acid
  MOD_RES (190)..(204): Any amino acid
  MOD_RES (215)..(234): Any amino acid
  MOD_RES (250)..(254): Any amino acid
  MOD_RES (275)..(275): Any amino acid
  MOD_RES (286)..(289): Any amino acid
  MOD_RES (349)..(363): Any amino acid
  MOD_RES (387)..(394): Any amino acid
  MOD_RES (403)..(414): Any amino acid
  MOD_RES (424)..(430): Any amino acid
  MOD_RES (446)..(450): Any amino acid
  MOD_RES (477)..(477): Any amino acid
  MOD_RES (522)..(523): Any amino acid
  MOD_RES (550)..(551): Any amino acid
  MOD_RES (561)..(565): Any amino acid
XXXXXXXXXXXXXXKADEICIGYMSNNSTEKVDTIIENNVTVTSSIELVENGHTGSFCSLDGKAPISLGGCSFAGWLLGNPMCDELIGKTSWSYIVEKLNPANGICYPGSLDXEEELKLKFXXXXXXXXXXXXXXXXXXXXXXXXXXXXXXXXXXXXSFFRHMVWLIYQSGTYPVVXRTFNNIKGRDVLXXXXXXXXXXXXXXXDLYKKDNSYVXXXXXXXXXXXXXXXXXXXXINGQAGRMTFYWKIVXXXXXITFESDGAFLAPRYSFELVSXGNGKLFKSELXXXXCSTKCQTEIGGINTTKSFHSVHRNTIGNCPKYVNVRSLKLATGPRNVPAIASRGLFGAIXXXXXXXXXXXXXXXYGFQHRNDEGTGIAADRESTQKAXXXXXXXXNKIVDRMNXXXXXXXXXXXXIEERINHLSXXXXXXXVDIWSYNARLLVLLEXXXXXDLHDSNVTNLHERVRRMLRDNAKDEGXGCFPFYHKCDNKCIERVRNGTYDHKEFKEESKINRQEIEGVRLDXXGNIYKILSIYSCVASSLILAAIIMGLXXWTCSNGSCRXXXXX

SEQ ID NO: 418407 - protein, 565 aa, Influenza virus
  MOD_RES (1)..(14): Any amino acid
  MOD_RES (48)..(51): Any amino acid
  MOD_RES (113)..(113): Any amino acid
  MOD_RES (122)..(157): Any amino acid
  MOD_RES (177)..(177): Any amino acid
  MOD_RES (189)..(204): Any amino acid
  MOD_RES (215)..(239): Any amino acid
  MOD_RES (250)..(254): Any amino acid
  MOD_RES (275)..(275): Any amino acid
  MOD_RES (286)..(289): Any amino acid
  MOD_RES (303)..(305): Any amino acid
  MOD_RES (349)..(366): Any amino acid
  MOD_RES (387)..(394): Any amino acid
  MOD_RES (403)..(414): Any amino acid
  MOD_RES (423)..(430): Any amino acid
  MOD_RES (451)..(451): Any amino acid
  MOD_RES (478)..(478): Any amino acid
  MOD_RES (497)..(498): Any amino acid
  MOD_RES (522)..(523): Any amino acid
  MOD_RES (550)..(551): Any amino acid
  MOD_RES (563)..(565): Any amino acid
XXXXXXXXXXXXXXRADEICIGHLSNNSTDKVDTIIESNVTVTNSVEXXXXKHTGSFCSINGKQPISLGDCSFTGWILGNPRCDDLIGKNSWSYIVEKSNPVNGICYPGILEXEEELRLTFXXXXXXXXXXXXXXXXXXXXXXXXXXXXXXXXXXXXAFFRNMVWLVHQSGTYPIIXRTFKNTKGRDVXXXXXXXXXXXXXXXXNLYKKDSSYIXXXXXXXXXXXXXXXXXXXXXXXXXGRMTFYWAIVXXXXXMTFESNGAFIAPRYAFEIVSXGSGKLFRSELXXXXCSTRCQSEIGGISXXXSFQNVHRNTIGDCPKYMNVKSLKLASGLRNVPAISARGLFGAIXXXXXXXXXXXXXXXXXXQHRDEEGTGIAADKESTQTAXXXXXXXXNNIVDWMNXXXXXXXXXXXXIEEGINQLXXXXXXXXINIWSYNAQLLVWLENEKTLXLHDSNVRSLHEKVRRILKGNAKDEGNXCFTFYHRCDNECIERVRNXXYDHKEFEKESKLNRQEIGGVKLDXXSNVYKILSICSCIASSLILAALIMGFXXWACNNGSCRCTXXX

SEQ ID NO: 418408 - protein, 565 aa, Influenza virus
  MOD_RES (1)..(15): Any amino acid
  MOD_RES (41)..(43): Any amino acid
  MOD_RES (69)..(69): Any amino acid
  MOD_RES (113)..(113): Any amino acid
  MOD_RES (122)..(157): Any amino acid
  MOD_RES (177)..(177): Any amino acid
  MOD_RES (189)..(204): Any amino acid
  MOD_RES (215)..(240): Any amino acid
  MOD_RES (250)..(254): Any amino acid
  MOD_RES (275)..(275): Any amino acid
  MOD_RES (286)..(289): Any amino acid
  MOD_RES (356)..(368): Any amino acid
  MOD_RES (377)..(377): Any amino acid
  MOD_RES (387)..(394): Any amino acid
  MOD_RES (403)..(414): Any amino acid
  MOD_RES (424)..(430): Any amino acid
  MOD_RES (447)..(451): Any amino acid
  MOD_RES (477)..(479): Any amino acid
  MOD_RES (510)..(510): Any amino acid
  MOD_RES (521)..(537): Any amino acid
  MOD_RES (549)..(551): Any amino acid
  MOD_RES (561)..(565): Any amino acid
XXXXXXXXXXXXXXXADKICIGYLSNNSTDKVNTIIENNVXXXSSVELVETMHTGSFCSINGKAPISLXDCSFAGWLLGNPMCDYLIGKTSWSYIVEKTNPINGICYPGSLEXEEGLRLKFXXXXXXXXXXXXXXXXXXXXXXXXXXXXXXXXXXXXSFFRNMIWLIHQSETYPVIXRIFNNTKGGDVXXXXXXXXXXXXXXXXDLYKKDISYVXXXXXXXXXXXXXXXXXXXXXXXXXXRMTFYWTMVXXXXXVTFESNGALLAPRYAFELVFXGKGKLFRSNLXXXXCSIKCQSEIGWINTNRSFHNVHRSTIGDCPKYVNIKSLKLATGLRNIPAIASRGLFGAKAGFIEGGXXXXXXXXXXXXXRNEEGTGVXADKESTQEAXXXXXXXXNNIIDRMNXXXXXXXXXXXXIEERINRLSXXXXXXXLDIWSYNAKLLVLLENXXXXXLHDSNVKNLHEKIRRMLQDNAKDEGXXXFTFYHKCNNECIEKIRNGTYDHKDFEEESKXNRQEVEGVKLXXXXXXXXXXXXXXXXXSSLVLAALIMGXXXWVCSNGSCRXXXXX

SEQ ID NO: 418409 - protein, 565 aa, Influenza virus
  MOD_RES (1)..(23): Any amino acid
  MOD_RES (39)..(51): Any amino acid
  MOD_RES (71)..(77): Any amino acid
  MOD_RES (101)..(162): Any amino acid
  MOD_RES (175)..(177): Any amino acid
  MOD_RES (190)..(204): Any amino acid
  MOD_RES (213)..(241): Any amino acid
  MOD_RES (250)..(254): Any amino acid
  MOD_RES (275)..(275): Any amino acid
  MOD_RES (286)..(289): Any amino acid
  MOD_RES (322)..(323): Any amino acid
  MOD_RES (341)..(378): Any amino acid
  MOD_RES (387)..(394): Any amino acid
  MOD_RES (403)..(414): Any amino acid
  MOD_RES (424)..(430): Any amino acid
  MOD_RES (441)..(455): Any amino acid
  MOD_RES (464)..(467): Any amino acid
  MOD_RES (478)..(480): Any amino acid
  MOD_RES (496)..(501): Any amino acid
  MOD_RES (522)..(537): Any amino acid
  MOD_RES (550)..(551): Any amino acid
  MOD_RES (563)..(565): Any amino acid
XXXXXXXXXXXXXXXXXXXXXXXLSNNSTERVDTIIESXXXXXXXXXXXXXEYTGSFCSINGRAPISLGDXXXXXXXLGNPMCDNLIGKTSWSYIVERPNXXXXXXXXXXXXXXXXXXXXXXXXXXXXXXXXXXXXXXXXXXXXXXXXXXXXXXXXXXXXXXMVWLTHQSGTYPXXXRTFNNTKERDVLXXXXXXXXXXXXXXXSLYKKDNSXXXXXXXXXXXXXXXXXXXXXXXXXXXXXMTFYWTIIXXXXXIIFESNGAFLAPGYAFEIVSXGNGTLFRSDLXXXXCSTKCQTGIGGINTNKSLHNVHRNTFGDCPKYXXVKSLKLVTGLRNVPAITXXXXXXXXXXXXXXXXXXXXXXXXXXXXXXXXXXXXXXDKESTQKTXXXXXXXXNNIVDQMNXXXXXXXXXXXXIGERINQLSXXXXXXXIDLWSYNAQLXXXXXXXXXXXXXXXNVRNLHERXXXXLKNNAKDEGNXXXTFYHKCDDECIEKVRXXXXXXKEFEEESRLNRQEIEGVKLNXXXXXXXXXXXXXXXXSSLVLAASIMGFXXWACGNGSCRCTXXX

SEQ ID NO: 418410 - protein, 565 aa, Influenza virus
  MOD_RES (1)..(32): Any amino acid
  MOD_RES (41)..(52): Any amino acid
  MOD_RES (72)..(82): Any amino acid
  MOD_RES (95)..(164): Any amino acid
  MOD_RES (175)..(180): Any amino acid
  MOD_RES (190)..(205): Any amino acid
  MOD_RES (215)..(255): Any amino acid
  MOD_RES (274)..(292): Any amino acid
  MOD_RES (322)..(325): Any amino acid
  MOD_RES (337)..(415): Any amino acid
  MOD_RES (424)..(458): Any amino acid
  MOD_RES (469)..(481): Any amino acid
  MOD_RES (493)..(501): Any amino acid
  MOD_RES (522)..(538): Any amino acid
  MOD_RES (550)..(565): Any amino acid
XXXXXXXXXXXXXXXXXXXXXXXXXXXXXXXXNTIIESNVXXXXXXXXXXXXHTGTFCSINGKEPISLGDCXXXXXXXXXXXCDDLIEKTSWSYXXXXXXXXXXXXXXXXXXXXXXXXXXXXXXXXXXXXXXXXXXXXXXXXXXXXXXXXXXXXXXXXXXXXXXWLIDQSGTYPXXXXXXNNTKGRYVLXXXXXXXXXXXXXXXXLYKKDTSYVXXXXXXXXXXXXXXXXXXXXXXXXXXXXXXXXXXXXXXXXXTFESNGVFLAPRYALELVXXXXXXXXXXXXXXXXXXXKCQTEVGGINTNKNFHNVHRNAIGDCPKYXXXXSLKLAIGPRNVXXXXXXXXXXXXXXXXXXXXXXXXXXXXXXXXXXXXXXXXXXXXXXXXXXXXXXXXXXXXXXXXXXXXXXXXXXXXXXXEKRINQLSXXXXXXXXXXXXXXXXXXXXXXXXXXXXXXXXXXXNLHEKVRQMLXXXXXXXXXXXXXFYHKCDNGCIEXXXXXXXXXKEFEKESRLNRQEIEGARLDXXXXXXXXXXXXXXXXXSLVLAALNMGFXXXXXXXXXXXXXXXX

SEQ ID NO: 418411 - protein, 565 aa, Influenza virus
  MOD_RES (1)..(505): Any amino acid
  MOD_RES (517)..(565): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEESRINRQEIEXXXXXXXXXXXXXXXXXXXXXXXXXXXXXXXXXXXXXXXXXXXXXXXXX

SEQ ID NO: 418412 - protein, 564 aa, Influenza virus
  MOD_RES (10)..(14): Any amino acid
  MOD_RES (57)..(60): Any amino acid
  MOD_RES (189)..(189): Any amino acid
  MOD_RES (205)..(219): Any amino acid
  MOD_RES (289)..(291): Any amino acid
  MOD_RES (406)..(410): Any amino acid
  MOD_RES (489)..(492): Any amino acid
MEKFIILSTXXXXXFAYDKICIGYQTNNSTETVNTLIEQNVPVTQVEELVHGGIDPXXXXTELGSPLVLDDCSLEGLILGNPKCDLYLNGREWSYIVERPKEMEGICYPGSIENQEELRSLFSSIKKYERVKMFDFTKWNVTYTGTSKACNNTSNQGSFYRSMRWLTLKSGQFPVQTDEYKNTRDSDIXFTWAIHHPPTSDEQVXXXXXXXXXXXXXXXEINRSFKPNIGPRPLVRGQQGRMDYYWAVLKPGQTVKIQTNGNLIAPEYGHLITGKSHGRILKNNLPIGXXXTECQLNEGVMNTSKPFQNTSKHYIGKCPKYIPSGSLKLAIGLRNVPQAQDRGLFGAIAGFIEGGWPGLVAGWYGFQHQNAEGTGIAADRDSTQKAIDNMQNKLNNVIDKMNKQFXXXXXEFSEVESRINMINSKIDDQITDIWAYNAELLVLLENQKTLDEHDANVRNLHDRVRRVLRENAIDTGDGCFEILHKCDNXXXXTIRNGTYNHKEYEEESKIERQKINGVKLEENSTYKILSIYSSVASSLVLLLMIIGGFIFGCQNGNVRCTFCI

SEQ ID NO: 418413 - protein, 564 aa, Influenza virus
  MOD_RES (10)..(14): Any amino acid
  MOD_RES (23)..(23): Any amino acid
  MOD_RES (57)..(60): Any amino acid
  MOD_RES (128)..(129): Any amino acid
  MOD_RES (172)..(176): Any amino acid
  MOD_RES (189)..(189): Any amino acid
  MOD_RES (205)..(219): Any amino acid
  MOD_RES (289)..(291): Any amino acid
  MOD_RES (363)..(363): Any amino acid
  MOD_RES (406)..(410): Any amino acid
  MOD_RES (449)..(454): Any amino acid
  MOD_RES (489)..(492): Any amino acid
  MOD_RES (524)..(535): Any amino acid
MEKFIVLSIXXXXXLAYDKICIXYQTNNSTDTVNTLIEQNIPVTQVEELVHRGIDPXXXXTELGAPLVLDDCSLKGLILGNPKCDPYLNGREWSYIVERTKEMEGICYPGSVENQEELRFLFSSIKKXXRVKMFDFSKWNVTYTGISKACNDTSNQDSFYRSMKWLTLKSGXXXXXTDEYKNTGDSDIXFMWAIHHPPTTDEQMXXXXXXXXXXXXXXXEINRSFRPNIGPRPFVRGQQGRMDYYWAILKPGQTVKIKTNGNLIAPEYGYLITGKSHGRVLKNNLPVGXXXTGCQLNEGVINTSKPFQNICKPYIGKCPKYISSGSLKLAIGPRNVPQAQNRGLFGAIAGFIEGRWPGLVAGXYGFQHQNSEGTGIAADRGSTQKAIDIMQNKLNNVIDKMYKQFXXXXXEFSKVETRINMINSQIDDQIIDIWAYNAELIVLLENQKXXXXXXANVRNLHERIRRVLKENAIDAGDGCFEILHRCDDXXXXTIKNGTYNHQDYEEESKLERQKISGVKLEENXXXXXXXXXXXXASSLVLLFMIIGGFIFGCQNGNIRCTFCI

SEQ ID NO: 418414 - protein, 564 aa, Influenza virus
  MOD_RES (10)..(14): Any amino acid
  MOD_RES (23)..(29): Any amino acid
  MOD_RES (45)..(45): Any amino acid
  MOD_RES (57)..(60): Any amino acid
  MOD_RES (178)..(179): Any amino acid
  MOD_RES (189)..(189): Any amino acid
  MOD_RES (205)..(219): Any amino acid
  MOD_RES (243)..(252): Any amino acid
  MOD_RES (289)..(291): Any amino acid
  MOD_RES (328)..(331): Any amino acid
  MOD_RES (356)..(366): Any amino acid
  MOD_RES (406)..(410): Any amino acid
  MOD_RES (438)..(456): Any amino acid
  MOD_RES (489)..(492): Any amino acid
  MOD_RES (516)..(564): Any amino acid
MEKFITLSTXXXXXVAYDKICIXXXXXXXTETVNTLSEQNVPVTXVEELVHGQVNPXXXXTKLGSPLVLDDCSLEGIILGNPKCDLYLSGREWSYIVERPKEIEGICYPGSIKNQEELRSLFSSIKRYERVKMFDFIKWNVTYTGTSRACNNTSNRGSFYRSMRWLTLKLGQFPVQTXXYKNTRDSNIXFIWAIHHPPTSNEQVXXXXXXXXXXXXXXXEINRIFRPNIGPRPLIRGQQGRMXXXXXXXXXXQTVKIQTSGNLIAPEYGHLVTGKSHGRILKNDLPVGXXXTKCQLNEGVMNTSKPLQNTSKHYIGKCPRYIPSGSLXXXXGLRNVPQVQNRGLFGAKAGFIEGGXXXXXXXXXXXQHQNAEGIGIAADRDSTQRAIDNMQNRLNNVIDKMNNQFXXXXXEFSEVETRINTINSKIDDQVTDIWAYNXXXXXXXXXXXXXXXXXXXVRNLHDRIRRILKENAIDNGDGCFEILHRCNDXXXXTIRTGTYNHREYEEESRIERQKIXXXXXXXXXXXXXXXXXXXXXXXXXXXXXXXXXXXXXXXXXXXXXXXXX

SEQ ID NO: 418415 - protein, 564 aa, Influenza virus
  MOD_RES (10)..(29): Any amino acid
  MOD_RES (45)..(46): Any amino acid
  MOD_RES (57)..(70): Any amino acid
  MOD_RES (86)..(98): Any amino acid
  MOD_RES (127)..(135): Any amino acid
  MOD_RES (179)..(193): Any amino acid
  MOD_RES (205)..(219): Any amino acid
  MOD_RES (244)..(264): Any amino acid
  MOD_RES (280)..(280): Any amino acid
  MOD_RES (289)..(292): Any amino acid
  MOD_RES (347)..(368): Any amino acid
  MOD_RES (393)..(397): Any amino acid
  MOD_RES (406)..(410): Any amino acid
  MOD_RES (435)..(456): Any amino acid
  MOD_RES (489)..(494): Any amino acid
  MOD_RES (503)..(503): Any amino acid
  MOD_RES (522)..(564): Any amino acid
MKKFIILSTXXXXXXXXXXXXXXXXXXXXTETVNTLTEQNVPVTXXEELVHGGVDPXXXXXXXXXXXXXXDCSLEGLVLGNPKCDXXXXXXXXXXXXXRPKEMEGVCYPGSIENQEELKSLFSSIKXXXXXXXXXFTKWNVTHTGTSKACNDISNQGSFYRNMRWLTLKSEQFPVQTDXXXXXXXXXXXXXXXIHHPPTSAEQVXXXXXXXXXXXXXXXEIDRSFRPNIGPRPLVMGQQGRMDXXXXXXXXXXXXXXXXXXXXXAPEYGHLTTGKSHGRXLKNNLPMGXXXXECQLNEGIMNTSKPFQNTSRHYIGKCPKYIPSNSLKLAIGLRNVPQIQNRGLFGXXXXXXXXXXXXXXXXXXXXXXQNAEGTGMAADRDSTQMAIDNMQNXXXXXIDKMNKQLXXXXXEFSEVGSRINMINSKINDQITDIWXXXXXXXXXXXXXXXXXXXXXXVRNLHDRTRRILKENALDTGDGCFEILHKCNDXXXXXXRNGTYNHRXYEDESRIERQRINGVKLEXXXXXXXXXXXXXXXXXXXXXXXXXXXXXXXXXXXXXXXXXXX

SEQ ID NO: 418416 - protein, 564 aa, Influenza virus
  MOD_RES (1)..(1): Any amino acid
  MOD_RES (10)..(29): Any amino acid
  MOD_RES (39)..(47): Any amino acid
  MOD_RES (57)..(72): Any amino acid
  MOD_RES (88)..(105): Any amino acid
  MOD_RES (114)..(146): Any amino acid
  MOD_RES (171)..(196): Any amino acid
  MOD_RES (205)..(219): Any amino acid
  MOD_RES (245)..(280): Any amino acid
  MOD_RES (289)..(317): Any amino acid
  MOD_RES (349)..(369): Any amino acid
  MOD_RES (385)..(410): Any amino acid
  MOD_RES (435)..(457): Any amino acid
  MOD_RES (489)..(494): Any amino acid
  MOD_RES (506)..(506): Any amino acid
  MOD_RES (516)..(564): Any amino acid
XEKFIVLSVXXXXXXXXXXXXXXXXXXXXTDTVNTLTEXXXXXXXXXELVHGGINPXXXXXXXXXXXXXXXXSLEGLILSNPKCDLYXXXXXXXXXXXXXXXXXXVCYPGSIKXXXXXXXXXXXXXXXXXXXXXXXXXXXXXXXXXSKACNSISNQGSFYRSIRWLTLKSXXXXXXXXXXXXXXXXXXXXXXXXXXPPTSDEQIXXXXXXXXXXXXXXXEINRNFKPNIGPRPLVREQQGRMDYXXXXXXXXXXXXXXXXXXXXXXXXXXXXXXXXXXXXLKNDLPIGXXXXXXXXXXXXXXXXXXXXXXXXXXXXXCPKYIPSRSLKLAIGPRNVPQVQDRGLFGAKXXXXXXXXXXXXXXXXXXXXXNSEGTGIVADRDSTQXXXXXXXXXXXXXXXXXXXXXXXXXXEFSEVEIRINMINSKIEDQITDIWXXXXXXXXXXXXXXXXXXXXXXXRNLHDRVKRILKENAVDTGDGCFEILHKCDDXXXXXXRNGTYNHQEYEXESKLERQRIXXXXXXXXXXXXXXXXXXXXXXXXXXXXXXXXXXXXXXXXXXXXXXXXX

SEQ ID NO: 418417 - protein, 564 aa, Influenza virus
  MOD_RES (1)..(414): Any amino acid
  MOD_RES (425)..(464): Any amino acid
  MOD_RES (475)..(496): Any amino acid
  MOD_RES (506)..(507): Any amino acid
  MOD_RES (523)..(564): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVESRINTINSXXXXXXXXXXXXXXXXXXXXXXXXXXXXXXXXXXXXXXXXKRVLRENAVDXXXXXXXXXXXXXXXXXXXXXXGTYNHKDYEXXSKIERQKVNGVKLEEXXXXXXXXXXXXXXXXXXXXXXXXXXXXXXXXXXXXXXXXXX

SEQ ID NO: 418418 - protein, 567 aa, Influenza virus
  MOD_RES (1)..(17): Any amino acid
  MOD_RES (86)..(89): Any amino acid
  MOD_RES (147)..(154): Any amino acid
  MOD_RES (169)..(172): Any amino acid
  MOD_RES (202)..(212): Any amino acid
  MOD_RES (225)..(231): Any amino acid
  MOD_RES (251)..(256): Any amino acid
  MOD_RES (289)..(290): Any amino acid
  MOD_RES (341)..(343): Any amino acid
  MOD_RES (469)..(472): Any amino acid
  MOD_RES (565)..(567): Any amino acid
XXXXXXXXXXXXXXXXXADRICVGYLSTNSSERVDTLLENGVPVTSSVDLVETNHTGTYCSLNGISPVHLGDCSFEGWIVGNPACXXXXGIREWSYLIEDPSAPHGLCYPGELDNNGELRHLFSGIRSFSRTELIAPTSWGEVLDGXXXXXXXXKGTNSFYRNLVWFVXXXXGGYPVIKKTYNNTTGRDVLVLWGIHHPVSXXXXXXXXXXXDPYTLVSTSSWSXXXXXXXGVRPGYNGQKSWMKIYWSLXXXXXXITFESNGGLLAPRYGYIIEEYGKGRIFQSRIRXXKCNTKCQTSVGGINTNKTFQNIERNALGDCPKYIKSGQLKLATGLRNVPAXXXRGLFGAIAGFIEGGWPGLINGWYGFQHQNEQGVGMAADKESTQKAIDQITTKINNIIDKMNGNYDSIRGEFNQVEKRINMLADRIDDAVTDVWSYNAKLLVLLENDKTLDMHDANVRNLHDQVRRXXXXNAIDEGNGCFELLHKCNDSCMETIRNGTYNHTEYAEESKLKRQEIEGIKLKSEDNVYKALSIYSCIASSVVLVGLILAFIMWACSSGNCRFNXXX

SEQ ID NO: 418419 - protein, 567 aa, Influenza virus
  MOD_RES (1)..(17): Any amino acid
  MOD_RES (86)..(89): Any amino acid
  MOD_RES (147)..(154): Any amino acid
  MOD_RES (169)..(179): Any amino acid
  MOD_RES (202)..(212): Any amino acid
  MOD_RES (225)..(231): Any amino acid
  MOD_RES (251)..(256): Any amino acid
  MOD_RES (289)..(290): Any amino acid
  MOD_RES (341)..(343): Any amino acid
  MOD_RES (355)..(368): Any amino acid
  MOD_RES (427)..(427): Any amino acid
  MOD_RES (443)..(445): Any amino acid
  MOD_RES (469)..(472): Any amino acid
  MOD_RES (565)..(567): Any amino acid
XXXXXXXXXXXXXXXXXADRICIGYLSTNSTEKVDTLLENDVPVTSSIDLIETNHTGTYCSLDGVSPVHLGDCRFEGWIVGNPSCXXXXGTREWSYLIEDPGAPHGLCYPGELNNNGELRHLFSGIKSFSRTELIPPTSWGAVNDGXXXXXXXXTGTSSFYRNLIWFVXXXXXXXXXXXGTYNNTTGRDVLVMWGIHHPLSXXXXXXXXXXXNPYTLVSTKSWSXXXXXXXGIRPGYNGQRSWMKIYWYLXXXXXXISFESNGGLLAPKYGYIIEEYGRGRIFQSRIIXXRCNTKCQTSVGGIDTNKTFQNIDKNALGDCPKYIKSDQLKLATGLKNVPAXXXRGLLGAIAGFIXXXXXXXXXXXXXXQHQNEQGTGIAADKESTQKAIDRITTKINNIIEKMNGNYDSIRGEFSQVEQRINMLADXIDDAVTDIWSYNAKLXXXLENDKTLNMHDANVRNLHEQVRRXXXXNAVDEGNGCFELLHKCNNSCMETIRNGTYDHTEYEEESKLKRQEINGIKLKSDDSVYKALSIYSCIASSIVLVGLILSFIMWACSNGSCRFNXXX

SEQ ID NO: 418420 - protein, 567 aa, Influenza virus
  MOD_RES (1)..(17): Any amino acid
  MOD_RES (65)..(66): Any amino acid
  MOD_RES (82)..(89): Any amino acid
  MOD_RES (110)..(125): Any amino acid
  MOD_RES (147)..(154): Any amino acid
  MOD_RES (169)..(179): Any amino acid
  MOD_RES (202)..(212): Any amino acid
  MOD_RES (225)..(231): Any amino acid
  MOD_RES (251)..(256): Any amino acid
  MOD_RES (273)..(278): Any amino acid
  MOD_RES (289)..(290): Any amino acid
  MOD_RES (327)..(330): Any amino acid
  MOD_RES (341)..(343): Any amino acid
  MOD_RES (357)..(368): Any amino acid
  MOD_RES (384)..(411): Any amino acid
  MOD_RES (427)..(433): Any amino acid
  MOD_RES (469)..(472): Any amino acid
  MOD_RES (533)..(536): Any amino acid
  MOD_RES (565)..(567): Any amino acid
XXXXXXXXXXXXXXXXXADKICVGYLSTNSSDKVDTLLESDVPVTSSVDLIETTHTGTYCSLGGXXPVHLGDCNFEGWIVGXXXXXXXXGVREWSYLIEDPAAPHGLCYXXXXXXXXXXXXXXXXIKSFSRTQLIAPASWGEVNDGXXXXXXXXTGTNSFYRNLAWFVXXXXXXXXXXXRTYNNTTGRDVLVIWGIHHPISXXXXXXXXXXXDPYTLVTTSSWSXXXXXXXGTRPGYNGQKSWTKIYWYLXXXXXXVSFESNGGFLAPRYGYXXXXXXKGRIFQSPIRXXRCNTRCQTSVGGINTNRTFQNIDKNALGECPKYIKSXXXXLATGLRNIPAXXXRAVDGTIAGFIEGXXXXXXXXXXXXQHQNEQGMGMAADKEXXXXXXXXXXXXXXXXXXXXXXXXXXXXGEFNQVENRINMLADXXXXXXXDIWSYNARLLVLLENDKTLDLHDANVRNLHDQIRRXXXXNAINEGNGCFELLHKCNNTCMETIRNGTYNHAKYEEESKLKRQEIDGIKLKSDDNVYKALXXXXCIASSIVMVGLILAFIMWTCNSGNCRFNXXX

SEQ ID NO: 418421 - protein, 567 aa, Influenza virus
  MOD_RES (1)..(25): Any amino acid
  MOD_RES (65)..(72): Any amino acid
  MOD_RES (86)..(94): Any amino acid
  MOD_RES (110)..(133): Any amino acid
  MOD_RES (147)..(154): Any amino acid
  MOD_RES (169)..(179): Any amino acid
  MOD_RES (202)..(213): Any amino acid
  MOD_RES (225)..(231): Any amino acid
  MOD_RES (251)..(257): Any amino acid
  MOD_RES (266)..(278): Any amino acid
  MOD_RES (289)..(306): Any amino acid
  MOD_RES (321)..(332): Any amino acid
  MOD_RES (341)..(343): Any amino acid
  MOD_RES (354)..(370): Any amino acid
  MOD_RES (384)..(411): Any amino acid
  MOD_RES (427)..(452): Any amino acid
  MOD_RES (469)..(486): Any amino acid
  MOD_RES (505)..(513): Any amino acid
  MOD_RES (535)..(539): Any amino acid
  MOD_RES (565)..(567): Any amino acid
XXXXXXXXXXXXXXXXXXXXXXXXXLSTNSSEKVDTLLENNVPVTSSIDLVETSHTGTYCSLSGXXXXXXXXCSFEGWIGGNPACXXXXXXXXXSYLIEDPTAPHGLCYXXXXXXXXXXXXXXXXXXXXXXXXLIPPASWGDLLDGXXXXXXXXKGFNSFYRNLVWLVXXXXXXXXXXXGAYNNTTGRDVLVMWGLHHPVSXXXXXXXXXXXXPYTLVSTGSWSXXXXXXXGVRPRYNGQRSWMKIYWVLXXXXXXXTFESNGGFXXXXXXXXXXXXXKGRIFQSHIRXXXXXXXXXXXXXXXXXXRTFQNIDRNALGDCXXXXXXXXXXXXTGLRNVPTXXXRGFFGAIAGFXXXXXXXXXXXXXXXXXQNEQGVGIAADKEXXXXXXXXXXXXXXXXXXXXXXXXXXXXGEFSQVERRINMLADXXXXXXXXXXXXXXXXXXXXXXXXXXDMHDANVKNLHEQVRKXXXXXXXXXXXXXXXXXXKCNDSCMDTIRNGTYNHSXXXXXXXXXRQEIEGIRLKSDDGVYKALSIXXXXXSSVVLVGPILSFIMWAGSNGNCRFNXXX

SEQ ID NO: 418422 - protein, 567 aa, Influenza virus
  MOD_RES (1)..(27): Any amino acid
  MOD_RES (54)..(98): Any amino acid
  MOD_RES (114)..(133): Any amino acid
  MOD_RES (147)..(154): Any amino acid
  MOD_RES (169)..(179): Any amino acid
  MOD_RES (189)..(213): Any amino acid
  MOD_RES (225)..(241): Any amino acid
  MOD_RES (251)..(311): Any amino acid
  MOD_RES (327)..(332): Any amino acid
  MOD_RES (341)..(373): Any amino acid
  MOD_RES (389)..(411): Any amino acid
  MOD_RES (423)..(458): Any amino acid
  MOD_RES (469)..(496): Any amino acid
  MOD_RES (505)..(515): Any amino acid
  MOD_RES (538)..(542): Any amino acid
  MOD_RES (563)..(567): Any amino acid
XXXXXXXXXXXXXXXXXXXXXXXXXXXTNSSEKVNTLLENDVPVTSTIDLIETXXXXXXXXXXXXXXXXXXXXXXXXXXXXXXXXXXXXXXXXXXXXXEDPSAPHRLCYPGELXXXXXXXXXXXXXXXXXXXXLIAPSSWGEVIDGXXXXXXXXRGTNSFYRNLVWFIXXXXXXXXXXXGVYNNTTGRXXXXXXXXXXXXXXXXXXXXXXXXXPYTLVSTRSWSXXXXXXXXXXXXXXXXXSWMKIYWDLXXXXXXXXXXXXXXXXXXXXXXXXXXXXXXXXXXXXXXXXXXXXXXXXXXXXXXXXXXXXXIERNALGNCPKYIKSXXXXXXTGLRNVPSXXXXXXXXXXXXXXXXXXXXXXXXXXXXXXXXXQGTGIAAEKESTQKAXXXXXXXXXXXXXXXXXXXXXXXGEFNQVEQRINXXXXXXXXXXXXXXXXXXXXXXXXXXXXXXXXXXXXVRNLHEQIKRXXXXXXXXXXXXXXXXXXXXXXXXXXXXRNGTYNHIXXXXXXXXXXXEIEGIKLESEDNVYRALSIYSCXXXXXVLVGLILTFIMWACNSGNCRXXXXX

SEQ ID NO: 418423 - protein, 567 aa, Influenza virus
  MOD_RES (1)..(39): Any amino acid
  MOD_RES (48)..(158): Any amino acid
  MOD_RES (167)..(521): Any amino acid
  MOD_RES (533)..(552): Any amino acid
  MOD_RES (565)..(567): Any amino acid
XXXXXXXXXXXXXXXXXXXXXXXXXXXXXXXXXXXXXXXNGVPVTSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFYRNLVWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSEDGVYKALXXXXXXXXXXXXXXXXXXXXMWACSNGNCRFHXXX

SEQ ID NO: 418424 - protein, 568 aa, Influenza virus
MIALILVALALSHTAYSQITNGTTGNPIICLGHHAVENGTSVKTLTDNHVEVVSAKELVETNHTDELCPSPLKLVDGQDCDLINGALGSPGCDRLQDTTWDVFIERPTAVDTCYPFDVPDYQSLRSILASSGSLEFIAEQFTWNGVKVDGSSSACLRGGRNSFFSRLNWLTKATNGNYGPINVTKENTGSYVRLYLWGVHHPSSDNEQTDLYKVATGRVTVSTRSDQISIVPNIGSRPRVRNQSGRISIYWTLVNPGDSIIFNSIGNLIAPRGHYKISKSTKSTVLKSDKRIGSCTSPCLTDKGSIQSDKPFQNVSRIAIGNCPKYVKQGSLMLATGMRNIPGKQAKGLFGAIAGFIENGWQGLIDGWYGFRHQNAEGTGTAADLKSTQAAIDQINGKLNRLIEKTNEKYHQIEKEFEQVEGRIQDLEKYVEDTKIDLWSYNAELLVALENQHTIDVTDSEMNKLFERVRRQLRENAEDQGNGCFEIFHQCDNNCIESIRNGTYDHNIYRDEAINNRIKINPVTLTMGYKDIILWISFSMSCFVFVALILGFVLWACQNGNIRCQICI

SEQ ID NO: 418425 - protein, 568 aa, Influenza virus
  MOD_RES (1)..(9): Any amino acid
  MOD_RES (20)..(165): Any amino acid
  MOD_RES (181)..(568): Any amino acid
XXXXXXXXXGSEHTAYSQIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLNWLTKETNGNYGPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418426 - protein, 570 aa, Influenza virus
MNTQIIVILVLGLSMVKSDKICLGHHAVANGTKVNTLTERGVEVVNATETVEITGIDKVCTKGKKAVDLGSCGILGTIIGPPQCDLHLEFKADLIIERRNSSDICYPGRFTNEEALRQIIRESGGIDKESMGFRYSGIRTDGATSACKRTVSSFYSEMKWLSSSMNNQVFPQLNQTYRNTRKEPALIVWGVHHSSSLDEQNKLYGTGNKLITVGSSKYQQSFSPSPGARPKVNGQAGRIDFHWMLLDPGDTVTFTFNGAFIAPDRATFLRSNAPSGIEYNGKSLGIQSDAQIDESCEGECFYSGGTINSPLPFQNIDSRAVGKCPRYVKQSSLPLALGMKNVPEKIRTRGLFGAIAGFIENGWEGLIDGWYGFRHQNAQGQGTAADYKSTQAAIDQITGKLNRLIEKTNKQFELIDNEFTEVEQQIGNVINWTRDSLTEIWSYNAELLVAMENQHTIDLADSEMNKLYERVRRQLRENAEEDGTGCFEIFHRCDDQCMESIRNNTYNHTEYRQEALQNRIMINPVKLSSGYKDVILWFSFGASCVMLLAIAMGLIFMCVKNGNLRCTICI

SEQ ID NO: 418427 - protein, 570 aa, Influenza virus
  MOD_RES (1)..(9): Any amino acid
  MOD_RES (48)..(49): Any amino acid
  MOD_RES (65)..(78): Any amino acid
  MOD_RES (97)..(101): Any amino acid
  MOD_RES (117)..(122): Any amino acid
  MOD_RES (147)..(154): Any amino acid
  MOD_RES (188)..(198): Any amino acid
  MOD_RES (236)..(269): Any amino acid
  MOD_RES (285)..(311): Any amino acid
  MOD_RES (331)..(339): Any amino acid
  MOD_RES (363)..(402): Any amino acid
  MOD_RES (418)..(521): Any amino acid
  MOD_RES (537)..(570): Any amino acid
XXXXXXXXXVLGLSMVRSDKICLGHHAVPNGTKVNTLTEKGVEVVNAXXTVEITGINKVCTKGKXXXXXXXXXXXXXXIGPPQCDSHLKFKADLIIXXXXXSDICYPGKFTNEEALXXXXXXSGGIDKEPMGFRYSGIKTDGATSAXXXXXXXXYSEMKWLLSSKANQVFPQLNQTYRNNRKEPALIXXXXXXXXXXXEQNKLYGAGNKLITVGSSKYRQSFSPSPGDRPKVNGQXXXXXXXXXXXXXXXXXXXXXXXXXXXXXXXXXXRSNAPSGVEYNGKSLXXXXXXXXXXXXXXXXXXXXXXXXXXXPFQNIDSWAVGRCPRYVKQXXXXXXXXXKNVPEKIHTRGLFGAKAGFIENGXXXXXXXXXXXXXXXXXXXXXXXXXXXXXXXXXXXXXXXXRLIEKTNTQFELIDNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINPVKLSGGYKDVILXXXXXXXXXXXXXXXXXXXXXXXXXXXXXXXXXX

SEQ ID NO: 418428 - protein, 570 aa, Influenza virus
  MOD_RES (1)..(157): Any amino acid
  MOD_RES (173)..(340): Any amino acid
  MOD_RES (361)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMKWLSSSGNNQVFPQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNVPEKIRVKRRPVAKAGFIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418429 - protein, 570 aa, Influenza virus
  MOD_RES (1)..(158): Any amino acid
  MOD_RES (174)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKWLLSSKDNQVFPQLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418430 - protein, 569 aa, Influenza virus
  MOD_RES (10)..(15): Any amino acid
  MOD_RES (172)..(173): Any amino acid
  MOD_RES (343)..(343): Any amino acid
  MOD_RES (471)..(471): Any amino acid
QPNDGQVLYXXXXXXGRYSKADKICIGYLSNNSSDTVDTLTENGVPVTSSVDLVETNHTGTYCSLNGVSPIHLGDCSFEGWIVGNPSCATNINIREWSYLIEDPNAPNKLCFPGELDNNGELRHLFSGVNSFSRTELISPSKWGNVLDGVTASCLDRGASSFYRNLVWLVKXXIGEYPVVKGDYNNTTGRDVLVLWGIHHPDTEATATNLYVNKNPYTLVSTKEWSKRYELEIGTRIGDGQRSWMKLYWHLMRPGERITFESNGGLLAPRYGYIIEKYGTGRIFQSGVRMAKCNTKCQTSMGGINTNKTFQNIERNALGDCPKYIKSGQLKLATGLRNVPSIXGERGLFGAIAGFIEGGWPGLINGWYGFQHQNEQGTGIAADKASTQKAIDEITTKINNIIEKMNGNYDSIRGEFNQVEKRINMLADRVDDAVTDIWSYNAKLLVLIENDRTLDLHDANVRNLHDQVKRXLKNNAIDEGDGCFNLLHKCNDSCMETIRNGTYNHEDYKEESQLKRQEIEGIKLKTEDNVYKVLSIYSCIASSIVLVGLILAFIMWACSSGNCRFNVCI

SEQ ID NO: 418431 - protein, 569 aa, Influenza virus
  MOD_RES (1)..(15): Any amino acid
  MOD_RES (59)..(60): Any amino acid
  MOD_RES (76)..(82): Any amino acid
  MOD_RES (98)..(100): Any amino acid
  MOD_RES (124)..(131): Any amino acid
  MOD_RES (172)..(173): Any amino acid
  MOD_RES (188)..(195): Any amino acid
  MOD_RES (217)..(219): Any amino acid
  MOD_RES (326)..(333): Any amino acid
  MOD_RES (349)..(377): Any amino acid
  MOD_RES (400)..(418): Any amino acid
  MOD_RES (471)..(471): Any amino acid
  MOD_RES (517)..(518): Any amino acid
XXXXXXXXXXXXXXXVKYSRADKICIGYLSNNATDTVDTLTETGVPVTSSIDLVETNHXXTYCSLNGISPIHLGDXXXXXXXVGNPSCASNINIREWXXXIEDPNAPHKLCFPGEVDNNGELRXXXXXXXXFSRTELINPSKWGDILEGTTASCQNRGANSFYRNLIWLVNXXNGKYPVIKGDYNNTXXXXXXXXWGIHHPDSETTATKLYVNKNPXXXVSTKEWSRRYELEIGARIGEGQRSWMKIYWHLMHPGERIMFESNGGLIAPRYGYIIEKYGSGRIFQSGIRMARCNTKCQTSVGGIDTNKTFQNIDRNAIGDCPKYIXXXXXXXXTGLRNVPIPIGERGLXXXXXXXXXXXXXXXXXXXXXXXXXXXXXTGIAADKTSTQKAINEITTKINXXXXXXXXXXXXXXXXXXXVEKRINMIADRVDDAVTDVWSYNAKLLVLLENGRTLDLHDANVKNLHEQVKRXLKSNAIDEGDGCFSILHKCNDSCMEAIRNGTYNHEDYREESQLKRXXIEGIKLKSEDNVYKVLAIYSCIASSTVLVGLILAFILWACSSGNCRFSVCI

SEQ ID NO: 418432 - protein, 569 aa, Influenza virus
  MOD_RES (1)..(15): Any amino acid
  MOD_RES (44)..(63): Any amino acid
  MOD_RES (79)..(102): Any amino acid
  MOD_RES (120)..(131): Any amino acid
  MOD_RES (172)..(179): Any amino acid
  MOD_RES (191)..(197): Any amino acid
  MOD_RES (216)..(231): Any amino acid
  MOD_RES (240)..(245): Any amino acid
  MOD_RES (266)..(279): Any amino acid
  MOD_RES (305)..(307): Any amino acid
  MOD_RES (323)..(334): Any amino acid
  MOD_RES (343)..(343): Any amino acid
  MOD_RES (352)..(377): Any amino acid
  MOD_RES (393)..(421): Any amino acid
  MOD_RES (437)..(443): Any amino acid
  MOD_RES (456)..(458): Any amino acid
  MOD_RES (471)..(471): Any amino acid
  MOD_RES (493)..(508): Any amino acid
  MOD_RES (552)..(552): Any amino acid
XXXXXXXXXXXXXXXGRYSIADKICIGYLSNNSTDKVDTLTENXXXXXXXXXXXXXXXXXXXXSLNGVSPVHLGDCSFXXXXXXXXXXXXXXXXXXXXXXXXDPNAPNKFCYPGELDNNXXXXXXXXXXXXFSRTELIPPSKWGDVLDGVTASCRDNGADSFYRNLIWLVKXXXXXXXXVKGEYNNTTGRXXXXXXXIHHPDTETTANKLYVNKNXXXXXXXXXXXXXXXXEIGTRIGEXXXXXXKLYWHLMHPGERTTFESNGGXXXXXXXXXXXXXXTGRIFQSRIRMGKCNTKCQTSLGGIXXXKTFQNIEKNALGDCPXXXXXXXXXXXXGLRNVPSVXNERGLFGAXXXXXXXXXXXXXXXXXXXXXXXXXXTGIAADKVSTQKAINXXXXXXXXXXXXXXXXXXXXXXXXXXXXXRINMLADWVDDAVTDXXXXXXXLLVLLENDRTLDXXXANVRNLHEQIKRXLKDNAIDEGDGCFSLLHKCNDXXXXXXXXXXXXXXXXREESQLKKQEIEGIKLKTEDNIYKILSIYSCIASSVVLVGLILXFIMWACSNGSCRFNVCI

SEQ ID NO: 418433 - protein, 569 aa, Influenza virus
  MOD_RES (1)..(15): Any amino acid
  MOD_RES (25)..(28): Any amino acid
  MOD_RES (41)..(63): Any amino acid
  MOD_RES (76)..(104): Any amino acid
  MOD_RES (118)..(133): Any amino acid
  MOD_RES (149)..(149): Any amino acid
  MOD_RES (172)..(179): Any amino acid
  MOD_RES (189)..(197): Any amino acid
  MOD_RES (217)..(245): Any amino acid
  MOD_RES (271)..(282): Any amino acid
  MOD_RES (312)..(343): Any amino acid
  MOD_RES (352)..(383): Any amino acid
  MOD_RES (399)..(447): Any amino acid
  MOD_RES (471)..(471): Any amino acid
  MOD_RES (495)..(525): Any amino acid
  MOD_RES (538)..(538): Any amino acid
  MOD_RES (554)..(554): Any amino acid
  MOD_RES (568)..(569): Any amino acid
XXXXXXXXXXXXXXXGRYSRADKIXXXXLSNNSTDTVDTLXXXXXXXXXXXXXXXXXXXXXXXSLNGISPVHLGDXXXXXXXXXXXXXXXXXXXXXXXXXXXXXNAPNKLCYPGELDXXXXXXXXXXXXXXXXRTELINPNKWGNVLDXVTASCLDKGAKSFYRNLVWIVKXXXXXXXXVRGDYNNTTXXXXXXXXXIHHPDTEEVATRLYVNKNPXXXXXXXXXXXXXXXXXXXXXXXXXXXXXKLYWHLMSPGERITFESSGGLLAPRXXXXXXXXXXXXIFQSGVRLAKCNTKCQTSMGGVNTNKTFQXXXXXXXXXXXXXXXXXXXXXXXXXXXXXXXXVERGLFGAXXXXXXXXXXXXXXXXXXXXXXXXXXXXXXXXKVSTQKALNEITTKIXXXXXXXXXXXXXXXXXXXXXXXXXXXXXXXXXXXXXXXXXXXXXXXXXLENGRTLGLHDANVRNLHDQIKRXLQNNAIDEGDGCFNFFHKCNDSCXXXXXXXXXXXXXXXXXXXXXXXXXXXXXXXTEDNVYKILSIYXCIASSIVMVGLILAFXMWACSNGNCRFNVXX

SEQ ID NO: 418434 - protein, 569 aa, Influenza virus
  MOD_RES (1)..(15): Any amino acid
  MOD_RES (24)..(29): Any amino acid
  MOD_RES (45)..(104): Any amino acid
  MOD_RES (120)..(133): Any amino acid
  MOD_RES (172)..(198): Any amino acid
  MOD_RES (221)..(250): Any amino acid
  MOD_RES (259)..(282): Any amino acid
  MOD_RES (305)..(343): Any amino acid
  MOD_RES (352)..(384): Any amino acid
  MOD_RES (393)..(458): Any amino acid
  MOD_RES (470)..(538): Any amino acid
  MOD_RES (552)..(569): Any amino acid
XXXXXXXXXXXXXXXSRYSKADKXXXXXXSNNSTDKIDTLTETGXXXXXXXXXXXXXXXXXXXXXXXXXXXXXXXXXXXXXXXXXXXXXXXXXXXXXXXXXXXXNAPHKLCYPGEVDNNXXXXXXXXXXXXXXRTELISPNKWGDILDGVTASCLDRGTSSFYRNLIWLVQXXXXXXXXXXXXXXXXXXXXXXXXXXXHHPDTEAVAINLYASKNPYTLVXXXXXXXXXXXXXXXXXXXXXXXXXXXXXXLMRPGERTXXXXXXXXXXXXXXXXXXXXXXXXIFQSGVRVARCNTKCQTSLGGVXXXXXXXXXXXXXXXXXXXXXXXXXXXXXXXXXXXXXXXSERGLFGAXXXXXXXXXXXXXXXXXXXXXXXXXXXXXXXXXASTQKAINXXXXXXXXXXXXXXXXXXXXXXXXXXXXXXXXXXXXXXXXXXXXXXXXXXXXXXXXXXXXXXXXXXANVKNLHDQIKXXXXXXXXXXXXXXXXXXXXXXXXXXXXXXXXXXXXXXXXXXXXXXXXXXXXXXXXXXXXXXXXXXXXXCIASSTVMVGLILXXXXXXXXXXXXXXXXXX

SEQ ID NO: 418435 - protein, 569 aa, Influenza virus
  MOD_RES (1)..(35): Any amino acid
  MOD_RES (44)..(343): Any amino acid
  MOD_RES (352)..(569): Any amino acid
XXXXXXXXXXXXXXXXXXXXXXXXXXXXXXXXXXXKVDTLTETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDERGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418436 - protein, 627 aa, Influenza virus
  MOD_RES (16)..(26): Any amino acid
  MOD_RES (45)..(304): Any amino acid
  MOD_RES (322)..(342): Any amino acid
  MOD_RES (353)..(385): Any amino acid
  MOD_RES (415)..(415): Any amino acid
  MOD_RES (424)..(477): Any amino acid
  MOD_RES (496)..(519): Any amino acid
  MOD_RES (529)..(573): Any amino acid
  MOD_RES (584)..(603): Any amino acid
  MOD_RES (625)..(627): Any amino acid
KQGKTKATKMKAILVXXXXXXXXXXXTAYSQITNGTTGNPIICLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSNAPSGIEYNGKSLGIQXXXXXXXXXXXXXXXXXXXXXTSLTSLPFQNXXXXXXXXXXXXXXXXXXXXXXXXXXXXXXXXXRGLFGAIAGFIEGGWTGMVDGWYGYHHQNXQGSGYAADXXXXXXXXXXXXXXXXXXXXXXXXXXXXXXXXXXXXXXXXXXXXXXXXXXXXXXWTYNAELLVLLENERTLDXXXXXXXXXXXXXXXXXXXXXXXXGNGCFEFYHXXXXXXXXXXXXXXXXXXXXXXXXXXXXXXXXXXXXXXXXXXXXXLAIYSTVASSXXXXXXXXXXXXXXXXXXXXLCSVEYASKTRISLVKTTLFLXXX

SEQ ID NO: 418437 - protein, 627 aa, Influenza virus
  MOD_RES (1)..(3): Any amino acid
  MOD_RES (16)..(304): Any amino acid
  MOD_RES (319)..(390): Any amino acid
  MOD_RES (415)..(415): Any amino acid
  MOD_RES (424)..(477): Any amino acid
  MOD_RES (496)..(519): Any amino acid
  MOD_RES (529)..(573): Any amino acid
  MOD_RES (584)..(612): Any amino acid
  MOD_RES (622)..(627): Any amino acid
XXXKTKATKMEAILVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSNAPSGVEYNGKSLXXXXXXXXXXXXXXXXXXXXXXXXXXXXXXXXXXXXXXXXXXXXXXXXXXXXXXXXXXXXXXXXXXXXXXXXAIAGFIENGWEGMVDGWYGFRHQNXEGTGIAADXXXXXXXXXXXXXXXXXXXXXXXXXXXXXXXXXXXXXXXXXXXXXXXXXXXXXXWTYQAELLVAMENQHTIDXXXXXXXXXXXXXXXXXXXXXXXXGKGCFEIYHXXXXXXXXXXXXXXXXXXXXXXXXXXXXXXXXXXXXXXXXXXXXXLSIYSCIASSXXXXXXXXXXXXXXXXXXXXXXXXXXXXXCRICIRADGXXXXXX

SEQ ID NO: 418438 - protein, 627 aa, Influenza virus
  MOD_RES (1)..(6): Any amino acid
  MOD_RES (16)..(393): Any amino acid
  MOD_RES (415)..(415): Any amino acid
  MOD_RES (424)..(477): Any amino acid
  MOD_RES (496)..(519): Any amino acid
  MOD_RES (529)..(573): Any amino acid
  MOD_RES (584)..(612): Any amino acid
XXXXXXATKMKAIIVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFIEGGWPGLINGWYGFQHRNXQGTGQAADXXXXXXXXXXXXXXXXXXXXXXXXXXXXXXXXXXXXXXXXXXXXXXXXXXXXXXWSYNAQLLVLLENQKTLDXXXXXXXXXXXXXXXXXXXXXXXXGNGCFTFYHXXXXXXXXXXXXXXXXXXXXXXXXXXXXXXXXXXXXXXXXXXXXXILWFSFGASCXXXXXXXXXXXXXXXXXXXXXXXXXXXXXCRICILDQNFRNIRK

SEQ ID NO: 418439 - protein, 627 aa, Influenza virus
  MOD_RES (1)..(6): Any amino acid
  MOD_RES (16)..(396): Any amino acid
  MOD_RES (412)..(415): Any amino acid
  MOD_RES (424)..(477): Any amino acid
  MOD_RES (496)..(519): Any amino acid
  MOD_RES (529)..(573): Any amino acid
  MOD_RES (584)..(612): Any amino acid
  MOD_RES (622)..(627): Any amino acid
XXXXXXQPNDGQVLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGGWTGMIDGWYGYHXXXXQGTGIAADXXXXXXXXXXXXXXXXXXXXXXXXXXXXXXXXXXXXXXXXXXXXXXXXXXXXXXWSYNAKLLVLLENDKTLDXXXXXXXXXXXXXXXXXXXXXXXXGDGCFEILHXXXXXXXXXXXXXXXXXXXXXXXXXXXXXXXXXXXXXXXXXXXXXLAIYSTAASSXXXXXXXXXXXXXXXXXXXXXXXXXXXXXCTISLVKTTXXXXXX

SEQ ID NO: 418440 - protein, 627 aa, Influenza virus
  MOD_RES (1)..(396): Any amino acid
  MOD_RES (415)..(415): Any amino acid
  MOD_RES (424)..(477): Any amino acid
  MOD_RES (496)..(519): Any amino acid
  MOD_RES (529)..(573): Any amino acid
  MOD_RES (584)..(612): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGGWPGLVAGWYGFQHQNXQGVGMAADXXXXXXXXXXXXXXXXXXXXXXXXXXXXXXXXXXXXXXXXXXXXXXXXXXXXXXWAYNAELLILLENEKTLDXXXXXXXXXXXXXXXXXXXXXXXXGNGCFELLHXXXXXXXXXXXXXXXXXXXXXXXXXXXXXXXXXXXXXXXXXXXXXLSIYSSVASSXXXXXXXXXXXXXXXXXXXXXXXXXXXXXCRICIDFRDMRKNTL

SEQ ID NO: 418441 - protein, 599 aa, Influenza virus
  MOD_RES (17)..(26): Any amino acid
  MOD_RES (62)..(83): Any amino acid
  MOD_RES (97)..(101): Any amino acid
  MOD_RES (110)..(123): Any amino acid
  MOD_RES (147)..(169): Any amino acid
  MOD_RES (179)..(180): Any amino acid
  MOD_RES (190)..(201): Any amino acid
  MOD_RES (212)..(253): Any amino acid
  MOD_RES (263)..(264): Any amino acid
  MOD_RES (281)..(312): Any amino acid
  MOD_RES (324)..(325): Any amino acid
  MOD_RES (431)..(431): Any amino acid
  MOD_RES (473)..(483): Any amino acid
  MOD_RES (506)..(506): Any amino acid
  MOD_RES (528)..(531): Any amino acid
  MOD_RES (540)..(541): Any amino acid
KQGKTKATKMKAILVVXXXXXXXXXXADTLCIGYHANNSTDTVDTVLEKNVTVTHSVNLLEXXXXXXXXXXXXXXXXXXXXXXIAGWILGNPECESXXXXXSWSYIVETXXXXXXXXXXXXXXDYEELREQLSSVSSFERFEIFPKXXXXXXXXXXXXXXXXXXXXXXXSFYKNLIWLXXKEKENSYPMXXXXXXXXXXXXVLVLWGIHHPXXXXXXXXXXXXXXXXXXXXXXXXXXXXXXXXXXXXXXXXXXGRMNYYWTLXXPGDKITFEATGNLVVPXXXXXXXXXXXXXXXXXXXXXXXXXXXXXXXXGAINTSLPFQNXXNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNXLEKRIENLNKKVDDGFLDIWTYNAELLVLLENERTLDYHDSXXXXXXXXXXXQLKNNAKEIGNGCFEFYHKCDNXCMESVKNGTYDYPKYSEEAKLXXXXIDGVKLESXXIYQILAIYSTVASSLVLVVSLGAISFWMCSNGSLQCRIEYASKTRISIDFRDMRKNTL

SEQ ID NO: 418442 - protein, 599 aa, Influenza virus
  MOD_RES (1)..(3): Any amino acid
  MOD_RES (17)..(26): Any amino acid
  MOD_RES (38)..(38): Any amino acid
  MOD_RES (60)..(83): Any amino acid
  MOD_RES (97)..(101): Any amino acid
  MOD_RES (110)..(123): Any amino acid
  MOD_RES (147)..(169): Any amino acid
  MOD_RES (179)..(181): Any amino acid
  MOD_RES (190)..(201): Any amino acid
  MOD_RES (212)..(253): Any amino acid
  MOD_RES (263)..(264): Any amino acid
  MOD_RES (281)..(312): Any amino acid
  MOD_RES (324)..(325): Any amino acid
  MOD_RES (361)..(369): Any amino acid
  MOD_RES (431)..(431): Any amino acid
  MOD_RES (473)..(483): Any amino acid
  MOD_RES (506)..(506): Any amino acid
  MOD_RES (528)..(531): Any amino acid
  MOD_RES (540)..(541): Any amino acid
  MOD_RES (580)..(581): Any amino acid
  MOD_RES (594)..(599): Any amino acid
XXXKTKATKMEAILVVXXXXXXXXXXADTICIGYHANXSTDTVDTILEKNVTVTHSVDLXXXXXXXXXXXXXXXXXXXXXXXXVAGWILGNPKCDLXXXXXSWSYIVEKXXXXXXXXXXXXXXNYEELREQLSTVSSFERFEMFPKXXXXXXXXXXXXXXXXXXXXXXXSFYRNLLWLXXXEKENSYPKXXXXXXXXXXXXVLVLWGVHHPXXXXXXXXXXXXXXXXXXXXXXXXXXXXXXXXXXXXXXXXXXGRINYYWTLXXPGDTIIFEANGNLIAPXXXXXXXXXXXXXXXXXXXXXXXXXXXXXXXXGAINSSLPFQNXXNVHPVTIGECPKYVRSAKLRMVTGLRNIPSIQSRGXXXXXXXXXEGGWTGMIDGWYGYHHQNGQGSGYAADQKSTQNAINGITNKVNSIIEKMNTQFTSVGKEFNXLERRMENLNKKVDDGLLDVWTYNAELLILLENERTLDFHDSXXXXXXXXXXXQLRNNAKELGNGCFEFYHKCNDXCMESVRNGTYDYPKYSKESKLXXXXINGVKLDSXXVYQILAIYSTAASSLVLLVSLGAISFWMCSGHSCRICIXXSLQCRICIRADGXXXXXX

SEQ ID NO: 418443 - protein, 599 aa, Influenza virus
  MOD_RES (1)..(6): Any amino acid
  MOD_RES (17)..(26): Any amino acid
  MOD_RES (62)..(83): Any amino acid
  MOD_RES (97)..(101): Any amino acid
  MOD_RES (110)..(123): Any amino acid
  MOD_RES (147)..(169): Any amino acid
  MOD_RES (179)..(201): Any amino acid
  MOD_RES (212)..(253): Any amino acid
  MOD_RES (263)..(264): Any amino acid
  MOD_RES (281)..(312): Any amino acid
  MOD_RES (342)..(342): Any amino acid
  MOD_RES (364)..(385): Any amino acid
  MOD_RES (428)..(431): Any amino acid
  MOD_RES (455)..(464): Any amino acid
  MOD_RES (473)..(483): Any amino acid
  MOD_RES (506)..(506): Any amino acid
  MOD_RES (528)..(531): Any amino acid
  MOD_RES (540)..(541): Any amino acid
  MOD_RES (580)..(581): Any amino acid
XXXXXXATKMKAIIVVXXXXXXXXXXADTICVGYHANNSTDTVDTLLEKNVTVTHSVNILEXXXXXXXXXXXXXXXXXXXXXXIAGWLLGNPECELXXXXXSWSYIIETXXXXXXXXXXXXXXDYEELKEQLSTVSSFEKFEIFPKXXXXXXXXXXXXXXXXXXXXXXXSFYRNLIWLXXXXXXXXXXXXXXXXXXXXXXXVLVIWGVHHPXXXXXXXXXXXXXXXXXXXXXXXXXXXXXXXXXXXXXXXXXXGRMNYHWTLXXPGDTITFEATGNLIAPXXXXXXXXXXXXXXXXXXXXXXXXXXXXXXXXGALNSSLPSLPFQNIHPVTIGECPKYVKSXKLRMATGLRNIPSVQSRGLFGXXXXXXXXXXXXXXXXXXXXXXQNAQGSGYAADRKSTQIAIDKITNKVNSVVEKMNTQFTVVGKXXXXLEKRMENLNKKIDDGFLDVWTYNXXXXXXXXXXRTLDFHDLXXXXXXXXXXXQLNNNAKEVGNGCFEFYHKCDDXCMESIKNGTYNYPKYSEESKLXXXXINGVKLESXXIHQILAIYSTVASSSVLLVSLGAVSFWMCSNGSLRCRIXXSLQCRVCILDQNFRNIRK

SEQ ID NO: 418444 - protein, 599 aa, Influenza virus
  MOD_RES (1)..(8): Any amino acid
  MOD_RES (17)..(40): Any amino acid
  MOD_RES (57)..(83): Any amino acid
  MOD_RES (97)..(101): Any amino acid
  MOD_RES (110)..(123): Any amino acid
  MOD_RES (143)..(169): Any amino acid
  MOD_RES (179)..(201): Any amino acid
  MOD_RES (212)..(253): Any amino acid
  MOD_RES (263)..(264): Any amino acid
  MOD_RES (281)..(312): Any amino acid
  MOD_RES (324)..(325): Any amino acid
  MOD_RES (354)..(397): Any amino acid
  MOD_RES (428)..(431): Any amino acid
  MOD_RES (449)..(464): Any amino acid
  MOD_RES (473)..(497): Any amino acid
  MOD_RES (506)..(509): Any amino acid
  MOD_RES (528)..(531): Any amino acid
  MOD_RES (540)..(541): Any amino acid
  MOD_RES (550)..(550): Any amino acid
  MOD_RES (567)..(571): Any amino acid
  MOD_RES (596)..(599): Any amino acid
XXXXXXXXEREAKLFVXXXXXXXXXXXXXXXXXXXXXXXXDTVDTVRERNVTVTHSXXXXXXXXXXXXXXXXXXXXXXXXXXXVAGWLLGNPECDLXXXXXSWSYIAETXXXXXXXXXXXXXXNYEELREHLSSVSSFKRFEXXXXXXXXXXXXXXXXXXXXXXXXXXXSFYKNLLWLXXXXXXXXXXXXXXXXXXXXXXXVLVLWAIHHPXXXXXXXXXXXXXXXXXXXXXXXXXXXXXXXXXXXXXXXXXXGRMDYYWTLXXQGDTITFEATGNLLVPXXXXXXXXXXXXXXXXXXXXXXXXXXXXXXXXGALKSNLPFQNXXNVHPITIGECPKYVRSTQLRMATGLRNVXXXXXXXXXXXXXXXXXXXXXXXXXXXXXXXXXXXXXXXXXXXXKSTQHAIDGITNKVNSVIEKMNIQFTSVGKXXXXLERRIENLNRKVDDGFLXXXXXXXXXXXXXXXXRTLDFHDFXXXXXXXXXXXXXXXXXXXXXXXXXEFYHKCNNXXXXSVKNGTYNYPKYSEESRLXXXXVDGVKLESXXVHQILAIYXTVASSLILIVSLGAISXXXXXNGSLQCRVEYASKTRICIDFRDMRXXXX

SEQ ID NO: 418445 - protein, 599 aa, Influenza virus
  MOD_RES (1)..(12): Any amino acid
  MOD_RES (21)..(41): Any amino acid
  MOD_RES (55)..(88): Any amino acid
  MOD_RES (97)..(101): Any amino acid
  MOD_RES (110)..(132): Any amino acid
  MOD_RES (142)..(169): Any amino acid
  MOD_RES (178)..(201): Any amino acid
  MOD_RES (212)..(254): Any amino acid
  MOD_RES (263)..(264): Any amino acid
  MOD_RES (276)..(312): Any amino acid
  MOD_RES (351)..(397): Any amino acid
  MOD_RES (416)..(416): Any amino acid
  MOD_RES (431)..(431): Any amino acid
  MOD_RES (456)..(464): Any amino acid
  MOD_RES (473)..(519): Any amino acid
  MOD_RES (528)..(531): Any amino acid
  MOD_RES (540)..(552): Any amino acid
  MOD_RES (565)..(571): Any amino acid
  MOD_RES (580)..(581): Any amino acid
  MOD_RES (595)..(599): Any amino acid
XXXXXXXXXXXXIIIVVLLYXXXXXXXXXXXXXXXXXXXXXTVDTVLERNVTVTXXXXXXXXXXXXXXXXXXXXXXXXXXXXXXXXXXLGNPECGLXXXXXSWSYIVERXXXXXXXXXXXXXXXXXXXXXXXSSVSSFEKFXXXXXXXXXXXXXXXXXXXXXXXXXXXXGFYKNLIWXXXXXXXXXXXXXXXXXXXXXXXXVLVIWGIHHPXXXXXXXXXXXXXXXXXXXXXXXXXXXXXXXXXXXXXXXXXXXRMNYYWTIXXPRDTIIFEASGXXXXXXXXXXXXXXXXXXXXXXXXXXXXXXXXXXXXXGALNSNLPSLPFQNVHPFTIGECSKYVKSTRLRMATGLXXXXXXXXXXXXXXXXXXXXXXXXXXXXXXXXXXXXXXXXXXXXXXXKSTQTAIDGISNKVNSVIXKMNIQFTAVGKEFSXLETRIENLNKKIDDGFIDIWTYNAXXXXXXXXXRTLDYHDFXXXXXXXXXXXXXXXXXXXXXXXXXXXXXXXXXXXXXXXXXXXXXXXKYSKEAKLXXXXIDGIKLESXXXXXXXXXXXXXASSLVLIVSLGAXXXXXXXWSLQCRICXXSLRCRICILDQNFXXXXX

SEQ ID NO: 418446 - protein, 599 aa, Influenza virus
  MOD_RES (1)..(170): Any amino acid
  MOD_RES (179)..(266): Any amino acid
  MOD_RES (281)..(315): Any amino acid
  MOD_RES (324)..(325): Any amino acid
  MOD_RES (337)..(345): Any amino acid
  MOD_RES (354)..(405): Any amino acid
  MOD_RES (414)..(440): Any amino acid
  MOD_RES (456)..(552): Any amino acid
  MOD_RES (563)..(574): Any amino acid
  MOD_RES (583)..(584): Any amino acid
  MOD_RES (593)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFYRNLLWIXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTIIFEATGNLVAPXXXXXXXXXXXXXXXXXXXXXXXXXXXXXXXXXXXNTSLPFHNXXNIHSITIGKCPXXXXXXXXXLATGLRNIXXXXXXXXXXXXXXXXXXXXXXXXXXXXXXXXXXXXXXXXXXXXXXXXXXXXRITNKVNSXXXXXXXXXXXXXXXXXXXXXXXXXXXKKVDDGFIDVWTYNAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASTLVLLVSLXXXXXXXXXXXXGSLQCRICXXCRICIDFRXXXXXXX

SEQ ID NO: 418447 - protein, 599 aa, Influenza virus
  MOD_RES (1)..(316): Any amino acid
  MOD_RES (338)..(574): Any amino acid
  MOD_RES (583)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSLTSLPFQNIHSITIGKCSKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSLQCRVCXXXXXXXXXXXXXXXXX

SEQ ID NO: 418448 - protein, 599 aa, Influenza virus
  MOD_RES (1)..(320): Any amino acid
  MOD_RES (337)..(574): Any amino acid
  MOD_RES (583)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLPFHNIHPITIGKCSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSLRCRICXXXXXXXXXXXXXXXXX

SEQ ID NO: 418449 - protein, 599 aa, Influenza virus
  MOD_RES (1)..(320): Any amino acid
  MOD_RES (329)..(575): Any amino acid
  MOD_RES (586)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLPFQNVHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLCSVEYASKTXXXXXXXXXXXXXX

SEQ ID NO: 418450 - protein, 484 aa, Influenza virus
  MOD_RES (19)..(106): Any amino acid
  MOD_RES (231)..(232): Any amino acid
  MOD_RES (267)..(282): Any amino acid
  MOD_RES (298)..(299): Any amino acid
  MOD_RES (323)..(323): Any amino acid
  MOD_RES (343)..(354): Any amino acid
  MOD_RES (379)..(382): Any amino acid
  MOD_RES (395)..(409): Any amino acid
  MOD_RES (445)..(447): Any amino acid
  MOD_RES (465)..(467): Any amino acid
  MOD_RES (482)..(484): Any amino acid
IGLREQKQEFKMNPNQKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWXXNILRTQESECACVNGSCFTVMTDGPSVMGQASYKXXXXXXXXXXXXXXXXAPNYHYEECSCYPDSXXITCVCRDNWHGSNRPWVSFNQNLXYQIGYICSGIFGDNPRPNDXXXXXXXXXXXXGANGVKGFSFKYGNGVWIGRTKSIXXXXGFEMIWDPNGWTXXXXXXXXXXXXXXXNEWSGYSGSFVQHPELTGLDCIRPCFWVELIRGRPXXXTTIWTSGSSISFCGVNSXXXGWSWPDGAELPFTIXXX

SEQ ID NO: 418451 - protein, 484 aa, Influenza virus
  MOD_RES (1)..(106): Any amino acid
  MOD_RES (145)..(146): Any amino acid
  MOD_RES (231)..(232): Any amino acid
  MOD_RES (259)..(282): Any amino acid
  MOD_RES (298)..(299): Any amino acid
  MOD_RES (323)..(323): Any amino acid
  MOD_RES (334)..(334): Any amino acid
  MOD_RES (343)..(354): Any amino acid
  MOD_RES (379)..(383): Any amino acid
  MOD_RES (395)..(409): Any amino acid
  MOD_RES (419)..(420): Any amino acid
  MOD_RES (445)..(447): Any amino acid
  MOD_RES (465)..(467): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIYTKDNSIRIGSKGDIFVIREPFISCSHLECRTFFXXQGALLNDRHSNGTVKDRSPYRALMSCPLGEAPSPYNSKFESVAWSASACHDGMGWLTIGISGPDDGAVAVLKYKGIITGTIKSWXXQILRTQESECVCMNGSCFTIMTDGPSXXXXXXXXXXXXXXXXXXXXXXXXAPNFHYEECSCYPESXXVMCVCRDNWHASNRPWVSFDQNLXYQMGYICSGIXGDNPRPKDXXXXXXXXXXXXGADGVKGFSYKYGNGVWMGRTKSNXXXXXFEMIWDPDGWTXXXXXXXXXXXXXXXTDWSGYSGSXXQHPELTGMNCIRPCFWVELVRGLPXXXATIWTSGSIISFCGVNGXXXNWSWPDGADLPFTIXXX

SEQ ID NO: 418452 - protein, 484 aa, Influenza virus
  MOD_RES (1)..(106): Any amino acid
  MOD_RES (119)..(120): Any amino acid
  MOD_RES (145)..(152): Any amino acid
  MOD_RES (185)..(191): Any amino acid
  MOD_RES (208)..(217): Any amino acid
  MOD_RES (227)..(232): Any amino acid
  MOD_RES (259)..(282): Any amino acid
  MOD_RES (298)..(299): Any amino acid
  MOD_RES (309)..(309): Any amino acid
  MOD_RES (323)..(323): Any amino acid
  MOD_RES (343)..(354): Any amino acid
  MOD_RES (379)..(383): Any amino acid
  MOD_RES (392)..(409): Any amino acid
  MOD_RES (418)..(421): Any amino acid
  MOD_RES (445)..(448): Any amino acid
  MOD_RES (465)..(467): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIHTKDNSIRXXSKGDIFVMREPFISCSQLECRTFFXXXXXXXXDKHSNGTVKNRSPYRALMSCPIGEAPSPYNSRXXXXXXXASACHDGTSWLTIGISXXXXXXXXXXKYNGIITGTXXXXXXRILRTQESECVCVNGSCFTVLTDGPSXXXXXXXXXXXXXXXXXXXXXXXXAPNFYYEECSCYPDTXXVVCVCRDNWXASNRPWISFDQNLXYQVGYICSGVFGDNPRPEDXXXXXXXXXXXXGAYGVKGFSFRYGNGVWIGRTKSNXXXXXFEMVWDPNXXXXXXXXXXXXXXXXXXNDWSGYSGXXXXHPELTGLNCIKPCFWVELIRGQPXXXXTIWASGSSISFCGVDSXXXSWSWPDGAKLPFTIXXX

SEQ ID NO: 418453 - protein, 484 aa, Influenza virus
  MOD_RES (1)..(108): Any amino acid
  MOD_RES (130)..(131): Any amino acid
  MOD_RES (145)..(152): Any amino acid
  MOD_RES (182)..(191): Any amino acid
  MOD_RES (210)..(217): Any amino acid
  MOD_RES (231)..(232): Any amino acid
  MOD_RES (259)..(282): Any amino acid
  MOD_RES (298)..(299): Any amino acid
  MOD_RES (308)..(313): Any amino acid
  MOD_RES (323)..(323): Any amino acid
  MOD_RES (343)..(354): Any amino acid
  MOD_RES (379)..(409): Any amino acid
  MOD_RES (418)..(421): Any amino acid
  MOD_RES (432)..(448): Any amino acid
  MOD_RES (465)..(467): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIYSKDNGIRIGSKGDVFVMRXXFISCSHFECRTFFXXXXXXXXDKHSNGTAKDRSPHRTLMSCPVGEAPSPYXXXXXXXXXXASACHDGLGWITIGISGPXXXXXXXXKYNGIITETIKSWXXKILRTQESECVCINGSCFTIMTDGPNXXXXXXXXXXXXXXXXXXXXXXXXAPNSHYEECSCYPDAXXIICVCRDNXXXXXXPWVSFNQDLXYRIGYICSGVFGDNPRSNDXXXXXXXXXXXXGTNGVKGFSYRYGNGVWIGRTKSTXXXXXXXXXXXXXXXXXXXXXXXXXXXXXXXTNWSGYSGXXXXHPELTGMDCIXXXXXXXXXXXXXXXXXTIWTSASSISFCGVSSXXXDWSWPDGAELPFAIXXX

SEQ ID NO: 418454 - protein, 484 aa, Influenza virus
  MOD_RES (1)..(110): Any amino acid
  MOD_RES (125)..(133): Any amino acid
  MOD_RES (149)..(153): Any amino acid
  MOD_RES (170)..(191): Any amino acid
  MOD_RES (200)..(217): Any amino acid
  MOD_RES (229)..(237): Any amino acid
  MOD_RES (250)..(282): Any amino acid
  MOD_RES (294)..(313): Any amino acid
  MOD_RES (323)..(325): Any amino acid
  MOD_RES (334)..(359): Any amino acid
  MOD_RES (375)..(423): Any amino acid
  MOD_RES (439)..(472): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYSKDNSVRIGSKGDXXXXXXXXXSCSHLECKTFFLTQGXXXXXRHSNGTIKDRSPFRALXXXXXXXXXXXXXXXXXXXXXXASACHDGVXXXXXXXXXXXXXXXXXXKYNDIITDTIKXXXXXXXXXQESECACINGSCXXXXXXXXXXXXXXXXXXXXXXXXXXXXXXXXXAPNYYYEECSCXXXXXXXXXXXXXXXXXXXXPWVSFNHNLXXXMGYICSGVXXXXXXXXXXXXXXXXXXXXXXXXXXKGFSYKYDNGVWIGRXXXXXXXXXXXXXXXXXXXXXXXXXXXXXXXXXXXXXXXXXXXXXXXXXELTGLDCMRPCFWVEXXXXXXXXXXXXXXXXXXXXXXXXXXXXXXXXXXDGAELPFIIXXX

SEQ ID NO: 418455 - protein, 484 aa, Influenza virus
  MOD_RES (1)..(154): Any amino acid
  MOD_RES (166)..(220): Any amino acid
  MOD_RES (230)..(476): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHSNGTVKBRSPXXXXXXXXXXXXXXXXXXXXXXXXXXXXXXXXXXXXXXXXXXXXXXXXXXXXXXXGVITDTIKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPFTQEQK

SEQ ID NO: 418456 - protein, 566 aa, Influenza virus
  MOD_RES (1)..(17): Any amino acid
  MOD_RES (36)..(37): Any amino acid
  MOD_RES (52)..(53): Any amino acid
  MOD_RES (62)..(73): Any amino acid
  MOD_RES (85)..(113): Any amino acid
  MOD_RES (124)..(241): Any amino acid
  MOD_RES (250)..(306): Any amino acid
  MOD_RES (327)..(328): Any amino acid
  MOD_RES (369)..(371): Any amino acid
  MOD_RES (382)..(392): Any amino acid
  MOD_RES (401)..(421): Any amino acid
  MOD_RES (460)..(468): Any amino acid
  MOD_RES (491)..(491): Any amino acid
  MOD_RES (504)..(527): Any amino acid
  MOD_RES (538)..(550): Any amino acid
XXXXXXXXXXXXXXXXXDTICIGYHANNSTDTVDTXXEKNVTVTHSVNLLEXXHNGKLCLLXXXXXXXXXXXXVAGWILGNPECXXXXXXXXXXXXXXXXXXXXXXXXXXXXXDYEELREQLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRINYYWTXXXXXXXXXXXXXXXXXXXXXXXXXXXXXXXXXXXXXXXXXXXXXXXXXXXXXXXXXLPFQNVHPVTIGECPKYVKSXXLRMVTGLRNIPSIQSRGLFGAIAGFIEGGWTGMIDGWYGYXXXNEQGSGYAADXXXXXXXXXXXTNKVNSVIXXXXXXXXXXXXXXXXXXXXXENLNKKVDDGFLDIWTYNAELLVLLENERTLDFHDSNVXXXXXXXXXQLKNNAKEIGNGCFEFYHKCNNXCMESVKNGTYDYXXXXXXXXXXXXXXXXXXXXXXXXYQILAIYSTVXXXXXXXXXXXXXSFWMCSNGSLQCRICI

SEQ ID NO: 418457 - protein, 566 aa, Influenza virus
  MOD_RES (1)..(17): Any amino acid
  MOD_RES (36)..(37): Any amino acid
  MOD_RES (52)..(53): Any amino acid
  MOD_RES (62)..(73): Any amino acid
  MOD_RES (85)..(113): Any amino acid
  MOD_RES (124)..(241): Any amino acid
  MOD_RES (250)..(306): Any amino acid
  MOD_RES (327)..(328): Any amino acid
  MOD_RES (350)..(354): Any amino acid
  MOD_RES (369)..(371): Any amino acid
  MOD_RES (382)..(392): Any amino acid
  MOD_RES (401)..(421): Any amino acid
  MOD_RES (460)..(468): Any amino acid
  MOD_RES (491)..(491): Any amino acid
  MOD_RES (504)..(527): Any amino acid
  MOD_RES (538)..(550): Any amino acid
XXXXXXXXXXXXXXXXXDTLCIGYHANNSTETVDTXXKKNVTVTHSINLLEXXHNGKLCKLXXXXXXXXXXXXIAGWLLGNPECXXXXXXXXXXXXXXXXXXXXXXXXXXXXXNYEELREQLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRMNYYWTXXXXXXXXXXXXXXXXXXXXXXXXXXXXXXXXXXXXXXXXXXXXXXXXXXXXXXXXXLPFQNIHPVTIGKCPKYVKSXXLRMATGLRNVPSIHSRGLFGAXXXXXEGGWTGMVDGWYGYXXXNEQGSGFAADXXXXXXXXXXXTNKVNSIIXXXXXXXXXXXXXXXXXXXXXENLNKKIDDGFLDVWTYNAELLILLENERTLDYHDSNVXXXXXXXXXQLRNNAKELGNGCFEFYHRCDDXCMDSVKNGTYNYXXXXXXXXXXXXXXXXXXXXXXXXYRILAIYSTAXXXXXXXXXXXXXCFWMCSNGSLHGRICI

SEQ ID NO: 418458 - protein, 566 aa, Influenza virus
  MOD_RES (1)..(17): Any amino acid
  MOD_RES (36)..(37): Any amino acid
  MOD_RES (49)..(53): Any amino acid
  MOD_RES (62)..(73): Any amino acid
  MOD_RES (85)..(113): Any amino acid
  MOD_RES (124)..(241): Any amino acid
  MOD_RES (250)..(306): Any amino acid
  MOD_RES (327)..(328): Any amino acid
  MOD_RES (351)..(355): Any amino acid
  MOD_RES (369)..(371): Any amino acid
  MOD_RES (381)..(392): Any amino acid
  MOD_RES (401)..(421): Any amino acid
  MOD_RES (443)..(446): Any amino acid
  MOD_RES (460)..(468): Any amino acid
  MOD_RES (477)..(481): Any amino acid
  MOD_RES (491)..(491): Any amino acid
  MOD_RES (504)..(527): Any amino acid
  MOD_RES (537)..(550): Any amino acid
XXXXXXXXXXXXXXXXXDTICVGYHANNSTDTIDTXXEKNITVTHSVNXXXXXHNGKLCSLXXXXXXXXXXXXIAGWILGNPKCXXXXXXXXXXXXXXXXXXXXXXXXXXXXXNYEELREHLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRMDYYWTXXXXXXXXXXXXXXXXXXXXXXXXXXXXXXXXXXXXXXXXXXXXXXXXXXXXXXXXXHPFQNIHPITIGECPKYVRSXXLKMATGLRNTPSIQTRGLFGAIXXXXXGGWTGMVNGWYGYXXXNDQGSGYAAXXXXXXXXXXXXSNKVNSVIXXXXXXXXXXXXXXXXXXXXXESLNNKVDDGFVDLWTYNAELXXXXENERTLDLHDSNVXXXXXXXXXQLKNNAQEXXXXXFEFYHKCDDXCMESVRNGTYDYXXXXXXXXXXXXXXXXXXXXXXXXYNILAIYSTXXXXXXXXXXXXXXGFWMCSNGSLQCKICI

SEQ ID NO: 418459 - protein, 566 aa, Influenza virus
  MOD_RES (1)..(17): Any amino acid
  MOD_RES (26)..(37): Any amino acid
  MOD_RES (46)..(53): Any amino acid
  MOD_RES (62)..(73): Any amino acid
  MOD_RES (85)..(113): Any amino acid
  MOD_RES (124)..(241): Any amino acid
  MOD_RES (250)..(307): Any amino acid
  MOD_RES (319)..(328): Any amino acid
  MOD_RES (349)..(373): Any amino acid
  MOD_RES (382)..(392): Any amino acid
  MOD_RES (401)..(421): Any amino acid
  MOD_RES (433)..(449): Any amino acid
  MOD_RES (460)..(468): Any amino acid
  MOD_RES (481)..(482): Any amino acid
  MOD_RES (491)..(491): Any amino acid
  MOD_RES (504)..(527): Any amino acid
  MOD_RES (538)..(550): Any amino acid
XXXXXXXXXXXXXXXXXDTLCVGYHXXXXXXXXXXXXDKNVTVTHXXXXXXXXHNGKLCRLXXXXXXXXXXXXVAGWLLGNPACXXXXXXXXXXXXXXXXXXXXXXXXXXXXXDYEELKEQLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRMDYYWAXXXXXXXXXXXXXXXXXXXXXXXXXXXXXXXXXXXXXXXXXXXXXXXXXXXXXXXXXXPFQNVHPITIGXXXXXXXXXXLRMARGLRNVPSVQSRGLFGXXXXXXXXXXXXXXXXXXXXXXXXXQGYGYAADXXXXXXXXXXXTNKINSVIXXXXXXXXXXXXXXXXXXXXXENLNRKVDDGFXXXXXXXXXXXXXXXXXRTLDFHDFNVXXXXXXXXXQLKNKVKEIGNGXXEFYHKCNDXCMESIKNGTYDYXXXXXXXXXXXXXXXXXXXXXXXXYQILAVYSTVXXXXXXXXXXXXXSFWMCPNGSLQCTICI

SEQ ID NO: 418460 - protein, 566 aa, Influenza virus
  MOD_RES (1)..(18): Any amino acid
  MOD_RES (27)..(37): Any amino acid
  MOD_RES (47)..(53): Any amino acid
  MOD_RES (62)..(73): Any amino acid
  MOD_RES (85)..(115): Any amino acid
  MOD_RES (124)..(241): Any amino acid
  MOD_RES (250)..(307): Any amino acid
  MOD_RES (323)..(328): Any amino acid
  MOD_RES (351)..(392): Any amino acid
  MOD_RES (401)..(421): Any amino acid
  MOD_RES (435)..(471): Any amino acid
  MOD_RES (482)..(482): Any amino acid
  MOD_RES (491)..(494): Any amino acid
  MOD_RES (504)..(527): Any amino acid
  MOD_RES (538)..(555): Any amino acid
XXXXXXXXXXXXXXXXXXTLCIDYHAXXXXXXXXXXXEKNVAVTHSXXXXXXXHNGKLCNLXXXXXXXXXXXXVVGWISGNPECXXXXXXXXXXXXXXXXXXXXXXXXXXXXXXXEELREQISXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRMSYYWTXXXXXXXXXXXXXXXXXXXXXXXXXXXXXXXXXXXXXXXXXXXXXXXXXXXXXXXXXXPFQNIHPATIGECPKXXXXXXLRLATGLRNTLSIQSKGLFGAIXXXXXXXXXXXXXXXXXXXXXXXXXXXXXXXXXXXXXXXXXXTNKVNPVIXXXXXXXXXXXXXXXXXXXXXENLNKRVDDGFLDXXXXXXXXXXXXXXXXXXXXXXXXXXXXXXXXXXXXXNNAKETGNGCXEFYHKCDNXXXXSVKNGTYEYXXXXXXXXXXXXXXXXXXXXXXXXHQILAIYSAAXXXXXXXXXXXXXXXXXXSHGSLQCRVCI

SEQ ID NO: 418461 - protein, 566 aa, Influenza virus
  MOD_RES (1)..(38): Any amino acid
  MOD_RES (49)..(74): Any amino acid
  MOD_RES (84)..(333): Any amino acid
  MOD_RES (342)..(424): Any amino acid
  MOD_RES (435)..(471): Any amino acid
  MOD_RES (480)..(529): Any amino acid
  MOD_RES (538)..(556): Any amino acid
  MOD_RES (565)..(566): Any amino acid
XXXXXXXXXXXXXXXXXXXXXXXXXXXXXXXXXXXXXXKKLTVTHSVNXXXXXXXXXXXXXXXXXXXXXXXXXXAGWVLGNPEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLTNIPSIXXXXXXXXXXXXXXXXXXXXXXXXXXXXXXXXXXXXXXXXXXXXXXXXXXXXXXXXXXXXXXXXXXXXXXXXXXXXXXXXXXXNKKVDDGLLDXXXXXXXXXXXXXXXXXXXXXXXXXXXXXXXXXXXXXNNARELGNXXXXXXXXXXXXXXXXXXXXXXXXXXXXXXXXXXXXXXXXXXXXXXXXXXILAIYSAVXXXXXXXXXXXXXXXXXXXNGSLQCRVXX

SEQ ID NO: 418462 - protein, 566 aa, Influenza virus
  MOD_RES (1)..(471): Any amino acid
  MOD_RES (480)..(566): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNAKEIGNXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418463 - protein, 566 aa, Influenza virus
  MOD_RES (1)..(473): Any amino acid
  MOD_RES (483)..(566): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAREIGNGCFXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418464 - protein, 475 aa, Influenza virus
  MOD_RES (1)..(46): Any amino acid
  MOD_RES (55)..(84): Any amino acid
  MOD_RES (94)..(94): Any amino acid
  MOD_RES (127)..(128): Any amino acid
  MOD_RES (144)..(151): Any amino acid
  MOD_RES (198)..(200): Any amino acid
  MOD_RES (209)..(221): Any amino acid
  MOD_RES (236)..(236): Any amino acid
  MOD_RES (250)..(270): Any amino acid
  MOD_RES (287)..(287): Any amino acid
  MOD_RES (307)..(314): Any amino acid
  MOD_RES (329)..(345): Any amino acid
  MOD_RES (358)..(359): Any amino acid
  MOD_RES (368)..(370): Any amino acid
  MOD_RES (382)..(403): Any amino acid
  MOD_RES (415)..(416): Any amino acid
  MOD_RES (433)..(436): Any amino acid
XXXXXXXXXXXXXXXXXXXXXXXXXXXXXXXXXXXXXXXXXXXXXXKNNQVILCXXXXXXXXXXXXXXXXXXXXXXXXXXXXXXYRNWSKPQCXITGFAPFSKDNSIRLSAGGDIWVTREPYVSCDXXKCYQFALGQGTTLNNXXXXXXXXDRTPYRTLLMNELGVPFHLGTKQVCIAWSSSSCHDGKAWLHVCVTGXXXNATASFIYXXXXXXXXXXXXXNILRTQESECVCINXTCTVVMTDGSASGXXXXXXXXXXXXXXXXXXXXXGSAQHVEECSCYPRYPXVRCVCRDNWKGSNRPIVDIXXXXXXXXSSYVCSGLVGDTPRXXXXXXXXXXXXXXXXXGGHGVKGWAFDDXXDVWMGRTIXXXLRSGYETFKVIXXXXXXXXXXXXXXXXXXXXXXRSGYSGIFSVEXXSCINRCFYVELIRGRKXXXXVWWTSNSIVVFCGTSGTYGTGSWPDGADIISCLYKLSQF

SEQ ID NO: 418465 - protein, 475 aa, Influenza virus
  MOD_RES (1)..(84): Any amino acid
  MOD_RES (94)..(94): Any amino acid
  MOD_RES (104)..(104): Any amino acid
  MOD_RES (127)..(128): Any amino acid
  MOD_RES (144)..(151): Any amino acid
  MOD_RES (197)..(200): Any amino acid
  MOD_RES (209)..(221): Any amino acid
  MOD_RES (236)..(236): Any amino acid
  MOD_RES (250)..(270): Any amino acid
  MOD_RES (287)..(287): Any amino acid
  MOD_RES (307)..(314): Any amino acid
  MOD_RES (326)..(345): Any amino acid
  MOD_RES (358)..(359): Any amino acid
  MOD_RES (368)..(370): Any amino acid
  MOD_RES (382)..(403): Any amino acid
  MOD_RES (415)..(416): Any amino acid
  MOD_RES (433)..(436): Any amino acid
  MOD_RES (466)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXYRNWSMPQCXIKGFAPFSKXNSIRLSASGDVWVTREPYVSCEXXRCYQFALGQGTTLDNXXXXXXXXDRTPHRTLLMNELGIPFHLGTKQVCMAWSSSSCYDGKAWLHICVTXXXXNATASIIYXXXXXXXXXXXXXKILRTQESECICINXTCTVIMTDGSASEXXXXXXXXXXXXXXXXXXXXXGSAQHIEECSCYPRFPXVRCICRDNWKGSNRPVVDIXXXXXXXXSSYMCSGLVGDXXXXXXXXXXXXXXXXXXXXGNHGVKGWAFDNXXDLWMGRTIXXXLRLGYETFKVVXXXXXXXXXXXXXXXXXXXXXXWSGYSGIFSIEXXNCINRCFYVELIRGRRXXXXVLWTSNSIVAFCGTSGTYGSGSWPDGANIXXXXXXXXXX

SEQ ID NO: 418466 - protein, 475 aa, Influenza virus
  MOD_RES (1)..(84): Any amino acid
  MOD_RES (94)..(94): Any amino acid
  MOD_RES (103)..(106): Any amino acid
  MOD_RES (127)..(134): Any amino acid
  MOD_RES (144)..(151): Any amino acid
  MOD_RES (177)..(180): Any amino acid
  MOD_RES (198)..(200): Any amino acid
  MOD_RES (209)..(221): Any amino acid
  MOD_RES (236)..(236): Any amino acid
  MOD_RES (249)..(270): Any amino acid
  MOD_RES (287)..(289): Any amino acid
  MOD_RES (305)..(314): Any amino acid
  MOD_RES (326)..(345): Any amino acid
  MOD_RES (358)..(359): Any amino acid
  MOD_RES (368)..(370): Any amino acid
  MOD_RES (382)..(403): Any amino acid
  MOD_RES (415)..(416): Any amino acid
  MOD_RES (433)..(436): Any amino acid
  MOD_RES (466)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXYRDWSKPQCXVTGFAPFSXXXXIRLSAGGAIWVTREPYVSCSXXXXXXXXLGQGTTLKNXXXXXXXXDRIPHRTLLMSELGVPFYLGTKQVCXXXXSSSCHDGRAWLHVCITGXXXNATASVIYXXXXXXXXXXXXXRILRTQESECVCVNXICTVVMTDGSATXXXXXXXXXXXXXXXXXXXXXXGGAQHVEECSCYPRSPXXXCVCRDNWRGSNRPIVXXXXXXXXXXSSYICSGLVGDXXXXXXXXXXXXXXXXXXXXGNPGVKGWAFDYXXDIWMGRTIXXXSRSGYETFRVIXXXXXXXXXXXXXXXXXXXXXXRSGYSGVFSVEXXRCINRCFYVELIRGRNXXXXVGWTSNSIVEFCGTSGIYGTGTWPDGADIXXXXXXXXXX

SEQ ID NO: 418467 - protein, 475 aa, Influenza virus
  MOD_RES (1)..(84): Any amino acid
  MOD_RES (94)..(94): Any amino acid
  MOD_RES (103)..(108): Any amino acid
  MOD_RES (127)..(134): Any amino acid
  MOD_RES (144)..(151): Any amino acid
  MOD_RES (181)..(181): Any amino acid
  MOD_RES (197)..(200): Any amino acid
  MOD_RES (209)..(221): Any amino acid
  MOD_RES (236)..(236): Any amino acid
  MOD_RES (250)..(270): Any amino acid
  MOD_RES (287)..(296): Any amino acid
  MOD_RES (307)..(345): Any amino acid
  MOD_RES (358)..(370): Any amino acid
  MOD_RES (382)..(403): Any amino acid
  MOD_RES (412)..(416): Any amino acid
  MOD_RES (433)..(440): Any amino acid
  MOD_RES (461)..(462): Any amino acid
  MOD_RES (473)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXYRSWSKPQCXINGFAPFSXXXXXXVSAGGDIWITREPYVSCGXXXXXXXXLGQGTTLSNXXXXXXXXDRTSYRTLLMNELGVPFYLGTRQVCIAWSXSSCHDGKSWLHVCVTXXXXNATASLIYXXXXXXXXXXXXXKILRTHESECVCISXTCAVVMTDGSGSGXXXXXXXXXXXXXXXXXXXXXGNAQHVEECSCYPRYSXXXXXXXXXXKGSNRPIIDIXXXXXXXXXXXXXXXXXXXXXXXXXXXXXXXXXXXXXXXGDHGVKGWAFDSXXXXXXXXXXXXXSRLGYETFRVTXXXXXXXXXXXXXXXXXXXXXXWSGYSGVFXXXXXSCVNRCFYVELIRGRPXXXXXXXXSNSVVVFCGASGTYGTGTWPXXRTSISCLYKLXXX

SEQ ID NO: 418468 - protein, 475 aa, Influenza virus
  MOD_RES (1)..(84): Any amino acid
  MOD_RES (94)..(95): Any amino acid
  MOD_RES (104)..(109): Any amino acid
  MOD_RES (127)..(151): Any amino acid
  MOD_RES (162)..(165): Any amino acid
  MOD_RES (181)..(200): Any amino acid
  MOD_RES (209)..(227): Any amino acid
  MOD_RES (236)..(236): Any amino acid
  MOD_RES (245)..(296): Any amino acid
  MOD_RES (307)..(345): Any amino acid
  MOD_RES (358)..(403): Any amino acid
  MOD_RES (412)..(424): Any amino acid
  MOD_RES (433)..(441): Any amino acid
  MOD_RES (465)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXYRNWAKPQCXXTGFASFSKXXXXXXSAGGAVWVTREPYVSCKXXXXXXXXXXXXXXXXXXXXXXXXXDRSPYRTLLMXXXXVPFHLGTRQVCMAWSXXXXXXXXXXXXXXXXXXXXNATARFIFXXXXXXXXXXXXXXXXXXXESECVCIDXICAVVMTDXXXXXXXXXXXXXXXXXXXXXXXXXXXXXXXXXXXXXXXXXXXXXXXXXXXXKGSNRPVIDIXXXXXXXXXXXXXXXXXXXXXXXXXXXXXXXXXXXXXXXGSHGVKGWAFDEXXXXXXXXXXXXXXXXXXXXXXXXXXXXXXXXXXXXXXXXXXXXXXMSGYSGIFXXXXXXXXXXXXXVELIRGREXXXXXXXXXNSIVVFCSTSGTYGAGSWPDGRTXXXXXXXXXXX

SEQ ID NO: 418469 - protein, 475 aa, Influenza virus
  MOD_RES (1)..(95): Any amino acid
  MOD_RES (104)..(112): Any amino acid
  MOD_RES (121)..(165): Any amino acid
  MOD_RES (174)..(240): Any amino acid
  MOD_RES (250)..(405): Any amino acid
  MOD_RES (415)..(442): Any amino acid
  MOD_RES (451)..(451): Any amino acid
  MOD_RES (464)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGFAPFSKXXXXXXXXXGDIWATREXXXXXXXXXXXXXXXXXXXXXXXXXXXXXXXXXXXXXXXXXXXXXIPFHLGTRXXXXXXXXXXXXXXXXXXXXXXXXXXXXXXXXXXXXXXXXXXXXXXXXXXXXXXXXXXXXXXXXXXXIMIDGSASGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYFGVFSVEXXXXXXXXXXXXXXXXXXXXXXXXXXXXSIVVFCGAXGTCGTGSWPDGRXXXXXXXXXXXX

SEQ ID NO: 418470 - protein, 475 aa, Influenza virus
  MOD_RES (1)..(113): Any amino acid
  MOD_RES (122)..(443): Any amino acid
  MOD_RES (463)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDIWVTRKPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVVFCGTPGTYGKGSWPDGXXXXXXXXXXXXX

SEQ ID NO: 418471 - protein, 475 aa, Influenza virus
  MOD_RES (1)..(452): Any amino acid
  MOD_RES (466)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYGTGAWPDGADIXXXXXXXXXX

SEQ ID NO: 418472 - protein, 569 aa, Influenza virus
  MOD_RES (15)..(21): Any amino acid
  MOD_RES (94)..(94): Any amino acid
  MOD_RES (106)..(110): Any amino acid
  MOD_RES (126)..(131): Any amino acid
  MOD_RES (140)..(161): Any amino acid
  MOD_RES (173)..(182): Any amino acid
  MOD_RES (195)..(222): Any amino acid
  MOD_RES (231)..(241): Any amino acid
  MOD_RES (255)..(259): Any amino acid
  MOD_RES (289)..(294): Any amino acid
  MOD_RES (330)..(331): Any amino acid
  MOD_RES (341)..(341): Any amino acid
  MOD_RES (392)..(399): Any amino acid
  MOD_RES (412)..(412): Any amino acid
  MOD_RES (437)..(437): Any amino acid
  MOD_RES (527)..(527): Any amino acid
MDNQTKTMTITFLIXXXXXXXGDQICIGYHANNSTEKVDTILERNVTVTHAKDILEKTHNGKLCKLNGIPPLELGDCSIAGWLLGNPECDRLLXVPEWSYIVEKEXXXXXLCYPGSFNDYEELKHXXXXXXHFEKVKILXXXXXXXXXXXXXXXXXXXXXXPSFFRNMVWLTXXXXXXXXXXRSYNNTSGEQMLXXXXXXXXXXXXXXXXXXXXXXXXXXXXTSTLNKRSXXXXXXXXXXXGQGGRMEFSWTLLXXXXXINFESTGNLIAPEYGFKISKRGSSGIMKTXXXXXXCETKCQTPLGAINTTLPFHNIHPLTIGECPKYVKSXXLVLATGLRNXPQIESRGLFGAIAGFIEGGWQGMVDGWYGYHHSNDQGSGYAADKESTQKAXXXXXXXXNSVIEKMNTQFEXVGKEFNNLERRLENLNKKMEDGFLXVWTYNAELLVLMENERTLDFHDSNVKNLYDKVRMQLRDNAKEIGNGCFEFYHKCDDECMNSVKNGTYDYPKYEEESKLNRNEIKGVKLSXMGVYQILAIYATVAGSLSLAIMIAGISFWMCSNGSLQCRICI

SEQ ID NO: 418473 - protein, 569 aa, Influenza virus
  MOD_RES (15)..(21): Any amino acid
  MOD_RES (94)..(94): Any amino acid
  MOD_RES (106)..(110): Any amino acid
  MOD_RES (126)..(131): Any amino acid
  MOD_RES (140)..(161): Any amino acid
  MOD_RES (170)..(182): Any amino acid
  MOD_RES (195)..(222): Any amino acid
  MOD_RES (231)..(241): Any amino acid
  MOD_RES (255)..(259): Any amino acid
  MOD_RES (289)..(294): Any amino acid
  MOD_RES (330)..(331): Any amino acid
  MOD_RES (341)..(341): Any amino acid
  MOD_RES (352)..(357): Any amino acid
  MOD_RES (392)..(399): Any amino acid
  MOD_RES (411)..(412): Any amino acid
  MOD_RES (437)..(437): Any amino acid
  MOD_RES (527)..(527): Any amino acid
  MOD_RES (538)..(542): Any amino acid
  MOD_RES (563)..(569): Any amino acid
MDNQTKKMTITFLIXXXXXXXGDQICVGYHSNNSTEKIDTILEKNVTVTHAQDILEKVHNGKLCRLSGIPPLELRDCSIAGWLLGNPKCDRLLXVPEWSYIMEKEXXXXXLCYPGNFNEYEELKHXXXXXXHFEKIKILXXXXXXXXXXXXXXXXXXXXXXSSFFRNMVXXXXXXXXXXXXXGSYNNTSGKQMLXXXXXXXXXXXXXXXXXXXXXXXXXXXXTSTLYKRSXXXXXXXXXXXGLGSRMEFSWTILXXXXXISFESTGNLVAPEYGFKISKRGGSGIMKTXXXXXXCETRCQTPLGALNTTLPFHNVHPLTIGECPKYIKSXXLVLATGPRNXPQMESRGLFGXXXXXXEGGWQGMIDGWYGYHHSNDQGAGYAADKESTQRAXXXXXXXXNFVIEKMNTQSXXVGKEFSNLEKRLENLNKKVEDGFLXVWTYNVELLVLMENEMTLDFHDSNVRNLYDRVRMQLRDNVKELGNGCFEFYHKCNDECMNSVRNGTYDYSKYEEESKLKRNEIKGVELSXMGIYQILAIYXXXXXSLSLAIMMAGISLWMCSNGSXXXXXXX

SEQ ID NO: 418474 - protein, 569 aa, Influenza virus
  MOD_RES (12)..(21): Any amino acid
  MOD_RES (75)..(83): Any amino acid
  MOD_RES (94)..(94): Any amino acid
  MOD_RES (106)..(110): Any amino acid
  MOD_RES (125)..(131): Any amino acid
  MOD_RES (140)..(161): Any amino acid
  MOD_RES (173)..(182): Any amino acid
  MOD_RES (195)..(222): Any amino acid
  MOD_RES (231)..(241): Any amino acid
  MOD_RES (253)..(259): Any amino acid
  MOD_RES (289)..(294): Any amino acid
  MOD_RES (306)..(311): Any amino acid
  MOD_RES (330)..(331): Any amino acid
  MOD_RES (341)..(341): Any amino acid
  MOD_RES (354)..(378): Any amino acid
  MOD_RES (392)..(399): Any amino acid
  MOD_RES (412)..(412): Any amino acid
  MOD_RES (437)..(437): Any amino acid
  MOD_RES (526)..(527): Any amino acid
  MOD_RES (536)..(542): Any amino acid
  MOD_RES (563)..(569): Any amino acid
MDNKTKKMTITXXXXXXXXXXGDRICIGYHANNSTETVDTILEQNVTVTHAKNILEKTHNGKLCRLRGIPPLELXXXXXXXXXLGNPECDILLXVPEWSYIIEKEXXXXXLCYPGSLNDYEELKXXXXXXXHFEKVRILXXXXXXXXXXXXXXXXXXXXXXPSFFRNMIWLTXXXXXXXXXXGSYNNTNGEQILXXXXXXXXXXXXXXXXXXXXXXXXXXXXTSILNKRSXXXXXXXXXXXGLGGRMEFYWTXXXXXXXINFESNGNLIAPEYGFRISKRGSSGVMKTXXXXXXCETQCQTPLGAXXXXXXFHNIHPLAIGECPKYVRSXXLILATGLRNXPQIEPRGLFGAIXXXXXXXXXXXXXXXXXXXXXXXXXSGYAADKASTQKAXXXXXXXXNSVIEKINTQFEXVGKEFNSLERRLENLSKRMEDGFIXVWTYNAEVLVLMENERTLEFHDSNVKSLYDKVRMQLKDNAKEVGNGCFEFYHKCDNECMDSVRNGTYNYPKYEEESRLNRNEIKGLKLXXMGAYQILAXXXXXXXSLSLAIMVAGISIWMCSNGSXXXXXXX

SEQ ID NO: 418475 - protein, 569 aa, Influenza virus
  MOD_RES (11)..(23): Any amino acid
  MOD_RES (81)..(83): Any amino acid
  MOD_RES (94)..(96): Any amino acid
  MOD_RES (106)..(116): Any amino acid
  MOD_RES (126)..(131): Any amino acid
  MOD_RES (140)..(185): Any amino acid
  MOD_RES (195)..(222): Any amino acid
  MOD_RES (231)..(241): Any amino acid
  MOD_RES (255)..(274): Any amino acid
  MOD_RES (289)..(294): Any amino acid
  MOD_RES (309)..(331): Any amino acid
  MOD_RES (341)..(341): Any amino acid
  MOD_RES (354)..(399): Any amino acid
  MOD_RES (412)..(412): Any amino acid
  MOD_RES (437)..(437): Any amino acid
  MOD_RES (446)..(449): Any amino acid
  MOD_RES (485)..(489): Any amino acid
  MOD_RES (527)..(528): Any amino acid
  MOD_RES (538)..(546): Any amino acid
  MOD_RES (562)..(569): Any amino acid
MDKQTKTMTIXXXXXXXXXXXXXQICIGYHSNNSTKKVDTNLERNVTVTHAQNILERTHNGKLCKLSGIPPLVLGDCSIAXXXLGNPECDLLLXXXEWSYIVEREXXXXXXXXXXXFNNYEELKHXXXXXXHFEKVRIMXXXXXXXXXXXXXXXXXXXXXXXXXXXXXXXXXXXXXXXXXXXXXXNNTSGEQILXXXXXXXXXXXXXXXXXXXXXXXXXXXXTSKLNKRSXXXXXXXXXXXGQRGRMEFFWTLLXXXXXXXXXXXXXXXXXXXXFKISKRGNSGIMKTXXXXXXCETKCQSPLGAINTXXXXXXXXXXXXXXXXXXXXXXXLVLAAGLRNXPQIEARGLFGAIXXXXXXXXXXXXXXXXXXXXXXXXXXXXXXXXXXXXXXXXXXXXXXNSIIEKMNTQFGXVGKEFGNLEKRLGNLNKKMEDGFIXVWTYNTELXXXXENERTLDYHDSNVKNLYNKVRMQLRDNAKELGNGCXXXXXKCDDECMDSIRNGTYDYPKYEKESKLNRTEIKGVKLNXXGVYQILVIYXXXXXXXXXAIMIAGIFLWMCSNGXXXXXXXX

SEQ ID NO: 418476 - protein, 569 aa, Influenza virus
  MOD_RES (1)..(23): Any amino acid
  MOD_RES (41)..(49): Any amino acid
  MOD_RES (77)..(84): Any amino acid
  MOD_RES (94)..(97): Any amino acid
  MOD_RES (106)..(116): Any amino acid
  MOD_RES (126)..(131): Any amino acid
  MOD_RES (140)..(185): Any amino acid
  MOD_RES (195)..(222): Any amino acid
  MOD_RES (231)..(241): Any amino acid
  MOD_RES (253)..(278): Any amino acid
  MOD_RES (289)..(294): Any amino acid
  MOD_RES (304)..(331): Any amino acid
  MOD_RES (341)..(341): Any amino acid
  MOD_RES (352)..(400): Any amino acid
  MOD_RES (412)..(423): Any amino acid
  MOD_RES (437)..(449): Any amino acid
  MOD_RES (488)..(489): Any amino acid
  MOD_RES (527)..(546): Any amino acid
  MOD_RES (562)..(569): Any amino acid
XXXXXXXXXXXXXXXXXXXXXXXQICVGYHANNSTERVDTXXXXXXXXXHAQDILERTHNGKLCRLNGVPPLELGDXXXXXXXXGNPECDLFLXXXXWSYIMEKKXXXXXXXXXXXFNGYEELKHXXXXXXHFEKIRILXXXXXXXXXXXXXXXXXXXXXXXXXXXXXXXXXXXXXXXXXXXXXXNNTSGEQVLXXXXXXXXXXXXXXXXXXXXXXXXXXXXTSTVNKRSXXXXXXXXXXXGLGRRMEFSWTXXXXXXXXXXXXXXXXXXXXXXXXXXKRGSSGIVKTXXXXXXCDTKCQTPLXXXXXXXXXXXXXXXXXXXXXXXXXXXXLVLATGLKNXPQTESRGLFGXXXXXXXXXXXXXXXXXXXXXXXXXXXXXXXXXXXXXXXXXXXXXXXXXSVIEKMNIQFEXXXXXXXXXXXXLENLDKKMEDGFRXXXXXXXXXXXXXENERILDFHDSNVKNLYEKVRMQLRDNAKETGNGCFEFXXKCDDECMSSVKNGTYYYPKYEEESKLNRTEIKGIKLSXXXXXXXXXXXXXXXXXXXXAIMMAGIFFWMCSNGXXXXXXXX

SEQ ID NO: 418477 - protein, 569 aa, Influenza virus
  MOD_RES (1)..(37): Any amino acid
  MOD_RES (46)..(49): Any amino acid
  MOD_RES (66)..(68): Any amino acid
  MOD_RES (77)..(117): Any amino acid
  MOD_RES (126)..(401): Any amino acid
  MOD_RES (410)..(425): Any amino acid
  MOD_RES (434)..(451): Any amino acid
  MOD_RES (463)..(500): Any amino acid
  MOD_RES (509)..(510): Any amino acid
  MOD_RES (527)..(569): Any amino acid
XXXXXXXXXXXXXXXXXXXXXXXXXXXXXXXXXXXXXIDTILERNXXXXHAKDILERMHNGKLCRXXXTPPLELGDXXXXXXXXXXXXXXXXXXXXXXXXXXXXXXXXXXXXXXXXXNDYEEFKHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVEKMNTQXXXXXXXXXXXXXXXXNLNKRMEDXXXXXXXXXXXXXXXXXXERTLGFHDSNVXXXXXXXXXXXXXXXXXXXXXXXXXXXXXXXXXXXXXXTGTYDYPKXXEESKLNRSEIKGVKLRXXXXXXXXXXXXXXXXXXXXXXXXXXXXXXXXXXXXXXXXXXX

SEQ ID NO: 418478 - protein, 569 aa, Influenza virus
  MOD_RES (1)..(54): Any amino acid
  MOD_RES (64)..(402): Any amino acid
  MOD_RES (412)..(455): Any amino acid
  MOD_RES (464)..(504): Any amino acid
  MOD_RES (513)..(569): Any amino acid
XXXXXXXXXXXXXXXXXXXXXXXXXXXXXXXXXXXXXXXXXXXXXXXXXXXXXXLEKMHNGKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIEKMNTRFEXXXXXXXXXXXXXXXXXXXXXXXXXXXXXXXXXXXXXXXXXXXXDFHDSSVKXXXXXXXXXXXXXXXXXXXXXXXXXXXXXXXXXXXXXXXXXNYSKYEEEXXXXXXXXXXXXXXXXXXXXXXXXXXXXXXXXXXXXXXXXXXXXXXXXXXXXXXXXX

SEQ ID NO: 418479 - protein, 569 aa, Influenza virus
  MOD_RES (1)..(56): Any amino acid
  MOD_RES (65)..(569): Any amino acid
XXXXXXXXXXXXXXXXXXXXXXXXXXXXXXXXXXXXXXXXXXXXXXXXXXXXXXXXKAHNGKLCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418480 - protein, 562 aa, Influenza virus
  MOD_RES (1)..(12): Any amino acid
  MOD_RES (101)..(101): Any amino acid
  MOD_RES (121)..(121): Any amino acid
  MOD_RES (136)..(154): Any amino acid
  MOD_RES (166)..(172): Any amino acid
  MOD_RES (199)..(203): Any amino acid
  MOD_RES (214)..(215): Any amino acid
  MOD_RES (224)..(234): Any amino acid
  MOD_RES (248)..(249): Any amino acid
  MOD_RES (386)..(391): Any amino acid
XXXXXXXXXXXXVRGDQICIGYHANNSTEKVDTILERNVTVTHAKDILEKTHNGKLCKLNGIPPLELGDCSIAGWLLGNPECDRLLSVPEWSYIMEKENPXNGLCYPGSFNDYEELKHLLXSVKHFEKVKILPKDXXXXXXXXXXXXXXXXXXXPSFFRNMVWLTXXXXXXXVAKGSYNNTSGEQMLIIWGVHHPNDEXXXXXLYQNVGTYVSXXTSTLNKRSXXXXXXXXXXXGQGGRMEFSWTLLXXWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFXXXXXXVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 418481 - protein, 562 aa, Influenza virus
  MOD_RES (1)..(12): Any amino acid
  MOD_RES (76)..(79): Any amino acid
  MOD_RES (101)..(101): Any amino acid
  MOD_RES (121)..(121): Any amino acid
  MOD_RES (136)..(154): Any amino acid
  MOD_RES (163)..(172): Any amino acid
  MOD_RES (199)..(203): Any amino acid
  MOD_RES (214)..(215): Any amino acid
  MOD_RES (224)..(234): Any amino acid
  MOD_RES (248)..(249): Any amino acid
  MOD_RES (347)..(350): Any amino acid
  MOD_RES (386)..(391): Any amino acid
  MOD_RES (437)..(438): Any amino acid
  MOD_RES (534)..(535): Any amino acid
XXXXXXXXXXXXVKGDQICIGYHSNNSTEKADTILERNVTVTHAQDILEKTHNGRLCRLSGIPPLELGDCSITGWXXXXPECDRLLRVPEWSYIVERENPXDGLCYPGSLNDYEELKLLLXSVTHFEKVKILARNXXXXXXXXXXXXXXXXXXXSSFFRNMVXXXXXXXXXXIAKRSYNNTSGEQVLVIWGIHHPNDDXXXXXLYQKVGTYVSXXTSTLYKRSXXXXXXXXXXXGLGSRMEFSWTILXXWDVINFESTGNLVAPEYGFKISRRGGSGIMKTEKTLEDCETKCQTPLGALNTTLPFHNIHPLTIGECPRYVKSEKLVLATGPRNVPQIEPRGLFGAIXXXXEGGWQGMIDGWYGYHHSNDQGAGYAADKESTQRAFXXXXXXVNSIIEKMNTQSEAVGKEFNNLERRLENLSKRMEDGFIDVWTYNAXXLVLMENEMTLDFHDSSVKSLYDKVRMQLKDNAKEIGNGCFEFYHKCNDECMNSVRNGTYDYPKYEKESKLNRNEIKGVELSSMGVYQILVIYATVXXSLSLAIMIAGISLWMCSNGSLQFRICI

SEQ ID NO: 418482 - protein, 562 aa, Influenza virus
  MOD_RES (1)..(12): Any amino acid
  MOD_RES (63)..(66): Any amino acid
  MOD_RES (77)..(79): Any amino acid
  MOD_RES (101)..(101): Any amino acid
  MOD_RES (121)..(121): Any amino acid
  MOD_RES (136)..(154): Any amino acid
  MOD_RES (166)..(172): Any amino acid
  MOD_RES (199)..(203): Any amino acid
  MOD_RES (214)..(215): Any amino acid
  MOD_RES (224)..(234): Any amino acid
  MOD_RES (248)..(249): Any amino acid
  MOD_RES (302)..(305): Any amino acid
  MOD_RES (342)..(371): Any amino acid
  MOD_RES (386)..(391): Any amino acid
  MOD_RES (436)..(441): Any amino acid
  MOD_RES (475)..(478): Any amino acid
  MOD_RES (528)..(535): Any amino acid
  MOD_RES (548)..(553): Any amino acid
  MOD_RES (562)..(562): Any amino acid
XXXXXXXXXXXXVRGDQICVGYHSNNSTKKVDTNLERNVTVTHAKNILEKTHNGKLCRLSGIXXXXLGNCSIAGWLXXXPECDRLLTVPEWSYIIEKENPXYSLCYPGSFNNYEELKHLIXSVRHFEKVKILPRDXXXXXXXXXXXXXXXXXXXPSFFRNMIWLTXXXXXXXVAKRSYNNTNGEQILIIWGIHHPNDEXXXXXLYQEVGTYVSXXTSKLNKRSXXXXXXXXXXXGLGGRMEFFWTLLXXWDVISFESTGNLIAPEYGFRISKRGSSGVMKTEGTLGNCETKCQSPLGAINTXXXXHNIHPLTMGECPKYVRSEKLVLATGLRNIPQIESRGXXXXXXXXXXXXXXXXXXXXXXXXXXXXXXSGYAADKASTQKAIXXXXXXVNFVIEKMNTQFGAVGKEFGNLERRLENLNKRMEDGLLDVWTYNXXXXXXMENERTLGFHDSNVKSLYDRVRMQLRDNAKEIGXXXXEFYHKCDNECMDSVKNGTYYYPKYEEESRLNRNEIKGIKLSNMGVYQILXXXXXXXXSLSLAIMVAGISXXXXXXGSLQCRVCX

SEQ ID NO: 418483 - protein, 562 aa, Influenza virus
  MOD_RES (1)..(12): Any amino acid
  MOD_RES (38)..(42): Any amino acid
  MOD_RES (68)..(79): Any amino acid
  MOD_RES (101)..(101): Any amino acid
  MOD_RES (120)..(121): Any amino acid
  MOD_RES (136)..(172): Any amino acid
  MOD_RES (199)..(203): Any amino acid
  MOD_RES (214)..(234): Any amino acid
  MOD_RES (248)..(249): Any amino acid
  MOD_RES (258)..(262): Any amino acid
  MOD_RES (297)..(306): Any amino acid
  MOD_RES (345)..(377): Any amino acid
  MOD_RES (386)..(391): Any amino acid
  MOD_RES (432)..(442): Any amino acid
  MOD_RES (464)..(465): Any amino acid
  MOD_RES (478)..(487): Any amino acid
  MOD_RES (524)..(524): Any amino acid
  MOD_RES (533)..(539): Any amino acid
  MOD_RES (555)..(562): Any amino acid
XXXXXXXXXXXXVKGDRICIGYHANNSTETVDTILERXXXXXHAQNILEKTHNGKLCRLRGIPPLELXXXXXXXXXXXXPECDRLLNVPEWSYIVEKENPXYSLCYPGNFNDYEELKYLXXRVTHFEKVRILPKDXXXXXXXXXXXXXXXXXXXXXXXXXXXXXXXXXXXXXVAQGSYNNTSGKQMLIIWGVHHPIDEXXXXXLYQNVETYVSXXXXXXXXXXXXXXXXXXXXXGLGRRMEFSWILLXXLDTINFESXXXXXVPEYGFKISKRGGSGIMKTGGTLENCDTKCQTPLXXXXXXXXXXNVHPLAIGECPKYVKSDRLVLATGLRNAHKMESRGLFGXXXXXXXXXXXXXXXXXXXXXXXXXXXXXXXXXKESTQKAIXXXXXXVNSMIEKMNIQFESVGKEFSNLEKRLENLNKKVEDGFLDVXXXXXXXXXXXENERILDFHDSNVRNLYDKVRXXLRDNAKELGNGCXXXXXXXXXXCMSSVKNGTYDYSKYEEESKLKRNEIKGVKLSNMGVXQVLAIYATXXXXXXXAIMIAGIFLWMCSNGXXXXXXXX

SEQ ID NO: 418484 - protein, 562 aa, Influenza virus
  MOD_RES (1)..(24): Any amino acid
  MOD_RES (38)..(43): Any amino acid
  MOD_RES (57)..(79): Any amino acid
  MOD_RES (101)..(101): Any amino acid
  MOD_RES (110)..(111): Any amino acid
  MOD_RES (121)..(121): Any amino acid
  MOD_RES (136)..(172): Any amino acid
  MOD_RES (199)..(234): Any amino acid
  MOD_RES (243)..(249): Any amino acid
  MOD_RES (260)..(274): Any amino acid
  MOD_RES (283)..(285): Any amino acid
  MOD_RES (298)..(315): Any amino acid
  MOD_RES (344)..(377): Any amino acid
  MOD_RES (386)..(391): Any amino acid
  MOD_RES (403)..(404): Any amino acid
  MOD_RES (438)..(452): Any amino acid
  MOD_RES (468)..(487): Any amino acid
  MOD_RES (499)..(502): Any amino acid
  MOD_RES (531)..(539): Any amino acid
  MOD_RES (555)..(562): Any amino acid
XXXXXXXXXXXXXXXXXXXXXXXXNNSTEMVDTILERXXXXXXAQDILERTHNGKLXXXXXXXXXXXXXXXXXXXXXXXPECDRFLSIPEWSYIVERETPXYNLCYPGSXXDYEELKHFLXSVTHFEKIKILPRDXXXXXXXXXXXXXXXXXXXXXXXXXXXXXXXXXXXXXVARGSYNNTSGEQMLVIWGVHHPKDEXXXXXXXXXXXXXXXXXXXXXXXXXXXXXXXXXXXXGLESRMEFXXXXXXXWDTISFESTGXXXXXXXXXXXXXXXSSGIMKTGXXXENCETQCQTPLGXXXXXXXXXXXXXXXXXXCPKYVKSKRLVLATGLRNVPQMESRGLFXXXXXXXXXXXXXXXXXXXXXXXXXXXXXXXXXXKESTQKAVXXXXXXENSVIEKMNIQXXAVEKEFSNLEKRLENLDKKMEDGFLGVWTYNAEXXXXXXXXXXXXXXXSNVKNLYNKVRMQLRXXXXXXXXXXXXXXXXXXXXCMNSVKTGTYDXXXXEEESKLNKNEIKGVKLSNMGIYQILAIYXXXXXXXXXAIMMAGIFFWMCSNGXXXXXXXX

SEQ ID NO: 418485 - protein, 562 aa, Influenza virus
  MOD_RES (1)..(25): Any amino acid
  MOD_RES (39)..(45): Any amino acid
  MOD_RES (59)..(85): Any amino acid
  MOD_RES (94)..(102): Any amino acid
  MOD_RES (111)..(111): Any amino acid
  MOD_RES (120)..(122): Any amino acid
  MOD_RES (132)..(174): Any amino acid
  MOD_RES (184)..(277): Any amino acid
  MOD_RES (287)..(288): Any amino acid
  MOD_RES (297)..(316): Any amino acid
  MOD_RES (331)..(331): Any amino acid
  MOD_RES (345)..(393): Any amino acid
  MOD_RES (405)..(407): Any amino acid
  MOD_RES (419)..(420): Any amino acid
  MOD_RES (437)..(452): Any amino acid
  MOD_RES (468)..(489): Any amino acid
  MOD_RES (500)..(515): Any amino acid
  MOD_RES (528)..(562): Any amino acid
XXXXXXXXXXXXXXXXXXXXXXXXXNSTEKIDTILERNXXXXXXXDILEKAHNGKLCRXXXXXXXXXXXXXXXXXXXXXXXXXXXLIVPEWSYXXXXXXXXXSLCYPGSLXEYEELKHLXXXVKHFEKVRIXXXXXXXXXXXXXXXXXXXXXXXXXXXXXXXXXXXXXXXXXXXKGSYNNTNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIMKTEKTFEXXEIKCQTPLXXXXXXXXXXXXXXXXXXXXPKYVKSERLVLATGXRNVPQIEARGLFGXXXXXXXXXXXXXXXXXXXXXXXXXXXXXXXXXXXXXXXXXXXXXXXXXSVIEKINTQFEXXXKEFNNLEKRLEXXNKKMEDGLRDVWTYNAXXXXXXXXXXXXXXXXSNVKNLYEKVRMQLRXXXXXXXXXXXXXXXXXXXXXXNSIRNGTYDYXXXXXXXXXXXXXXXXVKLSSMGIYQILXXXXXXXXXXXXXXXXXXXXXXXXXXXXXXXXXXX

SEQ ID NO: 418486 - protein, 562 aa, Influenza virus
  MOD_RES (1)..(102): Any amino acid
  MOD_RES (111)..(322): Any amino acid
  MOD_RES (331)..(414): Any amino acid
  MOD_RES (436)..(491): Any amino acid
  MOD_RES (506)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLCYPGNFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRLVLAIGXXXXXXXXXXXXXXXXXXXXXXXXXXXXXXXXXXXXXXXXXXXXXXXXXXXXXXXXXXXXXXXXXXXXXXXXXXXXXXXXXXXXKRLGNLNKKMEDGFRDVWTYNXXXXXXXXXXXXXXXXXXXXXXXXXXXXXXXXXXXXXXXXXXXXXXXXXXXXXXXXVRNGTYNYPKYEEEXXXXXXXXXXXXXXXXXXXXXXXXXXXXXXXXXXXXXXXXXXXXXXXXXXXXXXXXX

SEQ ID NO: 418487 - protein, 469 aa, Influenza virus
  MOD_RES (17)..(24): Any amino acid
  MOD_RES (44)..(51): Any amino acid
  MOD_RES (62)..(62): Any amino acid
  MOD_RES (75)..(83): Any amino acid
  MOD_RES (210)..(212): Any amino acid
  MOD_RES (387)..(387): Any amino acid
MNPNQKIITIGSVSLTXXXXXXXXQIAILATTVTLHFKQHECDXXXXXXXXPCEPIIIERNXTEIVYLNNTTIEXXXXXXXXXYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGXXXDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDLRSGYETFKVIGGWSTPXSKSQVNRQVIVDNNNWSGYSGIFSVEGKSCINRCFYVELIRGRPQETRVWWTSNSIVVFCGTSGTYGTGSWPDGANINFMPI

SEQ ID NO: 418488 - protein, 469 aa, Influenza virus
  MOD_RES (17)..(24): Any amino acid
  MOD_RES (44)..(51): Any amino acid
  MOD_RES (62)..(62): Any amino acid
  MOD_RES (75)..(83): Any amino acid
  MOD_RES (101)..(103): Any amino acid
  MOD_RES (157)..(158): Any amino acid
  MOD_RES (210)..(212): Any amino acid
  MOD_RES (387)..(387): Any amino acid
  MOD_RES (452)..(455): Any amino acid
MNPNQKTITIGSVSLIXXXXXXXXQIAILVTTVTLHFKQNECSXXXXXXXXPCEPIIVERNXTEIVYLNDTIIEXXXXXXXXXYRSWSKPQCKITGFAPFXXXNSIRLSADGDIWVTREPYVSCSPSKCYQFALGQGTTLNNKHSNGTKHDRIPHRXXLMNELGVSFHLGTKQVCIAWSSSSCHDGRAWLHVCVTGDDKNATASFIYNGXXXDSIVSWSQNILRTHESECVCISGTCAVVMTDGSASGKADTRILFVKEGKIIHISPLSGSAQHVEECSCYPQYPDVRCVCRDNWKGSNRPIIDINMADYSIDSGYVCSGLVGDTPRNGDSSSSSNCRDPNNERGTQGVKGWAFDSGNDVWMGRTINKDSRSGYETFRVIGGWATAXSKSQINRQVIVDSDNRSGYSGIFSVEHKGCINRCFYVELIRGRKQETRVWWTSNSIAVFCGTSGXXXXGSWPDGADINFMPI

SEQ ID NO: 418489 - protein, 469 aa, Influenza virus
  MOD_RES (1)..(2): Any amino acid
  MOD_RES (17)..(24): Any amino acid
  MOD_RES (44)..(51): Any amino acid
  MOD_RES (60)..(62): Any amino acid
  MOD_RES (75)..(83): Any amino acid
  MOD_RES (99)..(103): Any amino acid
  MOD_RES (126)..(126): Any amino acid
  MOD_RES (157)..(164): Any amino acid
  MOD_RES (180)..(184): Any amino acid
  MOD_RES (210)..(212): Any amino acid
  MOD_RES (221)..(224): Any amino acid
  MOD_RES (244)..(245): Any amino acid
  MOD_RES (274)..(275): Any amino acid
  MOD_RES (376)..(376): Any amino acid
  MOD_RES (387)..(387): Any amino acid
  MOD_RES (439)..(439): Any amino acid
  MOD_RES (449)..(457): Any amino acid
XXPNQKIITMGSVSLTXXXXXXXXQIAILAATVTLHFKQHDCDXXXXXXXXPCEPTIIEXXXTEIVYLNSTTIEXXXXXXXXXYRDWSKPQCHITGFAXXXXXNSIRLSASGDIWITREPYVSCNXVKCYQFALGQGTTLENKHSNGTVHDRIPHRXXXXXXXXVPFHLGTRQVCIAWSXXXXXDGKAWLHICVTGDDENATASLIYDGXXXDSISSWSQXXXXTQESECICINGSCTVVMTDXXASGRADTKILFIEEGKIVHIGPLSGSAQXXEECSCYSRYPNVRCVCRDNWRGSNRPVVDINIAEYSIDSSYICSGLVGDTPRNNDGSSNSNCRNPNNERGNQGVKGWAFDDGSDVWMGRTISRDSRSGYEXFKVIGGWTTAXSKSQTNRQVIVDSNNWSGYSGIFSVENKRCINRCFYVELIRGRQQETRVWWXSNSIVVFVAXXXXXXXXXWPDGANIDFMPV

SEQ ID NO: 418490 - protein, 469 aa, Influenza virus
  MOD_RES (1)..(3): Any amino acid
  MOD_RES (17)..(24): Any amino acid
  MOD_RES (41)..(52): Any amino acid
  MOD_RES (62)..(62): Any amino acid
  MOD_RES (75)..(87): Any amino acid
  MOD_RES (101)..(104): Any amino acid
  MOD_RES (118)..(118): Any amino acid
  MOD_RES (135)..(139): Any amino acid
  MOD_RES (161)..(168): Any amino acid
  MOD_RES (180)..(186): Any amino acid
  MOD_RES (210)..(212): Any amino acid
  MOD_RES (228)..(228): Any amino acid
  MOD_RES (239)..(250): Any amino acid
  MOD_RES (277)..(278): Any amino acid
  MOD_RES (294)..(296): Any amino acid
  MOD_RES (386)..(387): Any amino acid
  MOD_RES (409)..(414): Any amino acid
  MOD_RES (439)..(457): Any amino acid
  MOD_RES (469)..(469): Any amino acid
XXXNQKIITIDSVSLTXXXXXXXXHIAILATTITLHFKQNXXXXXXXXXXXXCEPIIIEKNXTEIMYLNNTTLEXXXXXXXXXXXXXSKPQCQIAGFAPFXXXXPIRLSGGGDIWVTXEPYVSCDTNKCYQFALXXXXXLDNKHSNDTIHDRTPHRTLLMXXXXXXXXLGTRQVCVAWSXXXXXXXKAWLHVCITGDDKNATASFVYDGXXXDSIGSWSHNILRTQEXECVCINGSCTXXXXXXXXXXXXDTRILFIEEGKVVHISPLAGSAQHVEXXSCYPRYPGVRCICRDXXXGSNRPVLDISMEDYSIDSNYVCSGLVGDTPRSDDSSSNSKSRDPNNEKGNQGVKGWAFDYGNDLWMGRTISKESRSGYETFRVIGGWTTXXSKSQTSRQIIVDNNNRSGYSGXXXXXXKSCVNRCFYVELIRGRSQETRVWWXXXXXXXXXXXXXXXXXXXWPDGANTNFMPX

SEQ ID NO: 418491 - protein, 469 aa, Influenza virus
  MOD_RES (1)..(4): Any amino acid
  MOD_RES (15)..(33): Any amino acid
  MOD_RES (44)..(52): Any amino acid
  MOD_RES (62)..(62): Any amino acid
  MOD_RES (75)..(87): Any amino acid
  MOD_RES (97)..(108): Any amino acid
  MOD_RES (135)..(141): Any amino acid
  MOD_RES (161)..(168): Any amino acid
  MOD_RES (184)..(192): Any amino acid
  MOD_RES (207)..(213): Any amino acid
  MOD_RES (223)..(228): Any amino acid
  MOD_RES (244)..(250): Any amino acid
  MOD_RES (273)..(278): Any amino acid
  MOD_RES (295)..(296): Any amino acid
  MOD_RES (315)..(323): Any amino acid
  MOD_RES (353)..(356): Any amino acid
  MOD_RES (369)..(376): Any amino acid
  MOD_RES (387)..(387): Any amino acid
  MOD_RES (402)..(414): Any amino acid
  MOD_RES (442)..(458): Any amino acid
XXXXQKIITIGFVSXXXXXXXXXXXXXXXXXXXTLHFKQHKCDXXXXXXXXXCDPIIIERNXKEIVYLNNTIIEXXXXXXXXXXXXXSKTQCQITGXXXXXXXXXXXXSAGGDIWITREPYVSCDSSKCHQFALXXXXXXXNKHSNDTVHDRSPHRTLLMXXXXXXXXLGTKQVCAAWSSSSCXXXXXXXXXCITGDDRNATASLIXXXXXXXSVGSWSQNIXXXXXXECVCINGICTVVMTDXXXXXXXDTRILFIREGKIVHVSPLSGSAXXXXXXSCYPRYPNVRCICKDNXXGSNRPIVDINMVDYSIDSXXXXXXXXXDTPRNDDRSSNSNCKDPNNERGYPGVKGWXXXXGNDLWMGTTISKXXXXXXXXFRVIGGWVTAXSKSQANRQVIVGNNXXXXXXXXXXXXXKNCINRCFYVELIRGMPQEARVWWTSNXXXXXXXXXXXXXXXXXPDGANINLMPI

SEQ ID NO: 418492 - protein, 469 aa, Influenza virus
  MOD_RES (1)..(5): Any amino acid
  MOD_RES (17)..(35): Any amino acid
  MOD_RES (44)..(109): Any amino acid
  MOD_RES (127)..(147): Any amino acid
  MOD_RES (157)..(193): Any amino acid
  MOD_RES (210)..(282): Any amino acid
  MOD_RES (291)..(305): Any amino acid
  MOD_RES (314)..(324): Any amino acid
  MOD_RES (354)..(359): Any amino acid
  MOD_RES (368)..(378): Any amino acid
  MOD_RES (387)..(399): Any amino acid
  MOD_RES (408)..(424): Any amino acid
  MOD_RES (434)..(458): Any amino acid
XXXXXKIITIGSASLTXXXXXXXXXXXXXXXXXXXHFKQHECNXXXXXXXXXXXXXXXXXXXXXXXXXXXXXXXXXXXXXXXXXXXXXXXXXXXXXXXXXXXXXXXXXXAGGDIWVMREPYVSCGPXXXXXXXXXXXXXXXXXXXXXTIHDRSPHRXXXXXXXXXXXXXXXXXXXXXXXXXXXXXXXXXXXXXVTGYEKNATASFIYGGXXXXXXXXXXXXXXXXXXXXXXXXXXXXXXXXXXXXXXXXXXXXXXXXXXXXXXXXXXXXXXXXXXXXXXXXXRYPDVRCVXXXXXXXXXXXXXXXSMEDYSIGXXXXXXXXXXXTPRNDDRFSNSNCRNPNNEKGNHGVKGWAXXXXXXVLMGRTISXXXXXXXXXXXVIGGWSTAXXXXXXXXXXXXXSNNRSGYSXXXXXXXXXXXXXXXXXELIRGRRQEXXXXXXXXXXXXXXXXXXXXXXXXXPDGANISFMPI

SEQ ID NO: 418493 - protein, 469 aa, Influenza virus
  MOD_RES (1)..(198): Any amino acid
  MOD_RES (207)..(282): Any amino acid
  MOD_RES (298)..(338): Any amino acid
  MOD_RES (347)..(360): Any amino acid
  MOD_RES (369)..(399): Any amino acid
  MOD_RES (408)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNATASFVXXXXXXXXXXXXXXXXXXXXXXXXXXXXXXXXXXXXXXXXXXXXXXXXXXXXXXXXXXXXXXXXXXXXXXXXXXXXRYPDVRCTCRDNWKGXXXXXXXXXXXXXXXXXXXXXXXXXXXXXXXXXXXXXXXXXNPNNERGTXXXXXXXXXXXXXXWMGRTIGKXXXXXXXXXXXXXXXXXXXXXXXXXXXXXXXKNNWSGYSXXXXXXXXXXXXXXXXXXXXXXXXXXXXXXXXXXXXXXXXXXXXXXXXXXXXXXXXXXXXXX

SEQ ID NO: 418494 - protein, 469 aa, Influenza virus
  MOD_RES (1)..(284): Any amino acid
  MOD_RES (294)..(340): Any amino acid
  MOD_RES (352)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDVRCICKDXXXXXXXXXXXXXXXXXXXXXXXXXXXXXXXXXXXXXXXXXXXXXXXNNERGNHGVKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418495 - protein, 580 aa, Influenza virus
  MOD_RES (13)..(13): Any amino acid
  MOD_RES (22)..(29): Any amino acid
  MOD_RES (51)..(57): Any amino acid
  MOD_RES (72)..(86): Any amino acid
  MOD_RES (105)..(110): Any amino acid
  MOD_RES (119)..(121): Any amino acid
  MOD_RES (132)..(133): Any amino acid
  MOD_RES (148)..(172): Any amino acid
  MOD_RES (183)..(200): Any amino acid
  MOD_RES (213)..(257): Any amino acid
  MOD_RES (269)..(273): Any amino acid
  MOD_RES (288)..(291): Any amino acid
  MOD_RES (300)..(306): Any amino acid
  MOD_RES (337)..(338): Any amino acid
  MOD_RES (385)..(385): Any amino acid
  MOD_RES (414)..(414): Any amino acid
  MOD_RES (508)..(508): Any amino acid
  MOD_RES (519)..(520): Any amino acid
  MOD_RES (532)..(539): Any amino acid
  MOD_RES (559)..(561): Any amino acid
MLSLIMRTVIALXRFSYVFCLXXXXXXXXNNNNNTATTLCLGHHAVPNGTXXXXXXXDQIEVTNATELVQSXXXXXXXXXXXXXXXWEKNCTLIDALLGDPHCDXXXXXXWDLFVERSXXXSNCYPYDVPDXXSLRSLVASSGTLEFXXXXXXXXXXXXXXXXXXXXXXXXXSFFSRLNWLTXXXXXXXXXXXXXXXXXXFDKLYIWGVHHPXXXXXXXXXXXXXXXXXXXXXXXXXXXXXXXXXXXXXXXXXXXXXSIYWTIVKPGDXXXXXSTGNLIAPRGYFKIXXXXLNNEIRWPXXXXXXXSECITPNGSIPNDKPFQNVNRITYGACPRYXXQNTLKLATGMRNVPEKQTRGIFGAIAGFIENGWEGMVDGWYGFRHQXQNSEGTGQAADLKSTQAAIDQINGKLNRXIGKTNEKFHQIEKEFSEVEGRIQDLEKYVEDTKIDLWSYNAELLVALENQHTIDLTDSEMNKLFEKTKKQLRENAEDMGNGCFKIYHKCDNACXGSIRNGTYDHXXYRDEALNNRFQXXXXXXXXGYKDWILWISFAISCFLLCXXXLGFIMWACQKGNIRCNICI

SEQ ID NO: 418496 - protein, 580 aa, Influenza virus
  MOD_RES (1)..(3): Any amino acid
  MOD_RES (13)..(13): Any amino acid
  MOD_RES (22)..(32): Any amino acid
  MOD_RES (51)..(57): Any amino acid
  MOD_RES (72)..(90): Any amino acid
  MOD_RES (105)..(110): Any amino acid
  MOD_RES (119)..(121): Any amino acid
  MOD_RES (132)..(133): Any amino acid
  MOD_RES (147)..(172): Any amino acid
  MOD_RES (183)..(200): Any amino acid
  MOD_RES (213)..(257): Any amino acid
  MOD_RES (269)..(273): Any amino acid
  MOD_RES (287)..(306): Any amino acid
  MOD_RES (337)..(338): Any amino acid
  MOD_RES (367)..(367): Any amino acid
  MOD_RES (385)..(385): Any amino acid
  MOD_RES (414)..(414): Any amino acid
  MOD_RES (424)..(424): Any amino acid
  MOD_RES (508)..(508): Any amino acid
  MOD_RES (519)..(520): Any amino acid
  MOD_RES (532)..(539): Any amino acid
  MOD_RES (559)..(561): Any amino acid
  MOD_RES (579)..(580): Any amino acid
XXXHSMSGFRSNXVLSCIFCLXXXXXXXXXXXNNSTATLCLGHHAVANGTXXXXXXXDHIEVTNATELVQNXXXXXXXXXXXXXXXXXXXCTLMDALLGDPQCDXXXXXXWDLYVERSXXXSNCYPYDIPDXXSLRSLIASSGTLEXXXXXXXXXXXXXXXXXXXXXXXXXXGFFSRLNWLHXXXXXXXXXXXXXXXXXXFDKLYVWGVHHPXXXXXXXXXXXXXXXXXXXXXXXXXXXXXXXXXXXXXXXXXXXXXSIYWTVVKPGDXXXXXSNGNLIAPRGYFRXXXXXXXXXXXXXXXXXXXXSACITPNGSISNDKPFQNVNKITYGACPKYXXQSTLKLATGMRNIPEKQTRGLFGAIAGFXENGWEGMIDGWYGFRYQXQNSEGIGQAADLKSTQTAIDQITGKLNRXIEKTNEKFHXIEKEFSEIEGRIQDLERYVEDTKIDLWSYNAGLLVALENQNTIDLTDAEMNKLFERTRRQLRENAEDIGNGCFTIYHKCDNSCXESIRNGTYNHXXYRDEAVNNRFQXXXXXXXXGYKDWVLWISFAISCFLICXXXLGFIVWACQRGNIRCNIXX

SEQ ID NO: 418497 - protein, 580 aa, Influenza virus
  MOD_RES (1)..(10): Any amino acid
  MOD_RES (20)..(35): Any amino acid
  MOD_RES (51)..(57): Any amino acid
  MOD_RES (72)..(90): Any amino acid
  MOD_RES (105)..(110): Any amino acid
  MOD_RES (119)..(121): Any amino acid
  MOD_RES (132)..(133): Any amino acid
  MOD_RES (146)..(172): Any amino acid
  MOD_RES (183)..(200): Any amino acid
  MOD_RES (213)..(257): Any amino acid
  MOD_RES (266)..(273): Any amino acid
  MOD_RES (288)..(306): Any amino acid
  MOD_RES (337)..(338): Any amino acid
  MOD_RES (364)..(367): Any amino acid
  MOD_RES (414)..(414): Any amino acid
  MOD_RES (425)..(440): Any amino acid
  MOD_RES (476)..(480): Any amino acid
  MOD_RES (506)..(508): Any amino acid
  MOD_RES (517)..(520): Any amino acid
  MOD_RES (532)..(539): Any amino acid
  MOD_RES (559)..(561): Any amino acid
XXXXXXXXXXIFIFILLTHXXXXXXXXXXXXXXXXMATLCLGHHAVQNGTXXXXXXXDQVEVTNATELVQIXXXXXXXXXXXXXXXXXXXCTLIDAMLGDPHCDXXXXXXWDLFIERSXXXSNCYPYYVPDXXSLRSIVASSGTLXXXXXXXXXXXXXXXXXXXXXXXXXXXGFFRRLNWLTXXXXXXXXXXXXXXXXXXSDKLYIWGIHHPXXXXXXXXXXXXXXXXXXXXXXXXXXXXXXXXXXXXXXXXXXXXXSVYWTVVKXXXXXXXXSNGNLVAPRGYFKMXXXXXXXXXXXXXXXXXXXSGCITPNGSIPNEKPFQNVNKVTYGKCPKYXXQKTLKLATGMRNVPERQIRGIFGAIXXXXENGWEGMMDGWYGFRFRHQNSEGRGQAADLKSTQAAINQINEKLNRXIERTNEKFHQXXXXXXXXXXXXXXXXKYVEDTKVDLWSYNADVLVALENQHTIHLTDSEMNXXXXXTRKQLRENAEDMGGGCFKIYHRCDNXXXDSIRNGTYXXXXYRNEALNNRFHXXXXXXXXEYKDWILWISFATSCFLLCXXXLGFIMWTCQKGNIKCNICI

SEQ ID NO: 418498 - protein, 580 aa, Influenza virus
  MOD_RES (1)..(10): Any amino acid
  MOD_RES (20)..(35): Any amino acid
  MOD_RES (49)..(57): Any amino acid
  MOD_RES (72)..(90): Any amino acid
  MOD_RES (102)..(110): Any amino acid
  MOD_RES (119)..(121): Any amino acid
  MOD_RES (132)..(133): Any amino acid
  MOD_RES (148)..(172): Any amino acid
  MOD_RES (182)..(257): Any amino acid
  MOD_RES (269)..(273): Any amino acid
  MOD_RES (288)..(306): Any amino acid
  MOD_RES (327)..(328): Any amino acid
  MOD_RES (337)..(338): Any amino acid
  MOD_RES (365)..(370): Any amino acid
  MOD_RES (384)..(385): Any amino acid
  MOD_RES (394)..(396): Any amino acid
  MOD_RES (414)..(414): Any amino acid
  MOD_RES (424)..(453): Any amino acid
  MOD_RES (478)..(486): Any amino acid
  MOD_RES (508)..(508): Any amino acid
  MOD_RES (519)..(520): Any amino acid
  MOD_RES (532)..(539): Any amino acid
  MOD_RES (559)..(563): Any amino acid
XXXXXXXXXXIFIFLLLTHXXXXXXXXXXXXXXXXAATLCLGHHAVSNXXXXXXXXXDRIEVTNATELVQGXXXXXXXXXXXXXXXXXXXCTLVDALLGDPXXXXXXXXXWDLFVERNXXXSSCYPYDVPEXXTLRSLVASSGNLEFXXXXXXXXXXXXXXXXXXXXXXXXXSFFSKLNWLXXXXXXXXXXXXXXXXXXXXXXXXXXXXXXXXXXXXXXXXXXXXXXXXXXXXXXXXXXXXXXXXXXXXXXXXXXXXSVYWTIVKSGDXXXXXCTGNLIAPRGYFKLXXXXXXXXXXXXXXXXXXXFECITPNGSIPNNKPFQNVNXXTYGPCPRYXXQGTLKLATGMRNVPETQTKGLFGAIAXXXXXXWEGMVNGWYGFRHXXHNSEGTGQXXXFKSTQAAIDQVNGKLNRXIKKTNEKFHXXXXXXXXXXXXXXXXXXXXXXXXXXXXXXNAEFLVALENQHTIDLADSEMNKLXXXXXXXXXENAEDMGDGCFKIYHKCDNTCXESIRTGTYDHXXYRDEALSNRFQXXXXXXXXGYKDWFLWISFAMSCFLLCXXXXXFIMWACQRGNIRCDICI

SEQ ID NO: 418499 - protein, 580 aa, Influenza virus
  MOD_RES (1)..(10): Any amino acid
  MOD_RES (20)..(110): Any amino acid
  MOD_RES (119)..(121): Any amino acid
  MOD_RES (132)..(137): Any amino acid
  MOD_RES (148)..(174): Any amino acid
  MOD_RES (183)..(257): Any amino acid
  MOD_RES (268)..(279): Any amino acid
  MOD_RES (288)..(311): Any amino acid
  MOD_RES (327)..(338): Any amino acid
  MOD_RES (363)..(377): Any amino acid
  MOD_RES (399)..(405): Any amino acid
  MOD_RES (414)..(414): Any amino acid
  MOD_RES (423)..(464): Any amino acid
  MOD_RES (482)..(489): Any amino acid
  MOD_RES (508)..(508): Any amino acid
  MOD_RES (519)..(522): Any amino acid
  MOD_RES (532)..(539): Any amino acid
  MOD_RES (553)..(567): Any amino acid
  MOD_RES (576)..(580): Any amino acid
XXXXXXXXXXIFNFILLTHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWDLYIERSXXXSDCYPYDVQDXXXXXXIVASSGTVEFXXXXXXXXXXXXXXXXXXXXXXXXXXXFSRLNWLYXXXXXXXXXXXXXXXXXXXXXXXXXXXXXXXXXXXXXXXXXXXXXXXXXXXXXXXXXXXXXXXXXXXXXXXXXXXSIHWTIVKPGXXXXXXXXXXXXAPRGYFKVXXXXXXXXXXXXXXXXXXXXXXXXPNGSIPNGKPFQNVNXXXXXXXXXXXXQDTLKLATGMRNIPERQARGIFGAXXXXXXXXXXXXXXXGRLVRFRHQNSEGMGQAADLKXXXXXXXQINGKLNKXVEKTNEKFXXXXXXXXXXXXXXXXXXXXXXXXXXXXXXXXXXXXXXXXXXHTIDLTDAEMSKLFEKTXXXXXXXXEDMGNGCLKIYHKCDNVCXGSIRNETYDHXXXXDEALNNRSQXXXXXXXXGYKNWILWISFAMXXXXXXXXXXXXXXXACQKGNIKXXXXX

SEQ ID NO: 418500 - protein, 580 aa, Influenza virus
  MOD_RES (1)..(174): Any amino acid
  MOD_RES (183)..(279): Any amino acid
  MOD_RES (288)..(355): Any amino acid
  MOD_RES (364)..(379): Any amino acid
  MOD_RES (390)..(467): Any amino acid
  MOD_RES (482)..(494): Any amino acid
  MOD_RES (506)..(522): Any amino acid
  MOD_RES (531)..(549): Any amino acid
  MOD_RES (559)..(569): Any amino acid
  MOD_RES (579)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFARLNWLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAPRGYYKMXXXXXXXXXXXXXXXXXXXXXXXXXXXXXXXXXXXXXXXXXXXXXXXXXXXXXXXXXXXXXXXXXXXXTRGLFGAKXXXXXXXXXXXXXXXXWYGFRHQNSEXXXXXXXXXXXXXXXXXXXXXXXXXXXXXXXXXXXXXXXXXXXXXXXXXXXXXXXXXXXXXXXXXXXXXXXXXXXXXXDLTDSEMSKLFERTXXXXXXXXXXXXXGCFRIYHKCDNXXXXXXXXXXXXXXXXXDEALNNRLXXXXXXXXXXXXXXXXXXXFAISCLLLCXXXXXXXXXXXQKGNIRCDIXX

SEQ ID NO: 418501 - protein, 580 aa, Influenza virus
  MOD_RES (1)..(379): Any amino acid
  MOD_RES (391)..(498): Any amino acid
  MOD_RES (508)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRYQNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIYHKCNNACXXXXXXXXXXXXXXXXXXXXXXXXXXXXXXXXXXXXXXXXXXXXXXXXXXXXXXXXXXXXXXXXXXXXXXXXX

SEQ ID NO: 418502 - protein, 580 aa, Influenza virus
  MOD_RES (1)..(380): Any amino acid
  MOD_RES (391)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYGFRHLNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418503 - protein, 580 aa, Influenza virus
  MOD_RES (1)..(380): Any amino acid
  MOD_RES (391)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYGFRHHNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418504 - protein, 574 aa, Influenza virus
  MOD_RES (10)..(23): Any amino acid
  MOD_RES (51)..(51): Any amino acid
  MOD_RES (66)..(82): Any amino acid
  MOD_RES (99)..(104): Any amino acid
  MOD_RES (113)..(115): Any amino acid
  MOD_RES (127)..(127): Any amino acid
  MOD_RES (143)..(166): Any amino acid
  MOD_RES (177)..(194): Any amino acid
  MOD_RES (209)..(250): Any amino acid
  MOD_RES (263)..(267): Any amino acid
  MOD_RES (282)..(283): Any amino acid
  MOD_RES (293)..(300): Any amino acid
  MOD_RES (408)..(408): Any amino acid
  MOD_RES (514)..(514): Any amino acid
  MOD_RES (530)..(530): Any amino acid
  MOD_RES (553)..(555): Any amino acid
HSMSGFRSNXXXXXXXXXXXXXXNNNNNTATTLCLGHHAVPNGTIVKTITXDQIEVTNATELVQSXXXXXXXXXXXXXXXXXKNCTLIDALLGDPQCDXXXXXXWDLFVERSXXXSNCYPYDVPDYXSLRSLVASSGTLEFNXXXXXXXXXXXXXXXXXXXXXXXXSFFSRLNWLTXXXXXXXXXXXXXXXXXXFDKLYIWGVHHPGTXXXXXXXXXXXXXXXXXXXXXXXXXXXXXXXXXXXXXXXXXXISIYWTIVKPGDXXXXXSTGNLIAPRGYFKIXXGKSSIMRSDXXXXXXXXSECITPNGSIPNDKPFQNVNRITYGACPRYVKQNTLKLATGMRNVPEKQTRGIFGAIAGFIENGWEGMVDGWYGFRHQHQNSEGTGQAADLKSTQAAINQINGKLNRXIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDXYRDEALNNRFQIKGVXLKSGYKDWILWISFAISCFLLCXXXLGFIMWACQKGNIRCNICI

SEQ ID NO: 418505 - protein, 574 aa, Influenza virus
  MOD_RES (1)..(1): Any amino acid
  MOD_RES (10)..(26): Any amino acid
  MOD_RES (51)..(51): Any amino acid
  MOD_RES (66)..(84): Any amino acid
  MOD_RES (99)..(104): Any amino acid
  MOD_RES (113)..(115): Any amino acid
  MOD_RES (127)..(127): Any amino acid
  MOD_RES (143)..(166): Any amino acid
  MOD_RES (177)..(194): Any amino acid
  MOD_RES (209)..(250): Any amino acid
  MOD_RES (259)..(267): Any amino acid
  MOD_RES (282)..(283): Any amino acid
  MOD_RES (293)..(300): Any amino acid
  MOD_RES (361)..(361): Any amino acid
  MOD_RES (408)..(408): Any amino acid
  MOD_RES (418)..(422): Any amino acid
  MOD_RES (514)..(514): Any amino acid
  MOD_RES (530)..(530): Any amino acid
  MOD_RES (553)..(555): Any amino acid
  MOD_RES (573)..(574): Any amino acid
XMKTIIIVLXXXXXXXXXXXXXXXXXNNSTATLCLGHHAVPNGTLVKTITXDHIEVTNATELVQNXXXXXXXXXXXXXXXXXXXCTLMDALLGDPHCDXXXXXXWDLFIERSXXXSNCYPYYVPDYXSLRSLIASSGTLEFIXXXXXXXXXXXXXXXXXXXXXXXXGFFSRLNWLHXXXXXXXXXXXXXXXXXXFDKLYVWGVHHPSTXXXXXXXXXXXXXXXXXXXXXXXXXXXXXXXXXXXXXXXXXXVSIYWTIVXXXXXXXXXSNGNLIAPRGYYKMXXGKSSIMKSDXXXXXXXXSACITPNGSISNDKPFQNVNKITYGACPKYVKQSTLKLATGMRNIPEKQTRGLFGAIAGFXENGWEGMMDGWYGFRHHHQNSEGIGQAADLKSTQAAIDQINGKLNKXIEKTNEKFHXXXXXFTEVEGRIQDLERYVEDTKIDLWSYNAGLLVALENQHTIHLTDSEMNKLFEKTRKQLRENAEEMGNGCFTIYHKCDNSCMESIRNGTYNHDXYRDEAVNNRFQIKSVXLKSEYKDWILWISFATSCFLLCXXXLGFIVWACQRGNIRCNIXX

SEQ ID NO: 418506 - protein, 574 aa, Influenza virus
  MOD_RES (1)..(29): Any amino acid
  MOD_RES (51)..(51): Any amino acid
  MOD_RES (66)..(84): Any amino acid
  MOD_RES (96)..(104): Any amino acid
  MOD_RES (113)..(115): Any amino acid
  MOD_RES (127)..(127): Any amino acid
  MOD_RES (143)..(166): Any amino acid
  MOD_RES (177)..(194): Any amino acid
  MOD_RES (209)..(250): Any amino acid
  MOD_RES (263)..(267): Any amino acid
  MOD_RES (281)..(283): Any amino acid
  MOD_RES (293)..(300): Any amino acid
  MOD_RES (356)..(361): Any amino acid
  MOD_RES (386)..(390): Any amino acid
  MOD_RES (408)..(408): Any amino acid
  MOD_RES (418)..(434): Any amino acid
  MOD_RES (455)..(458): Any amino acid
  MOD_RES (514)..(514): Any amino acid
  MOD_RES (530)..(530): Any amino acid
  MOD_RES (547)..(555): Any amino acid
XXXXXXXXXXXXXXXXXXXXXXXXXXXXXMATLCLGHHAVPNGTVVKTITXDQVEVTNATELVQIXXXXXXXXXXXXXXXXXXXCTLVDALLGDPXXXXXXXXXWDLYVERSXXXSSCYPYDVPEYXSLRSIVASSGTLEFTXXXXXXXXXXXXXXXXXXXXXXXXGFFRRLNWLTXXXXXXXXXXXXXXXXXXSDKLYIWGIHHPSTXXXXXXXXXXXXXXXXXXXXXXXXXXXXXXXXXXXXXXXXXXISVYWTVVKPGDXXXXXCTGNLIAPRGYFRXXXGKSSVMRSDXXXXXXXXSGCITPNGSIPNEKPFQNVNRITYGPCPRYVKQKTLKLATGMRNVPETQTRGIFGXXXXXXENGWEGMIDGWYGFRFRHQNSEGTXXXXXFKSTQAAIDQVNGKLNRXIKKTNEKFHXXXXXXXXXXXXXXXXXKYVEDTKVDLWSYNAELLIAXXXXNTIDLTDSEMSKLFERTRRQLRENAEDLGNGCFKIYHKCDNTCIESIRNGTYDHNXYRNEALNNRFQIKGIXLKTGYKDWVLWISFAIXXXXXXXXXLGFIMWTCQKGNIKCNICI

SEQ ID NO: 418507 - protein, 574 aa, Influenza virus
  MOD_RES (1)..(29): Any amino acid
  MOD_RES (38)..(39): Any amino acid
  MOD_RES (51)..(104): Any amino acid
  MOD_RES (113)..(115): Any amino acid
  MOD_RES (127)..(132): Any amino acid
  MOD_RES (143)..(168): Any amino acid
  MOD_RES (177)..(200): Any amino acid
  MOD_RES (209)..(250): Any amino acid
  MOD_RES (262)..(273): Any amino acid
  MOD_RES (282)..(283): Any amino acid
  MOD_RES (293)..(300): Any amino acid
  MOD_RES (339)..(340): Any amino acid
  MOD_RES (356)..(362): Any amino acid
  MOD_RES (386)..(391): Any amino acid
  MOD_RES (408)..(408): Any amino acid
  MOD_RES (417)..(447): Any amino acid
  MOD_RES (459)..(462): Any amino acid
  MOD_RES (471)..(483): Any amino acid
  MOD_RES (514)..(516): Any amino acid
  MOD_RES (530)..(530): Any amino acid
  MOD_RES (553)..(557): Any amino acid
XXXXXXXXXXXXXXXXXXXXXXXXXXXXXAATLCLGHXXVPNGTIVRTITXXXXXXXXXXXXXXXXXXXXXXXXXXXXXXXXXXXXXXXXXXXXXXXXXXXXXXWDLFVERNXXXSDCYPYDVQDYXXXXXXVASSGNLEFTXXXXXXXXXXXXXXXXXXXXXXXXXXFSRLNWLYXXXXXXXXXXXXXXXXXXXXXXXXWGVHHPITXXXXXXXXXXXXXXXXXXXXXXXXXXXXXXXXXXXXXXXXXXISIHWTIVKPGXXXXXXXXXXXXAPRGYFKMXXGRSSIMRSDXXXXXXXXFECITPNGSIPNGKPFQNVNRITYGVCPRYIKQNTLKLXXGMRNVPERQTRGIFGXXXXXXXNGWEGMVNGWYGFRHRHQNSEGIXXXXXXKSTQAAVNQITGKLNRXVEKTNEKFXXXXXXXXXXXXXXXXXXXXXXXXXXXXXXXNAEFLVALENQXXXXLADSEMNKXXXXXXXXXXXXXEDMGNGCLKIYHKCDNSCIGSIRNETYDHDXXXDEALNNRSQIKGVXLKSGYKNWILWISFAMSCFLLCXXXXXFIMWACQRGNIRCDICI

SEQ ID NO: 418508 - protein, 574 aa, Influenza virus
  MOD_RES (1)..(39): Any amino acid
  MOD_RES (49)..(118): Any amino acid
  MOD_RES (127)..(134): Any amino acid
  MOD_RES (143)..(200): Any amino acid
  MOD_RES (209)..(250): Any amino acid
  MOD_RES (261)..(273): Any amino acid
  MOD_RES (282)..(283): Any amino acid
  MOD_RES (292)..(305): Any amino acid
  MOD_RES (321)..(323): Any amino acid
  MOD_RES (332)..(340): Any amino acid
  MOD_RES (356)..(371): Any amino acid
  MOD_RES (393)..(398): Any amino acid
  MOD_RES (407)..(447): Any amino acid
  MOD_RES (458)..(466): Any amino acid
  MOD_RES (476)..(484): Any amino acid
  MOD_RES (501)..(517): Any amino acid
  MOD_RES (529)..(530): Any amino acid
  MOD_RES (539)..(561): Any amino acid
  MOD_RES (570)..(574): Any amino acid
XXXXXXXXXXXXXXXXXXXXXXXXXXXXXXXXXXXXXXXVPNGTMVKTXXXXXXXXXXXXXXXXXXXXXXXXXXXXXXXXXXXXXXXXXXXXXXXXXXXXXXXXXXXXXXXXXXXXXXYPYDVPDHXXXXXXXXSSGTLEFVXXXXXXXXXXXXXXXXXXXXXXXXXXXXXXXXXXXXXXXXXXXXXXXXXXXXXXXXXXWGVHHPVTXXXXXXXXXXXXXXXXXXXXXXXXXXXXXXXXXXXXXXXXXXISVYWTIVKPXXXXXXXXXXXXXAPRGYFKVXXGKSSIIRSXXXXXXXXXXXXXXPNGSIPNNKPFQNVNXXXYGACPKYIXXXXXXXXXGMRNIPERQTRGLFGXXXXXXXXXXXXXXXXGRLVRFRHQNSEGRGQAADLKXXXXXXTQITGKLNXXXXXXXXXXXXXXXXXXXXXXXXXXXXXXXXXXXXXXXXXNAEILVALENXXXXXXXXXEMSKLFEKTXXXXXXXXXDMGNGCFTIYHKCNNAXXXXXXXXXXXXXXXXXEALSNRFQIKSXXLKSGYKEWXXXXXXXXXXXXXXXXXXXXXXXACQKGNIKXXXXX

SEQ ID NO: 418509 - protein, 574 aa, Influenza virus
  MOD_RES (1)..(252): Any amino acid
  MOD_RES (261)..(284): Any amino acid
  MOD_RES (293)..(318): Any amino acid
  MOD_RES (332)..(373): Any amino acid
  MOD_RES (388)..(399): Any amino acid
  MOD_RES (408)..(450): Any amino acid
  MOD_RES (459)..(484): Any amino acid
  MOD_RES (503)..(520): Any amino acid
  MOD_RES (529)..(533): Any amino acid
  MOD_RES (542)..(563): Any amino acid
  MOD_RES (573)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIYWTVVKPXXXXXXXXXXXXXXXXXXXXXXXXKSSIMRSNXXXXXXXXXXXXXXXXXXXXXXXXXXINRITYGACPRYIXXXXXXXXXXXXXXXXXXXXXXXXXXXXXXXXXXXXXXXXXXWYGFRHQNSEGMGQXXXXXXXXXXXXQISGKLNRXXXXXXXXXXXXXXXXXXXXXXXXXXXXXXXXXXXXXXXXXXXVLVALENQXXXXXXXXXXXXXXXXXXXXXXXXXXDMGNGCFRIYHKCDNACMXXXXXXXXXXXXXXXXXXNNRLQIKGXXXXXGYKDWFLWXXXXXXXXXXXXXXXXXXXXXXQKGNIRCDIXX

SEQ ID NO: 418510 - protein, 574 aa, Influenza virus
  MOD_RES (1)..(285): Any amino acid
  MOD_RES (294)..(329): Any amino acid
  MOD_RES (338)..(373): Any amino acid
  MOD_RES (388)..(521): Any amino acid
  MOD_RES (530)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLNNEIRWPXXXXXXXXXXXXXXXXXXXXXXXXXXXXXXXXXXXXYVRQNTLKXXXXXXXXXXXXXXXXXXXXXXXXXXXXXXXXXXXXWYGFRHHNSEGTGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNRFHIKGVXXXXXXXXXXXXXXXXXXXXXXXXXXXXXXXXXXXXXXXXXXXXX

SEQ ID NO: 418511 - protein, 574 aa, Influenza virus
  MOD_RES (1)..(286): Any amino acid
  MOD_RES (295)..(374): Any amino acid
  MOD_RES (385)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSIMRSDAXXXXXXXXXXXXXXXXXXXXXXXXXXXXXXXXXXXXXXXXXXXXXXXXXXXXXXXXXXXXXXXXXXXXXXXXXXXXXXXXYGFRHLNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418512 - protein, 574 aa, Influenza virus
  MOD_RES (1)..(286): Any amino acid
  MOD_RES (295)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSIMRSNAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418513 - protein, 574 aa, Influenza virus
  MOD_RES (1)..(286): Any amino acid
  MOD_RES (295)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSIMKSDAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418514 - protein, 574 aa, Influenza virus
  MOD_RES (1)..(286): Any amino acid
  MOD_RES (295)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSVMRSDAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418515 - protein, 574 aa, Influenza virus
  MOD_RES (1)..(286): Any amino acid
  MOD_RES (295)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSIIRSDAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418516 - protein, 486 aa, Influenza virus
  MOD_RES (20)..(36): Any amino acid
  MOD_RES (46)..(79): Any amino acid
  MOD_RES (89)..(91): Any amino acid
  MOD_RES (101)..(101): Any amino acid
  MOD_RES (134)..(134): Any amino acid
  MOD_RES (151)..(159): Any amino acid
  MOD_RES (205)..(205): Any amino acid
  MOD_RES (218)..(218): Any amino acid
  MOD_RES (228)..(228): Any amino acid
  MOD_RES (257)..(262): Any amino acid
  MOD_RES (271)..(278): Any amino acid
  MOD_RES (318)..(324): Any amino acid
  MOD_RES (340)..(357): Any amino acid
  MOD_RES (380)..(380): Any amino acid
  MOD_RES (392)..(401): Any amino acid
  MOD_RES (410)..(413): Any amino acid
  MOD_RES (442)..(445): Any amino acid
AKAGVKMNPNQKIITIGSVXXXXXXXXXXXXXXXXXTTVTLHFKQXXXXXXXXXXXXXXXXXXXXXXXXXXXXXXXXXXEKEKEICSVXXXYRNWSKPQCXITGFAPFSKDNSIRLSAGGDIWVTREPYVSCDXDKCYQFALGQGTTLNNXXXXXXXXXRTPYRTLLMNELGVPFHLGTKQVCIAWSSSSCHDGKAWLHVCVTGXDKNATASFIYNGXLVDSIGSWSXEILRTQESECVCINGTCTVVMTDGSASGXXXXXXLFIEEGKIXXXXXXXXLSGSAQHVEECSCYPRYPGVRCVCRDNWKGSNRPIVDINXXXXXXXSSYVCSGLVGDTPRKXXXXXXXXXXXXXXXXXXHGVKGWAFDDGNDVWMGRTISEXLRSGYETFKVIXXXXXXXXXXQINRQVIVXXXXRSGYSGIFSVEGKSCINRCFYVELIRGRXXXXEVLWTSNSIVVFCGTSGTYGTGSWPDGADINLHAYISFRNL

SEQ ID NO: 418517 - protein, 486 aa, Influenza virus
  MOD_RES (1)..(6): Any amino acid
  MOD_RES (20)..(36): Any amino acid
  MOD_RES (45)..(91): Any amino acid
  MOD_RES (101)..(109): Any amino acid
  MOD_RES (134)..(134): Any amino acid
  MOD_RES (151)..(159): Any amino acid
  MOD_RES (171)..(172): Any amino acid
  MOD_RES (188)..(194): Any amino acid
  MOD_RES (205)..(205): Any amino acid
  MOD_RES (218)..(218): Any amino acid
  MOD_RES (228)..(228): Any amino acid
  MOD_RES (257)..(262): Any amino acid
  MOD_RES (271)..(278): Any amino acid
  MOD_RES (318)..(324): Any amino acid
  MOD_RES (340)..(357): Any amino acid
  MOD_RES (380)..(380): Any amino acid
  MOD_RES (392)..(401): Any amino acid
  MOD_RES (410)..(413): Any amino acid
  MOD_RES (442)..(445): Any amino acid
  MOD_RES (456)..(458): Any amino acid
  MOD_RES (484)..(486): Any amino acid
XXXXXXMNPNKKIITIGSAXXXXXXXXXXXXXXXXXITVTLHFKXXXXXXXXXXXXXXXXXXXXXXXXXXXXXXXXXXXXXXXXXXXXXXXYRKWSKPQCXXXXXXXXXKDNSIRLAAGGDIWVTRELYVSCDXGKCYQFALGQGTTLDNXXXXXXXXXRIPHRTLLMNEXXVPFHLGTRQVCIAWSXXXXXXXKAWLHVCITGXDENATASFIYDGXLVDSIVSWSXKILRTQESECICINGTCTVIMTDGSASEXXXXXXLFIKEGKIXXXXXXXXLSGSAQHIEECSCYPRFPGVRCICRDNWKGSNRPVVDINXXXXXXXSRYVCSGLVGDTPRNXXXXXXXXXXXXXXXXXXPGVKGWAFDNGDDVWMGRTINEXSRLGYETFKVVXXXXXXXXXXQTNRQVIVXXXXWSGYSGIFSVESKSCVNRCFYVELIRGSXXXXEVWWTSNSIVXXXGTSGTYGSGSWPDGANIKSHAYISFXXX

SEQ ID NO: 418518 - protein, 486 aa, Influenza virus
  MOD_RES (1)..(6): Any amino acid
  MOD_RES (20)..(36): Any amino acid
  MOD_RES (46)..(91): Any amino acid
  MOD_RES (101)..(113): Any amino acid
  MOD_RES (134)..(134): Any amino acid
  MOD_RES (150)..(159): Any amino acid
  MOD_RES (192)..(205): Any amino acid
  MOD_RES (218)..(218): Any amino acid
  MOD_RES (228)..(228): Any amino acid
  MOD_RES (237)..(238): Any amino acid
  MOD_RES (257)..(262): Any amino acid
  MOD_RES (271)..(278): Any amino acid
  MOD_RES (288)..(288): Any amino acid
  MOD_RES (315)..(324): Any amino acid
  MOD_RES (336)..(357): Any amino acid
  MOD_RES (380)..(380): Any amino acid
  MOD_RES (392)..(401): Any amino acid
  MOD_RES (410)..(413): Any amino acid
  MOD_RES (429)..(445): Any amino acid
  MOD_RES (454)..(467): Any amino acid
  MOD_RES (485)..(486): Any amino acid
XXXXXXMYPIKKIITIGAVXXXXXXXXXXXXXXXXXTTITLHFKQXXXXXXXXXXXXXXXXXXXXXXXXXXXXXXXXXXXXXXXXXXXXXXYRDWSKPQCXXXXXXXXXXXXXIRLSAGGAIWVTREPYVSCSXSKCYQFALGQGTTLSXXXXXXXXXXRTPHRTLLMSELGVPFHLGTRQVCMAWSSSSCXXXXXXXXXXXXXXDRNATASFIYGGXLVDSVVSWSXNILRTQESXXVCINGTCAVVMTDGSASDXXXXXXLFIREGKIXXXXXXXXLLGSAQHVEXCSCYPRYSGIRCVCRDNWRGSNRPIVXXXXXXXXXXSSYMCSGLVGDXXXXXXXXXXXXXXXXXXXXXXQGVKGWAFDNENDVWMGRTIGEXSRSGYETFRVIXXXXXXXXXXQVNRQVIVXXXXMSGYSGIFSVENKSCXXXXXXXXXXXXXXXXXRVWWTSNSXXXXXXXXXXXXXXSWPDGADLGLMGRTRISXX

SEQ ID NO: 418519 - protein, 486 aa, Influenza virus
  MOD_RES (1)..(6): Any amino acid
  MOD_RES (16)..(36): Any amino acid
  MOD_RES (46)..(91): Any amino acid
  MOD_RES (101)..(125): Any amino acid
  MOD_RES (134)..(134): Any amino acid
  MOD_RES (143)..(172): Any amino acid
  MOD_RES (181)..(205): Any amino acid
  MOD_RES (218)..(218): Any amino acid
  MOD_RES (228)..(228): Any amino acid
  MOD_RES (237)..(238): Any amino acid
  MOD_RES (256)..(262): Any amino acid
  MOD_RES (271)..(278): Any amino acid
  MOD_RES (288)..(289): Any amino acid
  MOD_RES (305)..(306): Any amino acid
  MOD_RES (318)..(324): Any amino acid
  MOD_RES (336)..(360): Any amino acid
  MOD_RES (380)..(380): Any amino acid
  MOD_RES (389)..(401): Any amino acid
  MOD_RES (410)..(413): Any amino acid
  MOD_RES (435)..(445): Any amino acid
  MOD_RES (454)..(467): Any amino acid
  MOD_RES (483)..(486): Any amino acid
XXXXXXMNPNQRIITXXXXXXXXXXXXXXXXXXXXXTTVTLHFRQXXXXXXXXXXXXXXXXXXXXXXXXXXXXXXXXXXXXXXXXXXXXXXYRSWSKPQCXXXXXXXXXXXXXXXXXXXXXXXXXREPYVSCGXNKCYQFALXXXXXXXXXXXXXXXXXXXXXXXXXXXXXXVPFYLGTKXXXXXXXXXXXXXXXXXXXXXXXXXNENATASFVYDGXLVDSISSWSXDILRTQESXXVCISGTCAVVMTDGNASXXXXXXXLFVEEGKIXXXXXXXXLSGNAQHVEXXSCYPRYPNVRCVCRDXXKGSNRPVIDINXXXXXXXSSYLCSGLVGDXXXXXXXXXXXXXXXXXXXXXXXXXKGWAFDYGNDIWMGRTISKXFRSGYETFXXXXXXXXXXXXXQINKQVIVXXXXRSGYSGVFSVEGKNCINRCFYXXXXXXXXXXXKVWWTSNSXXXXXXXXXXXXXXSWPDGAEINLMPIYSXXXX

SEQ ID NO: 418520 - protein, 486 aa, Influenza virus
  MOD_RES (1)..(7): Any amino acid
  MOD_RES (20)..(36): Any amino acid
  MOD_RES (46)..(91): Any amino acid
  MOD_RES (101)..(205): Any amino acid
  MOD_RES (215)..(218): Any amino acid
  MOD_RES (228)..(245): Any amino acid
  MOD_RES (254)..(262): Any amino acid
  MOD_RES (271)..(289): Any amino acid
  MOD_RES (305)..(306): Any amino acid
  MOD_RES (318)..(367): Any amino acid
  MOD_RES (376)..(380): Any amino acid
  MOD_RES (389)..(401): Any amino acid
  MOD_RES (410)..(445): Any amino acid
  MOD_RES (454)..(473): Any amino acid
  MOD_RES (482)..(486): Any amino acid
XXXXXXXNPNQKIIAIGSVXXXXXXXXXXXXXXXXXTTVTLHLKQXXXXXXXXXXXXXXXXXXXXXXXXXXXXXXXXXXXXXXXXXXXXXXYRNWTKPQCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNNATASFIXXXXLIDSISSWSXXXXXXXXXXXXXXXXXXTVVMTDGNXXXXXXXXXLFVKEGKIXXXXXXXXXXXXXXXXXXXSCYPRYPDVRCVCRDXXKGSNRPIIDINXXXXXXXXXXXXXXXXXXXXXXXXXXXXXXXXXXXXXXXXXXXXXXXXXXGNDLWMGRXXXXXLRLGYETFXXXXXXXXXXXXXQISRQVIVXXXXXXXXXXXXXXXXXXXXXXXXXXXXXXXXXXXXDVLWTSNSXXXXXXXXXXXXXXXXXXXXDIKSHAYIXXXXX

SEQ ID NO: 418521 - protein, 486 aa, Influenza virus
  MOD_RES (1)..(8): Any amino acid
  MOD_RES (19)..(37): Any amino acid
  MOD_RES (46)..(206): Any amino acid
  MOD_RES (215)..(263): Any amino acid
  MOD_RES (274)..(309): Any amino acid
  MOD_RES (318)..(473): Any amino acid
  MOD_RES (482)..(486): Any amino acid
XXXXXXXXPIQKIITIGAXXXXXXXXXXXXXXXXXXXTVTLYFKQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNATASFVXXXXXXXXXXXXXXXXXXXXXXXXXXXXXXXXXXXXXXXXXXXXXXXXXEYYFVKEGKIXXXXXXXXXXXXXXXXXXXXXXXXXXXXXXXXXXXXNRPVVDIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDINLMPIYXXXXX

SEQ ID NO: 418522 - protein, 486 aa, Influenza virus
  MOD_RES (1)..(10): Any amino acid
  MOD_RES (19)..(486): Any amino acid
XXXXXXXXXXQKIITISSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418523 - protein, 486 aa, Influenza virus
  MOD_RES (1)..(11): Any amino acid
  MOD_RES (20)..(486): Any amino acid
XXXXXXXXXXXKIITIGSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418524 - protein, 571 aa, Influenza virus
  MOD_RES (1)..(18): Any amino acid
  MOD_RES (32)..(32): Any amino acid
  MOD_RES (60)..(61): Any amino acid
  MOD_RES (76)..(76): Any amino acid
  MOD_RES (93)..(95): Any amino acid
  MOD_RES (105)..(107): Any amino acid
  MOD_RES (141)..(141): Any amino acid
  MOD_RES (172)..(173): Any amino acid
  MOD_RES (206)..(207): Any amino acid
  MOD_RES (222)..(223): Any amino acid
  MOD_RES (275)..(288): Any amino acid
  MOD_RES (303)..(306): Any amino acid
  MOD_RES (317)..(317): Any amino acid
  MOD_RES (342)..(343): Any amino acid
XXXXXXXXXXXXXXXXXXYTGNPVICLGHHAXVPNGTMVKTLTDDQIEVVTAQELVESQXXPELCPSPLRLVDGQXCDIVNGALGSPGCDHLXXXEWDVFIERPXXXDTCYPFDVPDYQSLRSILANNGKFEFIAEEFQWXTVKQNGKSGACKRANVNDFFNRLNWLTKSDXXAYPLQNLTKVNNGDYARLYIWGVHHPSTDTEQXXLYKNNPGRVTVSTKXXQTSVVPNIGSRPWVRGQSGRISFYWTIVEPGDLIVFNTIGNLIAPRGHYKLXXXXXXXXXXXXXXIGSCVSKCHTDRGSXXXXKPFQNISRISXGDCPKYVKQGSLKLATGMRNIPEKXXRGLFGAIAGFIENGWQGLIDGWYGFRHQNAEGTGTAADLKSTQAAIDQINGKLNRLIEKTNEKYHQIEKEFEQVEGRIQDLEKYVEDTKIDLWSYNAELLVALENQHTIDVTDSEMNKLFERVRRQLRENAEDKGNGCFEIFHQCDNNCIESIRNGTYDHDIYRDEAINNRFQIQGVKLTQGYKDIILWISFSISCFLLISCFLLVALLLAFILWACQNGNIRCQICI

SEQ ID NO: 418525 - protein, 571 aa, Influenza virus
  MOD_RES (1)..(18): Any amino acid
  MOD_RES (32)..(32): Any amino acid
  MOD_RES (60)..(61): Any amino acid
  MOD_RES (76)..(76): Any amino acid
  MOD_RES (93)..(95): Any amino acid
  MOD_RES (105)..(109): Any amino acid
  MOD_RES (141)..(141): Any amino acid
  MOD_RES (172)..(173): Any amino acid
  MOD_RES (206)..(207): Any amino acid
  MOD_RES (222)..(223): Any amino acid
  MOD_RES (274)..(288): Any amino acid
  MOD_RES (303)..(306): Any amino acid
  MOD_RES (317)..(317): Any amino acid
  MOD_RES (332)..(333): Any amino acid
  MOD_RES (342)..(343): Any amino acid
  MOD_RES (352)..(365): Any amino acid
  MOD_RES (377)..(379): Any amino acid
  MOD_RES (441)..(446): Any amino acid
  MOD_RES (524)..(525): Any amino acid
  MOD_RES (549)..(549): Any amino acid
XXXXXXXXXXXXXXXXXXYTENPVICLGHHSXVSNGTMVKTLADDQVEVVTAQELVEAQXXLELCPSPLKLIDGQXCDIINGALGSPGCDRLXXXEWDIFIERPXXXXXCYPFDVPEYQSLRSILANNGRFEFIAEEFPWXTVKQDGKSSACKRANINDFFRRLNWLVKSDXXEYPLQNLTKINNGDYTRLYIWGVHHPSTDKEQXXLYKNSPGRVTVSTQXXQTSIVPNIGIRPLVRGQSGRVSFYWTIVDPGDIIVFNTIGNLVAPRGHYKXXXXXXXXXXXXXXXIGSCASKCHTDKGSXXXXKPFQNVSRIAXGDCPKYIKQGSLKLXXGMRNIPERXXKGLFGAIAXXXXXXXXXXXXXXYGFRHQNSEGTXXXADLKSTQTAIDQINGKLNRLIERTNEKYHQIEKEFGQVEGRIQYLEKYVEDTKVDLWSYNAXXXXXXENQHTIDMTDSEMNKLFERVKRQLRENAEDRGNGCFEIFHKCDNSCIESIRNGTYNHDIYRNEAINNRFQIQGIKLTXXYKDIILWVSFSISCFASPSCLVVXALLIAFVLWACQNGNLRCQICI

SEQ ID NO: 418526 - protein, 571 aa, Influenza virus
  MOD_RES (1)..(18): Any amino acid
  MOD_RES (32)..(32): Any amino acid
  MOD_RES (60)..(61): Any amino acid
  MOD_RES (76)..(76): Any amino acid
  MOD_RES (90)..(95): Any amino acid
  MOD_RES (105)..(109): Any amino acid
  MOD_RES (125)..(127): Any amino acid
  MOD_RES (141)..(141): Any amino acid
  MOD_RES (172)..(173): Any amino acid
  MOD_RES (193)..(195): Any amino acid
  MOD_RES (206)..(207): Any amino acid
  MOD_RES (222)..(223): Any amino acid
  MOD_RES (247)..(247): Any amino acid
  MOD_RES (262)..(265): Any amino acid
  MOD_RES (275)..(288): Any amino acid
  MOD_RES (303)..(306): Any amino acid
  MOD_RES (317)..(317): Any amino acid
  MOD_RES (335)..(384): Any amino acid
  MOD_RES (397)..(397): Any amino acid
  MOD_RES (413)..(413): Any amino acid
  MOD_RES (434)..(449): Any amino acid
  MOD_RES (469)..(479): Any amino acid
  MOD_RES (535)..(535): Any amino acid
  MOD_RES (548)..(549): Any amino acid
  MOD_RES (569)..(571): Any amino acid
XXXXXXXXXXXXXXXXXXHTGNPVICMGHHAXVANGTMVKTLTNDQIEVVAAQELVESKXXQELCPSPLRLIDGQXCDIVNSALGSPGCXXXXXXEWDVYIERPXXXXXCYPFDVPNYQSLRSIXXXNGKFEFIVEKFQWXTIKQNGKSGACKRADVNDFFKRLNWLIKSDXXAYPIQNLTKVNSGDYARLYXXXVHHPSTDAEQXXLYENNPGRVTVSTRXXQTSVVPDIGSRPLVRSQSGRISFXWTIVEPGNLIVFNTXXXXIAPRGHYRLXXXXXXXXXXXXXXIGSCESKCHTEKGSXXXXRPFQNISRVSXGECPKYVKQGSLRLATGXXXXXXXXXXXXXXXXXXXXXXXXXXXXXXXXXXXXXXXXXXXXXXXXXXTQAAINQINGKLXRLIEKTNDKYHQIEKXFEQVEGRTQDLERYVEDTKIXXXXXXXXXXXXXXXXHTIDVADSEMNRLFERVRRXXXXXXXXXXXGCFEIFHRCDNKCIESIRNGTYDHNVYRDEAINSRFQIQGVRLTQGYKDIILWFSXVTTRQASPSCLVXXALLLAFVLWACQTGNIRCQXXX

SEQ ID NO: 418527 - protein, 571 aa, Influenza virus
  MOD_RES (1)..(24): Any amino acid
  MOD_RES (55)..(61): Any amino acid
  MOD_RES (76)..(76): Any amino acid
  MOD_RES (87)..(95): Any amino acid
  MOD_RES (104)..(110): Any amino acid
  MOD_RES (125)..(127): Any amino acid
  MOD_RES (139)..(141): Any amino acid
  MOD_RES (172)..(175): Any amino acid
  MOD_RES (189)..(207): Any amino acid
  MOD_RES (219)..(223): Any amino acid
  MOD_RES (249)..(252): Any amino acid
  MOD_RES (266)..(288): Any amino acid
  MOD_RES (303)..(307): Any amino acid
  MOD_RES (317)..(317): Any amino acid
  MOD_RES (330)..(385): Any amino acid
  MOD_RES (400)..(415): Any amino acid
  MOD_RES (433)..(450): Any amino acid
  MOD_RES (476)..(482): Any amino acid
  MOD_RES (531)..(541): Any amino acid
  MOD_RES (571)..(571): Any amino acid
XXXXXXXXXXXXXXXXXXXXXXXXWICMGHHAVPNGTIVKTLTDDKVEVVAAQEXXXXXXXSELCPSPLKLVDGQXCDIVNAALGSXXXXXXXXXEWDVFVERXXXXXXXYPFDVPGYQSLRSIXXXNGKLEFIAEEFXXXAVKQNGKSSACKRANVDDFFNRLNWLTKSNXXXXPLQNLTKTNNGDYXXXXXXXXXXXXXXXXXXXLYKSNPGRVTVXXXXXQTSVIPNIGSGPWVRGQSSRISFYWXXXXPGDLILFNTIGNLXXXXXXXXXXXXXXXXXXXXXXXIGSCISKCHTNRGSXXXXXPFQNVSRTAXGDCPRYVKQGSLXXXXXXXXXXXXXXXXXXXXXXXXXXXXXXXXXXXXXXXXXXXXXXXXXXXXXXXXQTAIDQITGKLNRLXXXXXXXXXXXXXXXXQVEGRIQNLEEYVEDTKXXXXXXXXXXXXXXXXXXIIDVTDSEMDKLFERVRHQLRENAEXXXXXXXEIFHQCNNNCIESIRNGTYNHNIYRDEAISNRFQIQGVKLAQGYKDIIXXXXXXXXXXXSISCFLLVALFLAFILWACQTGNVRCQICX

SEQ ID NO: 418528 - protein, 571 aa, Influenza virus
  MOD_RES (1)..(25): Any amino acid
  MOD_RES (45)..(46): Any amino acid
  MOD_RES (56)..(61): Any amino acid
  MOD_RES (75)..(113): Any amino acid
  MOD_RES (126)..(129): Any amino acid
  MOD_RES (141)..(153): Any amino acid
  MOD_RES (162)..(163): Any amino acid
  MOD_RES (172)..(179): Any amino acid
  MOD_RES (195)..(209): Any amino acid
  MOD_RES (222)..(224): Any amino acid
  MOD_RES (234)..(236): Any amino acid
  MOD_RES (248)..(252): Any amino acid
  MOD_RES (263)..(288): Any amino acid
  MOD_RES (303)..(308): Any amino acid
  MOD_RES (317)..(317): Any amino acid
  MOD_RES (326)..(385): Any amino acid
  MOD_RES (399)..(421): Any amino acid
  MOD_RES (431)..(453): Any amino acid
  MOD_RES (463)..(487): Any amino acid
  MOD_RES (496)..(499): Any amino acid
  MOD_RES (513)..(515): Any amino acid
  MOD_RES (531)..(541): Any amino acid
  MOD_RES (570)..(571): Any amino acid
XXXXXXXXXXXXXXXXXXXXXXXXXICLGHHAVSNGTVVKTLTDXXVEVITAQELXXXXXXPELCPKPLKLVDGXXXXXXXXXXXXXXXXXXXXXXXXXXXXXXXXXXXXXXXDVPDYQSIRSILXXXXKFEFIAEDFQWXXXXXXXXXXXXXRANENDFFXXLNWLVKSNXXXXXXXXLTKVNNGNYARLYIWXXXXXXXXXXXXXXXKNNPGRVSVSTKXXXTSVVPNIDSXXXVRGLSSRISFYXXXXXPGDVIVFNTIXXXXXXXXXXXXXXXXXXXXXXXXXXIGSCVSRCHTDKGSXXXXXXFQNISRIAXGNCPKYVKXXXXXXXXXXXXXXXXXXXXXXXXXXXXXXXXXXXXXXXXXXXXXXXXXXXXXXXXXXXXQAAIDQISGKLNRXXXXXXXXXXXXXXXXXXXXXXXQDLENYVEDXXXXXXXXXXXXXXXXXXXXXXXVTDSEMNRLXXXXXXXXXXXXXXXXXXXXXXXXXCGNNCIESXXXXTYDHDVYRDEAISXXXQIQGVKLIQGYKDIIXXXXXXXXXXXSISCFLLAALLLAFMLWACQNGNVRCQIXX

SEQ ID NO: 418529 - protein, 571 aa, Influenza virus
  MOD_RES (1)..(25): Any amino acid
  MOD_RES (38)..(38): Any amino acid
  MOD_RES (47)..(62): Any amino acid
  MOD_RES (74)..(132): Any amino acid
  MOD_RES (141)..(244): Any amino acid
  MOD_RES (253)..(386): Any amino acid
  MOD_RES (396)..(422): Any amino acid
  MOD_RES (431)..(453): Any amino acid
  MOD_RES (468)..(488): Any amino acid
  MOD_RES (497)..(508): Any amino acid
  MOD_RES (517)..(527): Any amino acid
  MOD_RES (537)..(541): Any amino acid
  MOD_RES (565)..(571): Any amino acid
XXXXXXXXXXXXXXXXXXXXXXXXXICLGHHSVPNGTXVKTLTGDQXXXXXXXXXXXXXXXXELCSSPLRLVDXXXXXXXXXXXXXXXXXXXXXXXXXXXXXXXXXXXXXXXXXXXXXXXXXXXXXXXXXXXFITEEFQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLYWTIVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAAIDKINGKXXXXXXXXXXXXXXXXXXXXXXXXXXXDLEEYVEDXXXXXXXXXXXXXXXXXXXXXXXVTDSEMSKLFERVRXXXXXXXXXXXXXXXXXXXXXDNTCIESIXXXXXXXXXXXXDAINNRFQXXXXXXXXXXXDVILWISFSXXXXXSISCFLLIALLLTFILWACQNENXXXXXXX

SEQ ID NO: 418530 - protein, 571 aa, Influenza virus
  MOD_RES (1)..(28): Any amino acid
  MOD_RES (42)..(388): Any amino acid
  MOD_RES (398)..(545): Any amino acid
  MOD_RES (554)..(560): Any amino acid
  MOD_RES (569)..(571): Any amino acid
XXXXXXXXXXXXXXXXXXXXXXXXXXXXGHHAVANGTIVKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIDQVNGKLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLLVALLIXXXXXXXQNGNIRWQXXX

SEQ ID NO: 418531 - protein, 571 aa, Influenza virus
  MOD_RES (1)..(28): Any amino acid
  MOD_RES (42)..(561): Any amino acid
  MOD_RES (570)..(571): Any amino acid
XXXXXXXXXXXXXXXXXXXXXXXXXXXXGHHAVTNGTMVKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGNIRCQIXX

SEQ ID NO: 418532 - protein, 608 aa, Influenza virus
  MOD_RES (11)..(18): Any amino acid
  MOD_RES (57)..(66): Any amino acid
  MOD_RES (92)..(92): Any amino acid
  MOD_RES (104)..(120): Any amino acid
  MOD_RES (129)..(138): Any amino acid
  MOD_RES (147)..(163): Any amino acid
  MOD_RES (177)..(197): Any amino acid
  MOD_RES (207)..(222): Any amino acid
  MOD_RES (236)..(266): Any amino acid
  MOD_RES (283)..(302): Any amino acid
  MOD_RES (339)..(340): Any amino acid
  MOD_RES (350)..(352): Any amino acid
  MOD_RES (433)..(441): Any amino acid
  MOD_RES (516)..(516): Any amino acid
  MOD_RES (527)..(551): Any amino acid
  MOD_RES (579)..(580): Any amino acid
SVKMEKIVLLXXXXXXXXSDQICIGYGYHANNSTEQVDTIMEKNVTVTHAQDILEKXXXXXXXXXXGVKPLILRDCSVAGWLLGNPMCDEFXNVPEWSYIVEKXXXXXXXXXXXXXXXXXDYEELKHLXXXXXXXXXXADHPPKVAXXXXXXXXXXXXXXXXXNGRSSFFRNVVWLXXXXXXXXXXXXXXXXXXXXXLLVLWGIHHXXXXXXXXXXXXXXXXYISVGTSTLNQRLXXXXXXXXXXXXXXXXXXXXXXXXXXXXXXXFESNGNFIAPEYAYKIXXXXXXXXXXXXXXXXXXXXPSVKLPMGAIGAIDSSMPFHNIHPLTIGECPKYVKSXXLVLATGLRNXXXREREGGRRRKRGLFKRGLFGAIIAGFIEGGWQGMVDGWYGYHHSNEQGSGYAADKESTQKAIDGVTNKVNSIIDKMNTQFXXXXXXXXXLERRIENLNKKMEDGFLDVWTYNAELLVLMENERTLDFHDSNVKNLYDKVRLQLRDNAKELGNGCFEFYHKCDNXCMESVRNGTYXXXXXXXXXXXXXXXXXXXXXXXXXTYQILSIYSTVASSLALAIHGSLVLSLXXAGLSLWMCSNGSLQCRICIRFVNSDCSK

SEQ ID NO: 418533 - protein, 608 aa, Influenza virus
  MOD_RES (11)..(18): Any amino acid
  MOD_RES (27)..(27): Any amino acid
  MOD_RES (57)..(66): Any amino acid
  MOD_RES (92)..(92): Any amino acid
  MOD_RES (103)..(120): Any amino acid
  MOD_RES (129)..(163): Any amino acid
  MOD_RES (177)..(197): Any amino acid
  MOD_RES (207)..(222): Any amino acid
  MOD_RES (236)..(266): Any amino acid
  MOD_RES (283)..(304): Any amino acid
  MOD_RES (314)..(315): Any amino acid
  MOD_RES (339)..(340): Any amino acid
  MOD_RES (350)..(358): Any amino acid
  MOD_RES (375)..(379): Any amino acid
  MOD_RES (433)..(441): Any amino acid
  MOD_RES (504)..(504): Any amino acid
  MOD_RES (516)..(516): Any amino acid
  MOD_RES (527)..(551): Any amino acid
  MOD_RES (571)..(571): Any amino acid
  MOD_RES (594)..(597): Any amino acid
  MOD_RES (608)..(608): Any amino acid
ICQMEKIVLLXXXXXXXXGDQICIGYXYHANNSTKQVDTIMERNVTVTHAKDILEKXXXXXXXXXXGVKPLILKDCSVAGWLLGNPLCDEFXNVSEWSYIVEXXXXXXXXXXXXXXXXXXNYEELKHLXXXXXXXXXXXXXXXXXXXXXXXXXXXXXXXXXXXTGRSSFFRNVIWLXXXXXXXXXXXXXXXXXXXXXLLILWGIHHXXXXXXXXXXXXXXXXYVSVGTSTLNLRLXXXXXXXXXXXXXXXXXXXXXXXXXXXXXXXFESTGNFIAPENAYKIXXXXXXXXXXXXXXXXXXXXXXCQTPMGAINXXNSSMPFHNVHPLTIGECPRYVKSXXLVLATGPRNXXXXXXXXXRRKKRGLFTRGLFGAIXXXXXEGGWQGMIDGWYGYHHNNGQGSGYAADQESTQKAINGITNKVNSIINKMNTQFXXXXXXXXXLEKRIENLNRKMEDGFLNVWTYNAEILVLMENERTLDLHDSNVKNLYEKVRLQLKDNAKELGXGCFEFYHRCDNXCMESIRNGTYXXXXXXXXXXXXXXXXXXXXXXXXXIYQILSIYSTAASSLVLAIXSSLALAIMVAGLSFWMCSNGSYXXXXAFKFVSSDCSX

SEQ ID NO: 418534 - protein, 608 aa, Influenza virus
  MOD_RES (1)..(18): Any amino acid
  MOD_RES (27)..(27): Any amino acid
  MOD_RES (54)..(66): Any amino acid
  MOD_RES (92)..(92): Any amino acid
  MOD_RES (101)..(120): Any amino acid
  MOD_RES (129)..(163): Any amino acid
  MOD_RES (176)..(197): Any amino acid
  MOD_RES (207)..(222): Any amino acid
  MOD_RES (236)..(266): Any amino acid
  MOD_RES (283)..(304): Any amino acid
  MOD_RES (314)..(315): Any amino acid
  MOD_RES (335)..(340): Any amino acid
  MOD_RES (350)..(358): Any amino acid
  MOD_RES (367)..(367): Any amino acid
  MOD_RES (382)..(385): Any amino acid
  MOD_RES (433)..(441): Any amino acid
  MOD_RES (464)..(477): Any amino acid
  MOD_RES (501)..(506): Any amino acid
  MOD_RES (516)..(516): Any amino acid
  MOD_RES (527)..(551): Any amino acid
  MOD_RES (571)..(571): Any amino acid
  MOD_RES (606)..(608): Any amino acid
XXXXXXXXXXXXXXXXXXSDHICIGYXYHANNSTVQVDTIMEKNITVTHAQDLXXXXXXXXXXXXXGVRPLILKDCSIAGWLLGNPMCDKFXDVPEWSYIXXXXXXXXXXXXXXXXXXXXDYEELKYLXXXXXXXXXXXXXXXXXXXXXXXXXXXXXXXXXXXSGRSSFFRNMVWXXXXXXXXXXXXXXXXXXXXXXLLIIWGIHHXXXXXXXXXXXXXXXXYISIGTSTLNQRSXXXXXXXXXXXXXXXXXXXXXXXXXXXXXXXFDSNGNFIAPEYAYIVXXXXXXXXXXXXXXXXXXXXXXCQTPIGAINXXNSSLPFHNVHPFTIGECPKXXXXXXLILATGLRNXXXXXXXXXRRKRGLFGXRRGLFGAIAGFIEGXXXXMVDGWYGFHHSNDQGSGYAADRESTQKAVDGITNKVNSIIGKMNTQFXXXXXXXXXLERRIESLNKKMEDDFLDVWTYXXXXXXXXXXXXXXDFHDSNVRNLYDKVRHQLRDNAKXXXXXXFEFYHKCNNXCMESVKNGTYXXXXXXXXXXXXXXXXXXXXXXXXXVYQILSIYSTVVSSLVLAIXSSLVLAIMIAGLFLWMCSNGSLQCKICIKFVSSDXXX

SEQ ID NO: 418535 - protein, 608 aa, Influenza virus
  MOD_RES (1)..(18): Any amino acid
  MOD_RES (27)..(28): Any amino acid
  MOD_RES (44)..(44): Any amino acid
  MOD_RES (57)..(66): Any amino acid
  MOD_RES (77)..(83): Any amino acid
  MOD_RES (92)..(92): Any amino acid
  MOD_RES (101)..(120): Any amino acid
  MOD_RES (129)..(167): Any amino acid
  MOD_RES (177)..(197): Any amino acid
  MOD_RES (207)..(222): Any amino acid
  MOD_RES (236)..(269): Any amino acid
  MOD_RES (283)..(304): Any amino acid
  MOD_RES (314)..(315): Any amino acid
  MOD_RES (339)..(358): Any amino acid
  MOD_RES (367)..(389): Any amino acid
  MOD_RES (398)..(400): Any amino acid
  MOD_RES (433)..(441): Any amino acid
  MOD_RES (466)..(481): Any amino acid
  MOD_RES (516)..(516): Any amino acid
  MOD_RES (526)..(551): Any amino acid
  MOD_RES (571)..(571): Any amino acid
  MOD_RES (606)..(608): Any amino acid
XXXXXXXXXXXXXXXXXXGDRICIGYXXHANNSTEHVDTIMEKXVTVTHAQNILEKXXXXXXXXXXGVRPLILRDCXXXXXXXGNPTCDEFXKVPEWSYIXXXXXXXXXXXXXXXXXXXXDYGELKHLXXXXXXXXXXXXXXXXXXXXXXXXXXXXXXXXXXXXXXXSFYRNVVWLXXXXXXXXXXXXXXXXXXXXXLLVMWGIHHXXXXXXXXXXXXXXXXYVSIGTSTLNQKLXXXXXXXXXXXXXXXXXXXXXXXXXXXXXXXXXXNGNFITPEYAYKIXXXXXXXXXXXXXXXXXXXXXXCQTPVGAINXXNSSMPLHNIHPLTIGKCPKYVKSXXXXXXXXXXXXXXXXXXXXKRKKRGLFXXXXXXXXXXXXXXXXXXXXXXXWYGYHHINXXXSGYAADKKSTQKAIDGITNKINSIIDKMNIQFXXXXXXXXXLEGRIENLNKKMEEGFIDVWTYNAXXXXXXXXXXXXXXXXSNVKNLYNKVRLQLKDNARELGNGCFEFYHKCDDXCIESVRNGTXXXXXXXXXXXXXXXXXXXXXXXXXXTYQILSLYSTVASSLTLAIXSSLTLAIMMAGLLLWMCSNGSLQCRVCIYFCEFRXXX

SEQ ID NO: 418536 - protein, 608 aa, Influenza virus
  MOD_RES (1)..(18): Any amino acid
  MOD_RES (27)..(28): Any amino acid
  MOD_RES (43)..(48): Any amino acid
  MOD_RES (57)..(66): Any amino acid
  MOD_RES (82)..(92): Any amino acid
  MOD_RES (101)..(120): Any amino acid
  MOD_RES (129)..(167): Any amino acid
  MOD_RES (177)..(197): Any amino acid
  MOD_RES (207)..(222): Any amino acid
  MOD_RES (236)..(304): Any amino acid
  MOD_RES (314)..(315): Any amino acid
  MOD_RES (332)..(358): Any amino acid
  MOD_RES (367)..(404): Any amino acid
  MOD_RES (417)..(418): Any amino acid
  MOD_RES (433)..(447): Any amino acid
  MOD_RES (462)..(482): Any amino acid
  MOD_RES (498)..(517): Any amino acid
  MOD_RES (526)..(553): Any amino acid
  MOD_RES (562)..(562): Any amino acid
  MOD_RES (571)..(571): Any amino acid
  MOD_RES (584)..(586): Any amino acid
  MOD_RES (599)..(599): Any amino acid
  MOD_RES (608)..(608): Any amino acid
XXXXXXXXXXXXXXXXXXSDQICVGYXXHANNSTERVDTIMEXXXXXXHAQDILERXXXXXXXXXXGVKPLILGDCSVAGWXXXXXXXXXXXNAPEWSYIXXXXXXXXXXXXXXXXXXXXDYEEMKHLXXXXXXXXXXXXXXXXXXXXXXXXXXXXXXXXXXXXXXXAFFRNVVWIXXXXXXXXXXXXXXXXXXXXXLLVLWGVHHXXXXXXXXXXXXXXXXHISVGTSTLNQRMXXXXXXXXXXXXXXXXXXXXXXXXXXXXXXXXXXXXXXXXXXXXXXXXXXXXXXXXXXXXXXXXXXXXXCQTPLGAINXXSSSMPFHNVHPLAIGEXXXXXXXXXXXXXXXXXXXXXXXXXXXRRKRRGLFXXXXXXXXXXXXXXXXXXXXXXXXXXXXXXXXXXXXXXADKESTQRAIDGXXNRVNSIIDKMNTRFXXXXXXXXXXXXXXXDLNKKMEDGFIDVWXXXXXXXXXXXXXXXXXXXXXNVKNLYDRVRLQLRDXXXXXXXXXXXXXXXXXXXXMDSVRNGTXXXXXXXXXXXXXXXXXXXXXXXXXXXXQILSVYSTXVSSLALAIXSSLALAIIVAGLXXXMCFNGSLQCRIAXKICESRLRX

SEQ ID NO: 418537 - protein, 608 aa, Influenza virus
  MOD_RES (1)..(21): Any amino acid
  MOD_RES (34)..(35): Any amino acid
  MOD_RES (45)..(70): Any amino acid
  MOD_RES (82)..(168): Any amino acid
  MOD_RES (177)..(304): Any amino acid
  MOD_RES (314)..(315): Any amino acid
  MOD_RES (325)..(326): Any amino acid
  MOD_RES (335)..(360): Any amino acid
  MOD_RES (370)..(414): Any amino acid
  MOD_RES (423)..(453): Any amino acid
  MOD_RES (467)..(555): Any amino acid
  MOD_RES (578)..(597): Any amino acid
  MOD_RES (606)..(608): Any amino acid
XXXXXXXXXXXXXXXXXXXXXDQICIGYHANNSXXQIDTIMEKNXXXXXXXXXXXXXXXXXXXXXXXXXXFILKDCSVSGWXXXXXXXXXXXXXXXXXXXXXXXXXXXXXXXXXXXXXXXXXXXXXXXXXXXXXXXXXXXXXXXXXXXXXXXXXXXXXXXXXXXXXXXFFRNLVWLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCQTPMGAVNXXNSSKPFHNIXXFTIGECPRXXXXXXXXXXXXXXXXXXXXXXXXXXKKKRGLFGAXXXXXXXXXXXXXXXXXXXXXXXXXXXXXXXXXXXXXXXXXXXXXNGVTNKVNXXXXXXXXXXXXXXXXXXXXXXXXXXXXXXXEDGFLGVWTYNAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSIYSTVTSSPSTGNHGSLVLSXXXXXXXXXXXXXXXXXXXXCIKICESRXXX

SEQ ID NO: 418538 - protein, 608 aa, Influenza virus
  MOD_RES (1)..(21): Any amino acid
  MOD_RES (31)..(312): Any amino acid
  MOD_RES (321)..(361): Any amino acid
  MOD_RES (370)..(563): Any amino acid
  MOD_RES (573)..(608): Any amino acid
XXXXXXXXXXXXXXXXXXXXXDHICIGYHAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAINSSMPXXXXXXXXXXXXXXXXXXXXXXXXXXXXXXXXXXXXXXXXXETRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPSTGNHGXXXXXXXXXXXXXXXXXXXXXXXXXXXXXXXXXXXX

SEQ ID NO: 418539 - protein, 608 aa, Influenza virus
  MOD_RES (1)..(21): Any amino acid
  MOD_RES (31)..(312): Any amino acid
  MOD_RES (321)..(361): Any amino acid
  MOD_RES (370)..(608): Any amino acid
XXXXXXXXXXXXXXXXXXXXXDRICIGYHAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAINSSLPXXXXXXXXXXXXXXXXXXXXXXXXXXXXXXXXXXXXXXXXXRKRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418540 - protein, 608 aa, Influenza virus
  MOD_RES (1)..(21): Any amino acid
  MOD_RES (34)..(312): Any amino acid
  MOD_RES (321)..(361): Any amino acid
  MOD_RES (370)..(608): Any amino acid
XXXXXXXXXXXXXXXXXXXXXDQICVGYHANNSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAVNSSMPXXXXXXXXXXXXXXXXXXXXXXXXXXXXXXXXXXXXXXXXXKTRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418541 - protein, 608 aa, Influenza virus
  MOD_RES (1)..(312): Any amino acid
  MOD_RES (321)..(361): Any amino acid
  MOD_RES (370)..(608): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAINSSKPXXXXXXXXXXXXXXXXXXXXXXXXXXXXXXXXXXXXXXXXXKRRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418542 - protein, 608 aa, Influenza virus
  MOD_RES (1)..(312): Any amino acid
  MOD_RES (321)..(362): Any amino acid
  MOD_RES (374)..(608): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAINTSMPXXXXXXXXXXXXXXXXXXXXXXXXXXXXXXXXXXXXXXXXXXTRRQKRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418543 - protein, 608 aa, Influenza virus
  MOD_RES (1)..(362): Any amino acid
  MOD_RES (374)..(608): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRRKKRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418544 - protein, 599 aa, Influenza virus
  MOD_RES (11)..(18): Any amino acid
  MOD_RES (92)..(92): Any amino acid
  MOD_RES (105)..(115): Any amino acid
  MOD_RES (131)..(135): Any amino acid
  MOD_RES (144)..(163): Any amino acid
  MOD_RES (173)..(191): Any amino acid
  MOD_RES (206)..(217): Any amino acid
  MOD_RES (232)..(239): Any amino acid
  MOD_RES (248)..(260): Any amino acid
  MOD_RES (285)..(295): Any amino acid
  MOD_RES (347)..(348): Any amino acid
  MOD_RES (507)..(507): Any amino acid
  MOD_RES (523)..(541): Any amino acid
  MOD_RES (570)..(571): Any amino acid
SVKMEKIVLLXXXXXXXXSDQICIGYGYHANNSTEQVDTIMEKNVTVTHAQDILEKTHNGKLCDLDGVKPLILRDCSVAGWLLGNPMCDEFXNVPEWSYIVEKAXXXXXXXXXXXFNDYEELKHLLSRINXXXXXADHPPKVAXXXXXXXXXXXXXXXXXXXXSFFRNVVWLXXXXXXXXXXXXXXXXXXXEDLLVLWGIHHPNDXXXXXXXXXXXXTYISVGTSTLNQRLXXXXXXXXKVNGQSGRXXXXXXXXXXXXXINFESNGNFIAPEYAYKIVKKGDSXXXXXXXXXXXCNTKCQTPPIGAINSSMSSMPFHNIHPLTIGECPKYVKSNRLVLATGLRNSXXREREGGRRRKRGLFGAIIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNXCMESVRNGTYDYPQYXXXXXXXXXXXXXXXXXXXGTYQILSIYSTVASSLALAIHGSLVLSLXXAGLSLWMCSNGSLQCRICIRFVNSDCSK

SEQ ID NO: 418545 - protein, 599 aa, Influenza virus
  MOD_RES (11)..(18): Any amino acid
  MOD_RES (27)..(27): Any amino acid
  MOD_RES (92)..(92): Any amino acid
  MOD_RES (105)..(115): Any amino acid
  MOD_RES (131)..(163): Any amino acid
  MOD_RES (173)..(191): Any amino acid
  MOD_RES (206)..(217): Any amino acid
  MOD_RES (232)..(239): Any amino acid
  MOD_RES (248)..(260): Any amino acid
  MOD_RES (285)..(295): Any amino acid
  MOD_RES (347)..(355): Any amino acid
  MOD_RES (443)..(468): Any amino acid
  MOD_RES (495)..(495): Any amino acid
  MOD_RES (507)..(507): Any amino acid
  MOD_RES (523)..(541): Any amino acid
  MOD_RES (569)..(571): Any amino acid
  MOD_RES (585)..(588): Any amino acid
  MOD_RES (599)..(599): Any amino acid
ICQMEKIVLLXXXXXXXXSDHICIGYXYHANNSTKQVDTIMERNVTVTHAKDILERTHNGKLCNLNGVKPLILKDCSVAGWLLGNPLCDEFXNVSEWSYIVEKIXXXXXXXXXXXFNNYEELKHLMSSTNXXXXXXXXXXXXXXXXXXXXXXXXXXXXXXXXXSFYRNVVWLXXXXXXXXXXXXXXXXXXXEDLLILWGIHHSNDXXXXXXXXXXXXTYISIGTSTLNQRSXXXXXXXXKINGQSGRXXXXXXXXXXXXXIHFESNGNFITPEYAYKIVKEGDSXXXXXXXXXXXCNTRCQTPPMGAINSSMSSMPFHNVHPLTIGECPKYVKSDKLVLATGLRNTXXXXXXXXXRKKRGLFGAAIAGFIEGGWQGMIDGWYGYHHNNEQGSGYAADQESTQKAINGVTNKVNSIINKMNTQFEAIGREFNNLEKRIENLNKXXXXXXXXXXXXXXXXXXXXXXXXXXDFHDSNVRNLYDKVRLQLKDNAKELGXGCFEFYHRCDNXCMESIRNGTYNYPQYXXXXXXXXXXXXXXXXXXXGIYQILSIYSTAASSLALANHGSLVLSXXXAGLFLWMCSNGSYXXXXAFKFVSSDCSX

SEQ ID NO: 418546 - protein, 599 aa, Influenza virus
  MOD_RES (1)..(18): Any amino acid
  MOD_RES (27)..(27): Any amino acid
  MOD_RES (43)..(44): Any amino acid
  MOD_RES (77)..(92): Any amino acid
  MOD_RES (105)..(115): Any amino acid
  MOD_RES (131)..(163): Any amino acid
  MOD_RES (173)..(191): Any amino acid
  MOD_RES (206)..(217): Any amino acid
  MOD_RES (232)..(239): Any amino acid
  MOD_RES (248)..(260): Any amino acid
  MOD_RES (282)..(295): Any amino acid
  MOD_RES (313)..(319): Any amino acid
  MOD_RES (347)..(355): Any amino acid
  MOD_RES (372)..(376): Any amino acid
  MOD_RES (427)..(428): Any amino acid
  MOD_RES (447)..(472): Any amino acid
  MOD_RES (488)..(497): Any amino acid
  MOD_RES (507)..(507): Any amino acid
  MOD_RES (523)..(541): Any amino acid
  MOD_RES (562)..(562): Any amino acid
  MOD_RES (597)..(599): Any amino acid
XXXXXXXXXXXXXXXXXXGDQICIGYXYHANNSTVQVDTIMEXXVTVTHAQNILEKAHNGKLCSLKGVRPLILKDCXXXXXXXXXXXXXXXXDVPEWSYIVEKDXXXXXXXXXXXLNDYEELKHLLNRITXXXXXXXXXXXXXXXXXXXXXXXXXXXXXXXXXSFFRNVIWLXXXXXXXXXXXXXXXXXXXEDLLVMWGIHHPNNXXXXXXXXXXXXTYVSVGTSTLNLRLXXXXXXXXKINGQRGRXXXXXXXXXXXXXISFESNGNFIAPENAYKIVKKXXXXXXXXXXXXXXCSTKCQTPPVGAINSSMXXXXXXXIHPLTIGKCPKYVKSSRLILATGLRNAXXXXXXXXXRKRGLFGAGAIAGFIEXXXXXMVDGWYGFHHSNEQGSGYAADRESTQKAIDGITNKVNSIIGKMNTQFETVXXEFSNLERRIESLNKKMEDXXXXXXXXXXXXXXXXXXXXXXXXXXSNVKNLYEKVRLQLRXXXXXXXXXXFEFYHKCNNXCMESVKNGTYDYPRYXXXXXXXXXXXXXXXXXXXVTYQILSIYSTVVSSLALAIXSSLALAIMVAGLSFWMCSNGSLQCKICIKFVSSDXXX

SEQ ID NO: 418547 - protein, 599 aa, Influenza virus
  MOD_RES (1)..(18): Any amino acid
  MOD_RES (27)..(28): Any amino acid
  MOD_RES (40)..(48): Any amino acid
  MOD_RES (57)..(57): Any amino acid
  MOD_RES (77)..(96): Any amino acid
  MOD_RES (105)..(115): Any amino acid
  MOD_RES (131)..(164): Any amino acid
  MOD_RES (173)..(191): Any amino acid
  MOD_RES (205)..(217): Any amino acid
  MOD_RES (228)..(239): Any amino acid
  MOD_RES (248)..(260): Any amino acid
  MOD_RES (284)..(295): Any amino acid
  MOD_RES (313)..(327): Any amino acid
  MOD_RES (347)..(357): Any amino acid
  MOD_RES (371)..(381): Any amino acid
  MOD_RES (411)..(417): Any amino acid
  MOD_RES (450)..(473): Any amino acid
  MOD_RES (489)..(498): Any amino acid
  MOD_RES (507)..(507): Any amino acid
  MOD_RES (520)..(541): Any amino acid
  MOD_RES (599)..(599): Any amino acid
XXXXXXXXXXXXXXXXXXSDQICVGYXXHANNSTEHVDTXXXXXXXXXHAQDILERXHNGRLCDLDGVRPLILRDCXXXXXXXXXXXXXXXXXXXXWSYIVEKVXXXXXXXXXXXFSDYEELKHLLSSTNXXXXXXXXXXXXXXXXXXXXXXXXXXXXXXXXXXFFRNVVWIXXXXXXXXXXXXXXXXXXXEDLLIIWGIHHPNXXXXXXXXXXXXXTYVSIGTSTLXXXXXXXXXXXXRVNGQSGRXXXXXXXXXXXXXINFDSNGNFIAPEYAYIVKKGDSXXXXXXXXXXXXCDTKCQTPPLGAINSSMXXXXXXXXXXXXXXXCPKYVKSTKLILATGLRNVXXXXXXXXXXXKKRGLFGAIAGFIXXXXXXXXXXXYGYHHSNGQGSGYAADKESTQRAIDGVTNXXXXXXXKMNTRFEAVGKEFNSLERRIENLNRKMEDGFLXXXXXXXXXXXXXXXXXXXXXXXXNVKNLYDRVRLQLRDXXXXXXXXXXEFYHKCDDXCIESVRNGTYNYXXXXXXXXXXXXXXXXXXXXXXGVYQILSIYSTVTSSPSTGNHGSLVLAIMMAGLLLWMCSNGSLQCRVCIKICESRLRX

SEQ ID NO: 418548 - protein, 599 aa, Influenza virus
  MOD_RES (1)..(21): Any amino acid
  MOD_RES (44)..(51): Any amino acid
  MOD_RES (60)..(64): Any amino acid
  MOD_RES (76)..(96): Any amino acid
  MOD_RES (105)..(121): Any amino acid
  MOD_RES (131)..(191): Any amino acid
  MOD_RES (206)..(239): Any amino acid
  MOD_RES (248)..(271): Any amino acid
  MOD_RES (281)..(298): Any amino acid
  MOD_RES (313)..(338): Any amino acid
  MOD_RES (347)..(357): Any amino acid
  MOD_RES (366)..(381): Any amino acid
  MOD_RES (393)..(397): Any amino acid
  MOD_RES (407)..(420): Any amino acid
  MOD_RES (437)..(508): Any amino acid
  MOD_RES (523)..(550): Any amino acid
  MOD_RES (562)..(562): Any amino acid
  MOD_RES (575)..(577): Any amino acid
  MOD_RES (590)..(599): Any amino acid
XXXXXXXXXXXXXXXXXXXXXDQICIGYHANNSTERVDTIMEKXXXXXXXXDILEKAHNXXXXXLEGVKPLILRNXXXXXXXXXXXXXXXXXXXXXWSYIVEKTXXXXXXXXXXXXXXXXXLKHLLSRTNXXXXXXXXXXXXXXXXXXXXXXXXXXXXXXXXXXXXXXXXXXXXXXXXXXXXXXXXXXXXXENLLILWGVHHPNDXXXXXXXXXXXXXXXXXXXXXXXXXXXXXXXXXXKVNGQNGRXXXXXXXXXXXXXXXXXXXXXXXXPEYAYKVVKXXXXXXXXXXXXXXXXXXPSVKLPMGAVNSSMXXXXXXXXXXXXXXXXXXXXXXXXXXLATGLRNNXXXXXXXXXXXRKRGLFGAXXXXXXXXXXXXXXXXYGYHHSKEQGSXXXXXKESTQKAMDXXXXXXXXXXXXXXTQFEAVGKEFNHLERRXXXXXXXXXXXXXXXXXXXXXXXXXXXXXXXXXXXXXXXXXXXXXXXXXXXXXXXXXXXXXXXXXXXXXXXXMDSVRNGTYSYPQYXXXXXXXXXXXXXXXXXXXXXXXXXXXXSTVASSLVLAIXSSLVLAIMIAGLXXXMCFNGSLQCRIAXXXXXXXXXX

SEQ ID NO: 418549 - protein, 599 aa, Influenza virus
  MOD_RES (1)..(21): Any amino acid
  MOD_RES (31)..(51): Any amino acid
  MOD_RES (61)..(197): Any amino acid
  MOD_RES (206)..(273): Any amino acid
  MOD_RES (285)..(300): Any amino acid
  MOD_RES (320)..(358): Any amino acid
  MOD_RES (367)..(384): Any amino acid
  MOD_RES (393)..(404): Any amino acid
  MOD_RES (413)..(420): Any amino acid
  MOD_RES (432)..(510): Any amino acid
  MOD_RES (520)..(550): Any amino acid
  MOD_RES (562)..(562): Any amino acid
  MOD_RES (571)..(588): Any amino acid
  MOD_RES (597)..(599): Any amino acid
XXXXXXXXXXXXXXXXXXXXXDHICIGYHAXXXXXXXXXXXXXXXXXXXXXDILEKEHNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWGIHHSNNXXXXXXXXXXXXXXXXXXXXXXXXXXXXXXXXXXXXXXXXXXXXXXXXXXXXXXXXXXXXXXXXXXXXYAYKIVKTGDSXXXXXXXXXXXXXXXXCQTPIGAINSINSSMPFHNXXXXXXXXXXXXXXXXXXXXXXXXXXXXXXXXXXXXXXXTRGLFGAIXXXXXXXXXXXXXXXXXXRHSNEQGSXXXXXXXXXXXXIDGITNKIXXXXXXXXIQFEAVGREFSXXXXXXXXXXXXXXXXXXXXXXXXXXXXXXXXXXXXXXXXXXXXXXXXXXXXXXXXXXXXXXXXXXXXXXXXXXXXXXXSIRNGTYSYXXXXXXXXXXXXXXXXXXXXXXXXXXXXXXXSTVASSLTLAIXSSLTLAIMXXXXXXXXXXXXXXXXXXCIYFCEFRXXX

SEQ ID NO: 418550 - protein, 599 aa, Influenza virus
  MOD_RES (1)..(21): Any amino acid
  MOD_RES (34)..(51): Any amino acid
  MOD_RES (61)..(274): Any amino acid
  MOD_RES (285)..(300): Any amino acid
  MOD_RES (319)..(513): Any amino acid
  MOD_RES (523)..(554): Any amino acid
  MOD_RES (564)..(566): Any amino acid
  MOD_RES (575)..(599): Any amino acid
XXXXXXXXXXXXXXXXXXXXXDQICVGYHANNSXXXXXXXXXXXXXXXXXXDILEKKHNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYKIIKKGDSXXXXXXXXXXXXXXXXCQTPMGAINSVNSSMPFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGTYDYPHYXXXXXXXXXXXXXXXXXXXXXXXXXXXXXXXXEFPSTGNHGXXXLAIIVAGLXXXXXXXXXXXXXXXXXXXXXXXXX

SEQ ID NO: 418551 - protein, 599 aa, Influenza virus
  MOD_RES (1)..(300): Any amino acid
  MOD_RES (320)..(562): Any amino acid
  MOD_RES (571)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCQTPVGAINSINSSMPLHNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSLALAIIXXXXXXXXXXXXXXXXXXXXXXXXXXXXX

SEQ ID NO: 418552 - protein, 599 aa, Influenza virus
  MOD_RES (1)..(300): Any amino acid
  MOD_RES (311)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCQTPLGAINSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418553 - protein, 599 aa, Influenza virus
  MOD_RES (1)..(301): Any amino acid
  MOD_RES (311)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQTPMGAVNSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418554 - protein, 599 aa, Influenza virus
  MOD_RES (1)..(305): Any amino acid
  MOD_RES (316)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAIGAIDSSMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418555 - protein, 599 aa, Influenza virus
  MOD_RES (1)..(308): Any amino acid
  MOD_RES (318)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAINSSMPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418556 - protein, 599 aa, Influenza virus
  MOD_RES (1)..(308): Any amino acid
  MOD_RES (318)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAVNSSMPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418557 - protein, 599 aa, Influenza virus
  MOD_RES (1)..(309): Any amino acid
  MOD_RES (318)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAINSSMPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418558 - protein, 500 aa, Influenza virus
  MOD_RES (29)..(41): Any amino acid
  MOD_RES (53)..(72): Any amino acid
  MOD_RES (87)..(105): Any amino acid
  MOD_RES (114)..(114): Any amino acid
  MOD_RES (240)..(240): Any amino acid
  MOD_RES (267)..(268): Any amino acid
  MOD_RES (277)..(279): Any amino acid
  MOD_RES (288)..(292): Any amino acid
  MOD_RES (310)..(310): Any amino acid
  MOD_RES (331)..(333): Any amino acid
  MOD_RES (360)..(363): Any amino acid
  MOD_RES (403)..(417): Any amino acid
  MOD_RES (456)..(456): Any amino acid
LVFREQKQEFKMNPNKKINRDITIGSICXXXXXXXXXXXXXNLDLNMGQPFYXXXXXXXXXXXXXXXXXXXXITYENNTWVNQTYVXXXXXXXXXXXXXXXXXXXGNSSLCPIXGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRXNILRTQESECACVNGSCFTVMTDGPSXXQASYKIFKXXXGKKGKWLNXXXXXAPNYHYEECSCYPDAGEXTCVCRDNWHGSNRPWVSFNQXXXYQIGYICSGVFGDNPRPNDGTGSCGPXXXXGAYGVKGFSFKYGNGVWIGRTKSTNSRSGFEMIWDPNGWXXXXXXXXXXXXXXXITDWSGYSGSFVQHPELTGLDCIRPCFWVELIRGRPKEXTIWTSGSSISFCGVNSIFLWCKIVTTVGWSWPDGAELPFTIDKY

SEQ ID NO: 418559 - protein, 500 aa, Influenza virus
  MOD_RES (1)..(1): Any amino acid
  MOD_RES (29)..(51): Any amino acid
  MOD_RES (60)..(72): Any amino acid
  MOD_RES (86)..(105): Any amino acid
  MOD_RES (114)..(114): Any amino acid
  MOD_RES (198)..(199): Any amino acid
  MOD_RES (240)..(240): Any amino acid
  MOD_RES (267)..(268): Any amino acid
  MOD_RES (277)..(279): Any amino acid
  MOD_RES (288)..(292): Any amino acid
  MOD_RES (310)..(310): Any amino acid
  MOD_RES (331)..(333): Any amino acid
  MOD_RES (360)..(363): Any amino acid
  MOD_RES (403)..(417): Any amino acid
  MOD_RES (456)..(456): Any amino acid
  MOD_RES (473)..(481): Any amino acid
  MOD_RES (496)..(500): Any amino acid
XGLREQKQEFKMNPNQKIIEIITIGSICXXXXXXXXXXXXXXXXXXXXXXXGPSHSIHTXXXXXXXXXXXXXIIYENNTWGNQTYXXXXXXXXXXXXXXXXXXXXGNSSLCPVXGWAVHSKDNSIRIGSRGDVFVVREPFISCSHMECRTFFLTHGALLNDKHSNETVKDRSPYRTLMSCPMGEAPSPYNSKFESVAXXASACHDGISWLTIGVSGPDNGAVAVVKYNGMITDTIKSWGXNIMRTQESECACINGSCFTIMTDGPSXXQASHKIFKXXXGKRGKWVKXXXXXAPDYHYEECSCYPNAGEXICVCRDNWHGSNRPWISFNQXXXYRIGYICSGIFGDNPRPSDGTGSCDPXXXXGAYGIKGFSFKYGDGVWIGRTKSPSSRSGFEMVWDPNGWXXXXXXXXXXXXXXXTTDWSGYSGSFIQHPELTGLNCIRPCFWVELVRGRPKEXTVWTSGSSISFCGVSSXXXXXXXXXTVSWSWPDGAELPSXXXXX

SEQ ID NO: 418560 - protein, 500 aa, Influenza virus
  MOD_RES (1)..(1): Any amino acid
  MOD_RES (13)..(72): Any amino acid
  MOD_RES (87)..(105): Any amino acid
  MOD_RES (114)..(114): Any amino acid
  MOD_RES (192)..(199): Any amino acid
  MOD_RES (240)..(240): Any amino acid
  MOD_RES (267)..(268): Any amino acid
  MOD_RES (277)..(292): Any amino acid
  MOD_RES (310)..(310): Any amino acid
  MOD_RES (331)..(333): Any amino acid
  MOD_RES (360)..(363): Any amino acid
  MOD_RES (403)..(417): Any amino acid
  MOD_RES (426)..(426): Any amino acid
  MOD_RES (456)..(456): Any amino acid
  MOD_RES (473)..(481): Any amino acid
  MOD_RES (499)..(500): Any amino acid
XFSGSQKQEFKMXXXXXXXXXXXXXXXXXXXXXXXXXXXXXXXXXXXXXXXXXXXXXXXXXXXXXXXXXXXXINYENNTWVNQTFVXXXXXXXXXXXXXXXXXXXGNSPLCPIXGWAIHSKDNNIRIGSKGDVFVTREPFISCSHSECRTFFLTQGSLLNDKHSNGTIKDRSPHRALMSCPVGVAPSPYNSXXXXXXXXASACHDGSSWLTIGISGPDSGAVAVLKYDGIITDTIRSWRXNTLRTQESECACANGFCFTVMTDGPNXXQASYKIFRXXXXXXXXXXXXXXXXAPNYYYEECSCYPDSGEXMCVCRDNWHGSNRPWLSFNQXXXYKIGYICSGFFGDNPRPDDGTGSCSPXXXXGTYGVKGFSFRYGNGVWIGRTKSIHSRSGFEMIWDPDGWXXXXXXXXXXXXXXXLTDWSGYSXSFVQHPEMTGLDCMRPCFWVELIRGQPKEXTVWTSGSIISFCGVNGXXXXXXXXXIVSWSWPDDAELPFIIDXX

SEQ ID NO: 418561 - protein, 500 aa, Influenza virus
  MOD_RES (1)..(5): Any amino acid
  MOD_RES (18)..(72): Any amino acid
  MOD_RES (87)..(105): Any amino acid
  MOD_RES (114)..(114): Any amino acid
  MOD_RES (153)..(160): Any amino acid
  MOD_RES (190)..(200): Any amino acid
  MOD_RES (240)..(240): Any amino acid
  MOD_RES (249)..(254): Any amino acid
  MOD_RES (264)..(271): Any amino acid
  MOD_RES (281)..(300): Any amino acid
  MOD_RES (310)..(321): Any amino acid
  MOD_RES (331)..(333): Any amino acid
  MOD_RES (360)..(363): Any amino acid
  MOD_RES (396)..(417): Any amino acid
  MOD_RES (427)..(430): Any amino acid
  MOD_RES (456)..(456): Any amino acid
  MOD_RES (473)..(481): Any amino acid
XXXXXQKQEIKMNPNQKXXXXXXXXXXXXXXXXXXXXXXXXXXXXXXXXXXXXXXXXXXXXXXXXXXXXXXXITYKNNTWVNQTYIXXXXXXXXXXXXXXXXXXXGNSSLCSIXGWAIYSKDNGIRIGSKGDVFIIREPFISCSYLECRTFFXXXXXXXXDKHSNGTAKDRSPHRTLMSCPIGEAPSPYXXXXXXXXXXXSACHDGTNWLTIGISGPDNEAVAVLKYKGIITDTIKSWKXSILRTQESXXXXXXGYCFTVMTDXXXXXXXXYKYKIFKNGXXXXXXXXXXXXXXXXXXXXCSCYPDASEXXXXXXXXXXXXNRPWVSFDQXXXYQMGYICSGVFGDTPRPNDGAGSCGPXXXXGAHGVKGFSFKYGNGAWIGRTKSATSRSGFEMXXXXXXXXXXXXXXXXXXXXXXITEWSGYSGXXXXHPELTGVDCIRPCFWIELIRGRPEEXTIWASGSSISFCGVDSXXXXXXXXXTVDWSWPDGADLPFTIDKS

SEQ ID NO: 418562 - protein, 500 aa, Influenza virus
  MOD_RES (1)..(72): Any amino acid
  MOD_RES (87)..(118): Any amino acid
  MOD_RES (127)..(127): Any amino acid
  MOD_RES (149)..(161): Any amino acid
  MOD_RES (177)..(180): Any amino acid
  MOD_RES (193)..(200): Any amino acid
  MOD_RES (213)..(225): Any amino acid
  MOD_RES (238)..(240): Any amino acid
  MOD_RES (249)..(301): Any amino acid
  MOD_RES (310)..(322): Any amino acid
  MOD_RES (331)..(334): Any amino acid
  MOD_RES (360)..(364): Any amino acid
  MOD_RES (379)..(387): Any amino acid
  MOD_RES (397)..(417): Any amino acid
  MOD_RES (426)..(434): Any amino acid
  MOD_RES (446)..(456): Any amino acid
  MOD_RES (473)..(481): Any amino acid
  MOD_RES (499)..(500): Any amino acid
XXXXXXXXXXXXXXXXXXXXXXXXXXXXXXXXXXXXXXXXXXXXXXXXXXXXXXXXXXXXXXXXXXXXXXXXMTNQNSTWVSQTYIXXXXXXXXXXXXXXXXXXXXXXXXXXXXXXXXHSKDNGIRXGSRGDVFIIREPFVSCSHLECXXXXXXXXXXXXXKHSNGTVNDRSPHRTXXXXPVGEVPSPYNSRXXXXXXXXSACHDGASWLTIXXXXXXXXXXXXXKYNGLITDTIKSXXXNVLRTQESXXXXXXXXXXXXXXXXXXXXXXXXXXXXXXXXXXXXXXXXXXXXXXXXXXXXXSCYPDAGKXXXXXXXXXXXXXRPWVSFTQXXXXQTGYICSGVFGDSPRPNDGKGSCGPXXXXXAYGVKGFAFKYGNGXXXXXXXXXNSRSGFEIIXXXXXXXXXXXXXXXXXXXXXITNWSGYSXXXXXXXXXTGLNCMRPCFWXXXXXXXXXXXTIWTSGSIISFCGVSGXXXXXXXXXTAGWSWPDDAELPFTMTXX

SEQ ID NO: 418563 - protein, 500 aa, Influenza virus
  MOD_RES (1)..(75): Any amino acid
  MOD_RES (87)..(132): Any amino acid
  MOD_RES (141)..(168): Any amino acid
  MOD_RES (182)..(365): Any amino acid
  MOD_RES (381)..(438): Any amino acid
  MOD_RES (449)..(490): Any amino acid
  MOD_RES (499)..(500): Any amino acid
XXXXXXXXXXXXXXXXXXXXXXXXXXXXXXXXXXXXXXXXXXXXXXXXXXXXXXXXXXXXXXXXXXXXXXXXXXXENTTWVNQTYLXXXXXXXXXXXXXXXXXXXXXXXXXXXXXXXXXXXXXXXXXXXXXXVFAIREPFXXXXXXXXXXXXXXXXXXXXXXXXXXXXKDRSPQRTLMSCPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYGIKGFSYKYGNGVWXXXXXXXXXXXXXXXXXXXXXXXXXXXXXXXXXXXXXXXXXXXXXXXXXXXXXXXXXXCIKPCFWVELXXXXXXXXXXXXXXXXXXXXXXXXXXXXXXXXXXXXXXXXXXAELPFTTDXX

SEQ ID NO: 418564 - protein, 500 aa, Influenza virus
  MOD_RES (1)..(133): Any amino acid
  MOD_RES (143)..(174): Any amino acid
  MOD_RES (184)..(367): Any amino acid
  MOD_RES (376)..(490): Any amino acid
  MOD_RES (499)..(500): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFVIREPFVSXXXXXXXXXXXXXXXXXXXXXXXXXXXXXXXXRSLMSCPVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIKGFSFRYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAELPFSIDXX

SEQ ID NO: 418565 - protein, 573 aa, Influenza virus
  MOD_RES (1)..(15): Any amino acid
  MOD_RES (48)..(52): Any amino acid
  MOD_RES (61)..(69): Any amino acid
  MOD_RES (84)..(88): Any amino acid
  MOD_RES (102)..(143): Any amino acid
  MOD_RES (171)..(215): Any amino acid
  MOD_RES (227)..(229): Any amino acid
  MOD_RES (244)..(257): Any amino acid
  MOD_RES (276)..(287): Any amino acid
  MOD_RES (302)..(305): Any amino acid
  MOD_RES (316)..(339): Any amino acid
  MOD_RES (402)..(403): Any amino acid
  MOD_RES (412)..(440): Any amino acid
  MOD_RES (511)..(534): Any amino acid
XXXXXXXXXXXXXXXGDQICIGYHANNSTEQVDTIMEKNVTVTHAQDXXXXXHNGKLCSLXXXXXXXXXDCSVAGWLLGNPMCXXXXXVPEWSYIVEKDNPXXXXXXXXXXXXXXXXXXXXXXXXXXXXXXXXXXXXXXXXXXSSGVSSACPYYNGRSSFFRNVVWLIKKXXXXXXXXXXXXXXXXXXXXXXXXXXXXXXXXXXXXXXXXXXXXXSVGTSTLNQRSXXXIATRPKVNGQSGRMXXXXXXXXXXXXXXFESNGNFIAPEYAYKIVKXXXXXXXXXXXXYGNCDTKCQTPVGAXXXXMPFHNVHPLTXXXXXXXXXXXXXXXXXXXXXXXXRKRKRKTRGLFRGLFGAIAGFIEGGWQGMVDGWYGYHHSNEQGSGYAADKESTQKAIDGITNXXNSIIDKMNXXXXXXXXXXXXXXXXXXXXXXXXXXXXXDVWTYNAELLVLMENERTLDFHDSNVKNLYDKVRLQLRDNAKELGNGCFEFYHKCDNECMESVRNGTYDYXXXXXXXXXXXXXXXXXXXXXXXXYQILSIYSTVASSLALAIMIAGLSFWMCSNGSLQCRICI

SEQ ID NO: 418566 - protein, 573 aa, Influenza virus
  MOD_RES (1)..(15): Any amino acid
  MOD_RES (45)..(52): Any amino acid
  MOD_RES (61)..(69): Any amino acid
  MOD_RES (84)..(88): Any amino acid
  MOD_RES (102)..(143): Any amino acid
  MOD_RES (169)..(215): Any amino acid
  MOD_RES (227)..(229): Any amino acid
  MOD_RES (244)..(257): Any amino acid
  MOD_RES (276)..(287): Any amino acid
  MOD_RES (302)..(305): Any amino acid
  MOD_RES (316)..(344): Any amino acid
  MOD_RES (358)..(360): Any amino acid
  MOD_RES (402)..(403): Any amino acid
  MOD_RES (412)..(440): Any amino acid
  MOD_RES (511)..(534): Any amino acid
  MOD_RES (562)..(563): Any amino acid
XXXXXXXXXXXXXXXSDQICIGYHANNSKKQIDTIMEKNVIFTHXXXXXXXXHNGRLCSLXXXXXXXXXDCSIAGWLIGNPKCXXXXXAPEWSYIVEKNNPXXXXXXXXXXXXXXXXXXXXXXXXXXXXXXXXXXXXXXXXXXSSGVSAACPYHTGRSSFYRNVVWLIXXXXXXXXXXXXXXXXXXXXXXXXXXXXXXXXXXXXXXXXXXXXXXXSIGTSTLNKRSXXXIATRPQVNGQRGRMXXXXXXXXXXXXXXFESTGNFIAPEYAFKIAKXXXXXXXXXXXXYGNCNTKCQTPMGAXXXXMPFHNIHPLTXXXXXXXXXXXXXXXXXXXXXXXXXXXXXEKRRKKRGLFGAIXXXIEGGWQGLVDGWYGYHHINGQGSGYAADRKSTQKAIDGVTNXXNSIIGKMNXXXXXXXXXXXXXXXXXXXXXXXXXXXXXNVWTYNAELFVLMENERTLYFHDSNVRNLYDKVRHQLRDNARELGNGCFEFYHRCDNECMESVKNGTYDYXXXXXXXXXXXXXXXXXXXXXXXXYQILSVYSTVASSLVLAIMVAGLSFWMXXNGSLQCTICI

SEQ ID NO: 418567 - protein, 573 aa, Influenza virus
  MOD_RES (1)..(15): Any amino acid
  MOD_RES (47)..(52): Any amino acid
  MOD_RES (61)..(69): Any amino acid
  MOD_RES (84)..(88): Any amino acid
  MOD_RES (102)..(143): Any amino acid
  MOD_RES (152)..(157): Any amino acid
  MOD_RES (171)..(215): Any amino acid
  MOD_RES (227)..(229): Any amino acid
  MOD_RES (244)..(264): Any amino acid
  MOD_RES (276)..(287): Any amino acid
  MOD_RES (302)..(305): Any amino acid
  MOD_RES (316)..(344): Any amino acid
  MOD_RES (354)..(361): Any amino acid
  MOD_RES (402)..(403): Any amino acid
  MOD_RES (412)..(440): Any amino acid
  MOD_RES (497)..(497): Any amino acid
  MOD_RES (511)..(534): Any amino acid
  MOD_RES (562)..(563): Any amino acid
XXXXXXXXXXXXXXXGDRICIGYHANNSTKQVDTIMERNVTVTHARXXXXXXHNGKLCSIXXXXXXXXXDCSVAGWILGNPMCXXXXXTPEWSYIVEKANPXXXXXXXXXXXXXXXXXXXXXXXXXXXXXXXXXXXXXXXXXXSGVTSACSXXXXXXPSFFRNVVWLTKKXXXXXXXXXXXXXXXXXXXXXXXXXXXXXXXXXXXXXXXXXXXXXFVGTSTLNQRLXXXIATRPRVNGQSGRIXXXXXXXXXXXXXXXXXXXXXIAPEYAYRIIKXXXXXXXXXXXXYGNCNAKCQTPLGAXXXXLPFHNVHPFTXXXXXXXXXXXXXXXXXXXXXXXXXXXXXERRRKKRGLXXXXXXXXEGGWQGMIDGWYGYHHTNDQGSGYAADKKSTQKAINGITNXXNSIIDRMNXXXXXXXXXXXXXXXXXXXXXXXXXXXXXGVWTYNAELLVLIENERTLDLHDSNVKNLYNKVRLQLKDNAREMGNGCFEFYHKCNXKCMESVRNGTYNYXXXXXXXXXXXXXXXXXXXXXXXXYQILTIYSTVASSLTLAIMMAGLSFWMXXNGSLQCRVCI

SEQ ID NO: 418568 - protein, 573 aa, Influenza virus
  MOD_RES (1)..(15): Any amino acid
  MOD_RES (47)..(52): Any amino acid
  MOD_RES (61)..(69): Any amino acid
  MOD_RES (78)..(92): Any amino acid
  MOD_RES (102)..(143): Any amino acid
  MOD_RES (153)..(157): Any amino acid
  MOD_RES (168)..(215): Any amino acid
  MOD_RES (224)..(229): Any amino acid
  MOD_RES (244)..(266): Any amino acid
  MOD_RES (276)..(287): Any amino acid
  MOD_RES (302)..(305): Any amino acid
  MOD_RES (314)..(348): Any amino acid
  MOD_RES (358)..(371): Any amino acid
  MOD_RES (402)..(403): Any amino acid
  MOD_RES (412)..(440): Any amino acid
  MOD_RES (449)..(459): Any amino acid
  MOD_RES (511)..(534): Any amino acid
  MOD_RES (567)..(573): Any amino acid
XXXXXXXXXXXXXXXGDRICVGYHANNSTKQIDTIVEKNVTVTHTQXXXXXXHNGKLCDLXXXXXXXXXDCSAAGWLXXXXXXXXXXXXXXXSYIVEKDSPXXXXXXXXXXXXXXXXXXXXXXXXXXXXXXXXXXXXXXXXXXTSGVSSACLXXXXXSSFFRNIVWLXXXXXXXXXXXXXXXXXXXXXXXXXXXXXXXXXXXXXXXXXXXXXXXXSVTSTLNQXXXXXXIATRSKVNGQSGRVXXXXXXXXXXXXXXXXXXXXXXXPEYAYKIIKXXXXXXXXXXXXYGNCDAKCQTPIGAXXXXKPFHNIHPXXXXXXXXXXXXXXXXXXXXXXXXXXXXXXXXXXXETRGLFGAIXXXXXXXXXXXXXXWYGYHHNNAQGSGYAADKASTQRAIDGITNXXNSIINKMNXXXXXXXXXXXXXXXXXXXXXXXXXXXXXEVWTYNAEXXXXXXXXXXXDFHDSNVRKLYDRVRLQLKDNAKEMGNGCFEFYHKCDDVCMESVRNGTYKYXXXXXXXXXXXXXXXXXXXXXXXXYRILSIYSSVASSLALAIIIAGLSFWRCSNGSXXXXXXX

SEQ ID NO: 418569 - protein, 573 aa, Influenza virus
  MOD_RES (1)..(15): Any amino acid
  MOD_RES (48)..(52): Any amino acid
  MOD_RES (61)..(69): Any amino acid
  MOD_RES (84)..(92): Any amino acid
  MOD_RES (102)..(143): Any amino acid
  MOD_RES (152)..(160): Any amino acid
  MOD_RES (171)..(215): Any amino acid
  MOD_RES (227)..(229): Any amino acid
  MOD_RES (240)..(266): Any amino acid
  MOD_RES (276)..(293): Any amino acid
  MOD_RES (302)..(305): Any amino acid
  MOD_RES (316)..(348): Any amino acid
  MOD_RES (357)..(380): Any amino acid
  MOD_RES (398)..(403): Any amino acid
  MOD_RES (412)..(440): Any amino acid
  MOD_RES (455)..(467): Any amino acid
  MOD_RES (508)..(534): Any amino acid
  MOD_RES (566)..(573): Any amino acid
XXXXXXXXXXXXXXXSDQICIGHHANNSTEQIDTIMEKIVTVTHAQNXXXXXHKGKLCSLXXXXXXXXXDCSVAGLVLGNPMCXXXXXXXXXSYIVEKDKPXXXXXXXXXXXXXXXXXXXXXXXXXXXXXXXXXXXXXXXXXXSSGLSSACXXXXXXXXXFRNVVWLVKKXXXXXXXXXXXXXXXXXXXXXXXXXXXXXXXXXXXXXXXXXXXXXSVGTPTLNQRSXXXIAIRPKVNGQXXXXXXXXXXXXXXXXXXXXXXXXXXXPEYAYKIAKXXXXXXXXXXXXXXXXXXKCQTPLVAXXXXKPFHNVHPLAXXXXXXXXXXXXXXXXXXXXXXXXXXXXXXXXXKTRGLFGAXXXXXXXXXXXXXXXXXXXXXXXXQGSGYGEDKESTQRAIDXXXXXXNSIIEKMNXXXXXXXXXXXXXXXXXXXXXXXXXXXXXDVWTYNTELLVLMEXXXXXXXXXXXXXNLYDKVRFQLKDNAKEWGNGCFEFYHRCDDECIESVRNGTXXXXXXXXXXXXXXXXXXXXXXXXXXXYKILSIYSTVVSSLVLAIMIAGLFFWMCSNGXXXXXXXX

SEQ ID NO: 418570 - protein, 573 aa, Influenza virus
  MOD_RES (1)..(31): Any amino acid
  MOD_RES (46)..(144): Any amino acid
  MOD_RES (153)..(217): Any amino acid
  MOD_RES (226)..(233): Any amino acid
  MOD_RES (242)..(306): Any amino acid
  MOD_RES (315)..(348): Any amino acid
  MOD_RES (357)..(382): Any amino acid
  MOD_RES (395)..(472): Any amino acid
  MOD_RES (481)..(501): Any amino acid
  MOD_RES (511)..(543): Any amino acid
  MOD_RES (553)..(553): Any amino acid
  MOD_RES (562)..(573): Any amino acid
XXXXXXXXXXXXXXXXXXXXXXXXXXXXXXXVDTIREKNVTVTRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGVSSACPXXXXXXXXXXXXXXXXXXXXXXXXXXXXXXXXXXXXXXXXXXXXXXXXXXXXXXXXXXXXXXXXXGTLTLNQRXXXXXXXXLKVNGQSGXXXXXXXXXXXXXXXXXXXXXXXXXXXXXXXXXXXXXXXXXXXXXXXXXXXXXXXXXXXXXXXXXPFSNIHPLXXXXXXXXXXXXXXXXXXXXXXXXXXXXXXXXXXETKGLFGAXXXXXXXXXXXXXXXXXXXXXXXXXXGGYAADKESTQRXXXXXXXXXXXXXXXXXXXXXXXXXXXXXXXXXXXXXXXXXXXXXXXXXXXXXXXXXXXXXXXXXXXXXXXXXXXXXXVQLQLRDNXXXXXXXXXXXXXXXXXXXXXSVKNGTYNYXXXXXXXXXXXXXXXXXXXXXXXXXXXXXXXXXVVSSLALAIXETGLSLCMXXXXXXXXXXXX

SEQ ID NO: 418571 - protein, 573 aa, Influenza virus
  MOD_RES (1)..(31): Any amino acid
  MOD_RES (48)..(218): Any amino acid
  MOD_RES (227)..(234): Any amino acid
  MOD_RES (243)..(307): Any amino acid
  MOD_RES (316)..(383): Any amino acid
  MOD_RES (402)..(473): Any amino acid
  MOD_RES (482)..(573): Any amino acid
XXXXXXXXXXXXXXXXXXXXXXXXXXXXXXXVDTIMEKIVTVTQAQDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSSLNQRSXXXXXXXXNVNGQSGRXXXXXXXXXXXXXXXXXXXXXXXXXXXXXXXXXXXXXXXXXXXXXXXXXXXXXXXXXXXXXXXXXLHNVHPFTXXXXXXXXXXXXXXXXXXXXXXXXXXXXXXXXXXXXXXXXXXXXXXXXXXXXXXXXXXXXXXXXXXXXGYAANKESTQKAVDGITNXXXXXXXXXXXXXXXXXXXXXXXXXXXXXXXXXXXXXXXXXXXXXXXXXXXXXXXXXXXXXXXXXXXXXXXXRIQLRDNAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418572 - protein, 573 aa, Influenza virus
  MOD_RES (1)..(32): Any amino acid
  MOD_RES (48)..(385): Any amino acid
  MOD_RES (394)..(473): Any amino acid
  MOD_RES (482)..(573): Any amino acid
XXXXXXXXXXXXXXXXXXXXXXXXXXXXXXXXDTTMEKNVTVSHAQDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAADKDSTQXXXXXXXXXXXXXXXXXXXXXXXXXXXXXXXXXXXXXXXXXXXXXXXXXXXXXXXXXXXXXXXXXXXXXXXXXXXXXXXXRFQLRDNAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418573 - protein, 573 aa, Influenza virus
  MOD_RES (1)..(34): Any amino acid
  MOD_RES (43)..(387): Any amino acid
  MOD_RES (396)..(573): Any amino acid
XXXXXXXXXXXXXXXXXXXXXXXXXXXXXXXXXXIMEKSVTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGQESPPKAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418574 - protein, 573 aa, Influenza virus
  MOD_RES (1)..(389): Any amino acid
  MOD_RES (398)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXESTQKAINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418575 - protein, 471 aa, Influenza virus
  MOD_RES (1)..(4): Any amino acid
  MOD_RES (16)..(83): Any amino acid
  MOD_RES (126)..(127): Any amino acid
  MOD_RES (208)..(216): Any amino acid
  MOD_RES (235)..(236): Any amino acid
  MOD_RES (251)..(265): Any amino acid
  MOD_RES (312)..(315): Any amino acid
  MOD_RES (334)..(334): Any amino acid
  MOD_RES (359)..(359): Any amino acid
  MOD_RES (383)..(402): Any amino acid
  MOD_RES (416)..(417): Any amino acid
  MOD_RES (436)..(436): Any amino acid
  MOD_RES (471)..(471): Any amino acid
XXXXQKIITIGSVSLXXXXXXXXXXXXXXXXXXXXXXXXXXXXXXXXXXXXXXXXXXXXXXXXXXXXXXXXXXXXXXXXXXXXYRNWSKPQCQITGFAPFSKDNSIRLSAGGDIWVTREPYVSCDXXKCYQFALGQGTTLDNKHSNGTIHDRIPHRTLLMNELGVPFHLGTKQVCIAWSSSSCHDGKAWLHVCVTGDDRNATASFIYXXXXXXXXXSWSQNILRTQESECVCINXXCTVVMTDGSASGRAXXXXXXXXXXXXXXXSPLSGSAQHIEECSCYPRSYPNVRCVCRDNWKGSNRPVKLDINMADXXXXSSYVCSGLVGDTPRNDDSXSSSNCRDPNNERGNPGVKGWAFDNXDDVWMGRTISKDSRSGYETFRVIXXXXXXXXXXXXXXXXXXXXNNWSGYSGIFSVEXXSCINRCFYVELIRGRPQEXRVWWTSNSIVVFCGTSGTYGTGSWPDGANINFMPX

SEQ ID NO: 418576 - protein, 471 aa, Influenza virus
  MOD_RES (1)..(4): Any amino acid
  MOD_RES (16)..(83): Any amino acid
  MOD_RES (126)..(127): Any amino acid
  MOD_RES (208)..(216): Any amino acid
  MOD_RES (233)..(236): Any amino acid
  MOD_RES (250)..(265): Any amino acid
  MOD_RES (304)..(315): Any amino acid
  MOD_RES (334)..(334): Any amino acid
  MOD_RES (359)..(359): Any amino acid
  MOD_RES (383)..(402): Any amino acid
  MOD_RES (416)..(417): Any amino acid
  MOD_RES (434)..(436): Any amino acid
  MOD_RES (450)..(457): Any amino acid
  MOD_RES (471)..(471): Any amino acid
XXXXQRIITIGSISLXXXXXXXXXXXXXXXXXXXXXXXXXXXXXXXXXXXXXXXXXXXXXXXXXXXXXXXXXXXXXXXXXXXXYRDWSKPQCQVTGFAPFSKDNSIQLSAGGDIWITREPYVSCSXXRCYQFALGQGTTLNNNHSNGTIHDRTPHRTLLMSELGVPFHLGTRQVCIAWSSSSCYDGKAWLHICVTGDDKNATASFVYXXXXXXXXXSWSKNILRTQESECICXXXXCAVVMTDGSASRRXXXXXXXXXXXXXXXXSPLTGSAQHIEECSCYPQSYLNVRCVCRDNWMGSNRPVXXXXXXXXXXXXSSYICSGLVGDTPRNNDSXSNSNCKDPNNERGNSGVKGWAFDYXNDVWMGRTVSKDSRLGYETFKVIXXXXXXXXXXXXXXXXXXXXSNWSGYSGVFSVEXXGCINRCFYVEMIRGRPXXXRVWWTTNSIVVFCXXXXXXXXGSWPDGADINFMPX

SEQ ID NO: 418577 - protein, 471 aa, Influenza virus
  MOD_RES (1)..(4): Any amino acid
  MOD_RES (16)..(83): Any amino acid
  MOD_RES (101)..(106): Any amino acid
  MOD_RES (116)..(117): Any amino acid
  MOD_RES (126)..(134): Any amino acid
  MOD_RES (208)..(216): Any amino acid
  MOD_RES (225)..(225): Any amino acid
  MOD_RES (235)..(236): Any amino acid
  MOD_RES (251)..(265): Any amino acid
  MOD_RES (284)..(287): Any amino acid
  MOD_RES (304)..(315): Any amino acid
  MOD_RES (325)..(325): Any amino acid
  MOD_RES (334)..(334): Any amino acid
  MOD_RES (359)..(359): Any amino acid
  MOD_RES (382)..(402): Any amino acid
  MOD_RES (416)..(417): Any amino acid
  MOD_RES (436)..(438): Any amino acid
  MOD_RES (455)..(460): Any amino acid
  MOD_RES (471)..(471): Any amino acid
XXXXQKIITVGSVSLXXXXXXXXXXXXXXXXXXXXXXXXXXXXXXXXXXXXXXXXXXXXXXXXXXXXXXXXXXXXXXXXXXXXYKNWSKPQCEITGFAPFXXXXXXRLSAGGNIWXXREPYVSCGXXXXXXXXXGQGTTLDHNHSNGTIHDRSSYRTLLMNELGIPFHLGTKQVCMAWSSSSCHDGRAWLHVCVTGDDGNATASIIYXXXXXXXXXSWSLNILRXQESECVCVNXXCTVIMTDGSASGKAXXXXXXXXXXXXXXXSSLSGSAQHVEECSCYPHXXXXIRCVCRDNWKGSNRPIXXXXXXXXXXXXSRYICSGLVXDTPRNDDGXSNSNCRDPNNESGSQGVKGWAFDDXSDVWMGRTISRDSRSGYETFKVXXXXXXXXXXXXXXXXXXXXXNNRSGYSGIFSIEXXSCVNRCFYVELIRGRPKEXXXWWTSNSIIAFCGTSGTXXXXXXPDGANINLMPX

SEQ ID NO: 418578 - protein, 471 aa, Influenza virus
  MOD_RES (1)..(4): Any amino acid
  MOD_RES (16)..(83): Any amino acid
  MOD_RES (101)..(106): Any amino acid
  MOD_RES (116)..(134): Any amino acid
  MOD_RES (151)..(153): Any amino acid
  MOD_RES (162)..(168): Any amino acid
  MOD_RES (208)..(216): Any amino acid
  MOD_RES (225)..(226): Any amino acid
  MOD_RES (235)..(237): Any amino acid
  MOD_RES (251)..(265): Any amino acid
  MOD_RES (284)..(287): Any amino acid
  MOD_RES (299)..(315): Any amino acid
  MOD_RES (325)..(325): Any amino acid
  MOD_RES (334)..(334): Any amino acid
  MOD_RES (344)..(346): Any amino acid
  MOD_RES (359)..(359): Any amino acid
  MOD_RES (383)..(402): Any amino acid
  MOD_RES (411)..(417): Any amino acid
  MOD_RES (426)..(439): Any amino acid
  MOD_RES (454)..(462): Any amino acid
  MOD_RES (471)..(471): Any amino acid
XXXXQKIIAIGSVSLXXXXXXXXXXXXXXXXXXXXXXXXXXXXXXXXXXXXXXXXXXXXXXXXXXXXXXXXXXXXXXXXXXXXYRGWSKPQCKITGFAPFXXXXXXRLSAGGSIWXXXXXXXXXXXXXXXXXXXGQGTTLKDRHSNGTIHXXXSHRTLLMNXXXXXXXLGTKQVCVAWSSSSCHDGNAWLHVCVTGDDSNATASLIYXXXXXXXXXSCSQNILRXXESECVCISXXXAVVMTDGNASGRAXXXXXXXXXXXXXXXSPLSGNAQHIEECSCYPKXXXXVRCICRDNWKGXXXXXXXXXXXXXXXXXSHYVCSGLVXDTPRNDDIXSSSNCKDPNXXXGSPGVKGWAFDIXDDIWMGRTISEDSRSGYETFRVTXXXXXXXXXXXXXXXXXXXXKNWSGYSGXXXXXXXNCINRCFYXXXXXXXXXXXXXXWTSNSIVAFCGTSGXXXXXXXXXGANINFMAX

SEQ ID NO: 418579 - protein, 471 aa, Influenza virus
  MOD_RES (1)..(4): Any amino acid
  MOD_RES (16)..(83): Any amino acid
  MOD_RES (103)..(106): Any amino acid
  MOD_RES (116)..(141): Any amino acid
  MOD_RES (150)..(153): Any amino acid
  MOD_RES (162)..(178): Any amino acid
  MOD_RES (193)..(194): Any amino acid
  MOD_RES (205)..(226): Any amino acid
  MOD_RES (235)..(241): Any amino acid
  MOD_RES (250)..(265): Any amino acid
  MOD_RES (274)..(287): Any amino acid
  MOD_RES (304)..(334): Any amino acid
  MOD_RES (359)..(359): Any amino acid
  MOD_RES (383)..(402): Any amino acid
  MOD_RES (411)..(417): Any amino acid
  MOD_RES (426)..(462): Any amino acid
  MOD_RES (471)..(471): Any amino acid
XXXXHKIITIGSASLXXXXXXXXXXXXXXXXXXXXXXXXXXXXXXXXXXXXXXXXXXXXXXXXXXXXXXXXXXXXXXXXXXXXYRSWSKPQCQIAGFAPFSKXXXXRLSAGGGIWXXXXXXXXXXXXXXXXXXXXXXXXXXNRHSNGTIXXXXPYRTLLMNXXXXXXXXXXXXXXXXXSRSSCHDGRAWLHIXXTGHDKNATASXXXXXXXXXXXXXXXXXXXXXXESECVCIDXXXXXXXTDGSASERXXXXXXXXXXXXXXXXSPLLGSAQXXXXXXXXXXXXXXVTCVCRDNWKSSNRPVXXXXXXXXXXXXXXXXXXXXXXXXXXXXXXXSSSNCRDSNNERGNHGVKGWAFDSXNDIWMGRTINKNSRSGYETFRVLXXXXXXXXXXXXXXXXXXXXDNWSGYSGXXXXXXXHCINRCFYXXXXXXXXXXXXXXXXXXXXXXXXXXXXXXXXXXXXXGANINFMSX

SEQ ID NO: 418580 - protein, 471 aa, Influenza virus
  MOD_RES (1)..(141): Any amino acid
  MOD_RES (150)..(186): Any amino acid
  MOD_RES (205)..(242): Any amino acid
  MOD_RES (251)..(266): Any amino acid
  MOD_RES (279)..(338): Any amino acid
  MOD_RES (348)..(361): Any amino acid
  MOD_RES (383)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNKHSNGTMXXXXXXXXXXXXXXXXXXXXXXXXXXXXXXXXXXXXXKAWLHVCITGDDRNATANXXXXXXXXXXXXXXXXXXXXXXXXXXXXXXXXXXXXXXDGSATGKAXXXXXXXXXXXXXXXXPLSGGAQHIEECXXXXXXXXXXXXXXXXXXXXXXXXXXXXXXXXXXXXXXXXXXXXXXXXXXXXXXXXXXXXCRDPNNEKGXXXXXXXXXXXXXXVWLGRTISKNSRSGYETFRIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418581 - protein, 471 aa, Influenza virus
  MOD_RES (1)..(145): Any amino acid
  MOD_RES (154)..(195): Any amino acid
  MOD_RES (204)..(242): Any amino acid
  MOD_RES (251)..(267): Any amino acid
  MOD_RES (276)..(364): Any amino acid
  MOD_RES (373)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGTTHDRTXXXXXXXXXXXXXXXXXXXXXXXXXXXXXXXXXXXXXXXXXXGNDRNATAXXXXXXXXXXXXXXXXXXXXXXXXXXXXXXXXXXXXXXXDGSASGEAXXXXXXXXXXXXXXXXXPLGSAQATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRTIKEDSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418582 - protein, 471 aa, Influenza virus
  MOD_RES (1)..(268): Any amino acid
  MOD_RES (277)..(365): Any amino acid
  MOD_RES (374)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGSAQHIQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTISQDSRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418583 - protein, 570 aa, Influenza virus
  MOD_RES (1)..(13): Any amino acid
  MOD_RES (52)..(73): Any amino acid
  MOD_RES (85)..(89): Any amino acid
  MOD_RES (100)..(100): Any amino acid
  MOD_RES (112)..(126): Any amino acid
  MOD_RES (136)..(157): Any amino acid
  MOD_RES (168)..(188): Any amino acid
  MOD_RES (200)..(213): Any amino acid
  MOD_RES (223)..(238): Any amino acid
  MOD_RES (274)..(277): Any amino acid
  MOD_RES (286)..(305): Any amino acid
  MOD_RES (329)..(329): Any amino acid
  MOD_RES (343)..(344): Any amino acid
  MOD_RES (393)..(393): Any amino acid
  MOD_RES (413)..(413): Any amino acid
  MOD_RES (424)..(424): Any amino acid
  MOD_RES (465)..(467): Any amino acid
  MOD_RES (495)..(496): Any amino acid
  MOD_RES (510)..(526): Any amino acid
  MOD_RES (550)..(554): Any amino acid
XXXXXXXXXXXXXGKSDKICIGYHANNSTTQVDTILEKNVTVTHSVELLENXXXXXXXXXXXXXXXXXXXXXXEGWILGNPQCDXXXXXQSWSYIVERPXAQNGICYPGVLXXXXXXXXXXXXXXXVERFEMFPKXXXXXXXXXXXXXXXXXXXXXXSSFYRNLLWIXXXXXXXXXXXXXXXXXXXXXPILYFWGVHHPXXXXXXXXXXXXXXRYVRMGTESXXXXXXXXXXXXXXXXGQRGRIDYYWSVLKPGETLNVESNGNLIAPWYAYKXXXXNNNKGAVFXXXXXXXXXXXXXXXXXXXXRTNKTFQNVSPLWIGECPKYVKSXSLRLATGLRNVPQXXTRGLFGAIAGFIEGGWTGMIDGWYGYHHENSQGSGYAADKESTQKAIDXITNKVNSIIDKMNTQFEAVXHEFSNLERRIXNLNKRMEDGFLDVWTYNAELLVLLENERTLDLHDANVKNLXXXVKSQLRDNANDLGNGCFEFWHKCDNECXXSVKNGTYDYPKYQXXXXXXXXXXXXXXXXXLGVYQILAIYSTVSSSLVLVGLIXXXXXWMCSNGSMQCRICIGS

SEQ ID NO: 418584 - protein, 570 aa, Influenza virus
  MOD_RES (1)..(13): Any amino acid
  MOD_RES (23)..(23): Any amino acid
  MOD_RES (52)..(73): Any amino acid
  MOD_RES (85)..(89): Any amino acid
  MOD_RES (100)..(100): Any amino acid
  MOD_RES (112)..(126): Any amino acid
  MOD_RES (136)..(157): Any amino acid
  MOD_RES (166)..(188): Any amino acid
  MOD_RES (198)..(213): Any amino acid
  MOD_RES (223)..(238): Any amino acid
  MOD_RES (274)..(305): Any amino acid
  MOD_RES (329)..(329): Any amino acid
  MOD_RES (343)..(344): Any amino acid
  MOD_RES (371)..(376): Any amino acid
  MOD_RES (393)..(393): Any amino acid
  MOD_RES (413)..(413): Any amino acid
  MOD_RES (424)..(424): Any amino acid
  MOD_RES (465)..(467): Any amino acid
  MOD_RES (495)..(496): Any amino acid
  MOD_RES (510)..(526): Any amino acid
  MOD_RES (550)..(554): Any amino acid
  MOD_RES (568)..(570): Any amino acid
XXXXXXXXXXXXXGRSDKICIGXHANNSTTKVDTILERNVTVTHSIELLENXXXXXXXXXXXXXXXXXXXXXXDGWILGNPRCDXXXXXRSWSYIVERLXAQHGICYPGTLXXXXXXXXXXXXXXXIQRFEMFPKXXXXXXXXXXXXXXXXXXXXXXPSFYRNLLXXXXXXXXXXXXXXXXXXXXXXXSVLYFWGVHXXXXXXXXXXXXXXXXRYVRLGTESXXXXXXXXXXXXXXXXGQKGRIDYYWSILKPGETLKVESNGNLVAPWYAYKXXXXXXXXXXXXXXXXXXXXXXXXXXXXXXXXNTNKTFQNISPVWIGKCPKYVKSXSLKLATGLRNIPQXXTRGIFGAIAGFIEGGWTGLIDGWYGYXXXXXXGSGYAADRESTQKAVNXITTKVNSIINKMNTQFEAIXHEFSSLERRIXNLNKRMQDGFLNVWTYNAELLILLENERTLDMHDANVKSLXXXVRSQLRDNAKDLGNGCFEFWHKCNNECXXSVKNGTYNYPKYQXXXXXXXXXXXXXXXXXFGVYQILAIYSTISSSLVLMGLIXXXXXWMCSNSSMQCRICXXX

SEQ ID NO: 418585 - protein, 570 aa, Influenza virus
  MOD_RES (1)..(13): Any amino acid
  MOD_RES (52)..(73): Any amino acid
  MOD_RES (85)..(89): Any amino acid
  MOD_RES (100)..(100): Any amino acid
  MOD_RES (112)..(126): Any amino acid
  MOD_RES (135)..(157): Any amino acid
  MOD_RES (168)..(188): Any amino acid
  MOD_RES (200)..(213): Any amino acid
  MOD_RES (223)..(238): Any amino acid
  MOD_RES (274)..(305): Any amino acid
  MOD_RES (329)..(329): Any amino acid
  MOD_RES (343)..(344): Any amino acid
  MOD_RES (353)..(356): Any amino acid
  MOD_RES (372)..(381): Any amino acid
  MOD_RES (393)..(393): Any amino acid
  MOD_RES (411)..(413): Any amino acid
  MOD_RES (424)..(424): Any amino acid
  MOD_RES (442)..(443): Any amino acid
  MOD_RES (465)..(467): Any amino acid
  MOD_RES (481)..(484): Any amino acid
  MOD_RES (495)..(496): Any amino acid
  MOD_RES (508)..(526): Any amino acid
  MOD_RES (536)..(538): Any amino acid
  MOD_RES (547)..(554): Any amino acid
  MOD_RES (569)..(570): Any amino acid
XXXXXXXXXXXXXSKSDRICIGYHANNSTTQIDTILEKNITVTHSVELLESXXXXXXXXXXXXXXXXXXXXXXKGWILGNPKCDXXXXXQSWSYVVERPXARNGICYPGALXXXXXXXXXXXXXXXVQRFEMFPXXXXXXXXXXXXXXXXXXXXXXXSSFYRNLVWIXXXXXXXXXXXXXXXXXXXXXSVLYFWGIHHPXXXXXXXXXXXXXXRYIRMGTESXXXXXXXXXXXXXXXXGQRSRIDYYWSMLKPGETLNIESNGNLIAPWYAFRXXXXXXXXXXXXXXXXXXXXXXXXXXXXXXXXRTNRTFQNVSPVWIGGCPKYVKSXNLKLATGLRNVPKXXNRGLFGAIXXXXEGGWTGMVDGWYGYHXXXXXXXXXXADRESTQRAIDXITSKVNSIIEKMNTQFEXXXHEFSNLEKRIXNMNKRMEDGLLDVWTYNXXLLVLLENGRTLDMHDVNVKNLXXXVKSQLKDNAKDLGXXXXEFWHKCDDECXXSVKKGTYDYPKXXXXXXXXXXXXXXXXXXXFDVYQILAIXXXVSSSLVLAXXXXXXXXWMCLNGSMQCRVCIXX

SEQ ID NO: 418586 - protein, 570 aa, Influenza virus
  MOD_RES (1)..(13): Any amino acid
  MOD_RES (22)..(25): Any amino acid
  MOD_RES (41)..(43): Any amino acid
  MOD_RES (52)..(76): Any amino acid
  MOD_RES (85)..(89): Any amino acid
  MOD_RES (99)..(100): Any amino acid
  MOD_RES (112)..(126): Any amino acid
  MOD_RES (136)..(159): Any amino acid
  MOD_RES (168)..(188): Any amino acid
  MOD_RES (197)..(214): Any amino acid
  MOD_RES (223)..(238): Any amino acid
  MOD_RES (260)..(265): Any amino acid
  MOD_RES (274)..(305): Any amino acid
  MOD_RES (315)..(317): Any amino acid
  MOD_RES (329)..(344): Any amino acid
  MOD_RES (353)..(381): Any amino acid
  MOD_RES (393)..(393): Any amino acid
  MOD_RES (413)..(424): Any amino acid
  MOD_RES (443)..(444): Any amino acid
  MOD_RES (463)..(467): Any amino acid
  MOD_RES (479)..(485): Any amino acid
  MOD_RES (495)..(496): Any amino acid
  MOD_RES (505)..(526): Any amino acid
  MOD_RES (535)..(538): Any amino acid
  MOD_RES (547)..(555): Any amino acid
  MOD_RES (569)..(570): Any amino acid
XXXXXXXXXXXXXSKSDKICIXXXXNNSTTQVNTILEKNVXXXHSIELLESXXXXXXXXXXXXXXXXXXXXXXXXXILGNPRCGXXXXXQRWSYIVERXXAKNGICYPGILXXXXXXXXXXXXXXXIERFEMFPRXXXXXXXXXXXXXXXXXXXXXXXXFYRSLLWIXXXXXXXXXXXXXXXXXXXXXSILYFWGVXXXXXXXXXXXXXXXXXXYVRMGTERXXXXXXXXXXXXXXXXSQRGRIDYFWSILRPGETLNVXXXXXXIAPWYAYRXXXXXXXXXXXXXXXXXXXXXXXXXXXXXXXXKTNKTFQNAXXXWVGECPKYVRSXXXXXXXXXXXXXXXXARGLFGAIXXXXXXXXXXXXXXXXXXXXXXXXXXXXXADKESTQRAVNXITNKANSIIDKVNTQFEAVXXXXXXXXXXXXSLNKRMEDGFMDVWTYNAXXLVLLEDERTLDQHDANVKXXXXXVKSLLRDNAKDXXXXXXXFWHKCDNDCXXSIKNGTYDXXXXXXXXXXXXXXXXXXXXXXIGVYQILAXXXXVSSGLVLVXXXXXXXXXMCQNGSMQCKICIXX

SEQ ID NO: 418587 - protein, 570 aa, Influenza virus
  MOD_RES (1)..(13): Any amino acid
  MOD_RES (22)..(27): Any amino acid
  MOD_RES (43)..(43): Any amino acid
  MOD_RES (52)..(89): Any amino acid
  MOD_RES (99)..(100): Any amino acid
  MOD_RES (112)..(127): Any amino acid
  MOD_RES (136)..(188): Any amino acid
  MOD_RES (197)..(214): Any amino acid
  MOD_RES (223)..(238): Any amino acid
  MOD_RES (258)..(265): Any amino acid
  MOD_RES (274)..(309): Any amino acid
  MOD_RES (321)..(384): Any amino acid
  MOD_RES (393)..(399): Any amino acid
  MOD_RES (412)..(424): Any amino acid
  MOD_RES (440)..(448): Any amino acid
  MOD_RES (465)..(469): Any amino acid
  MOD_RES (481)..(496): Any amino acid
  MOD_RES (507)..(526): Any amino acid
  MOD_RES (537)..(541): Any amino acid
  MOD_RES (550)..(557): Any amino acid
  MOD_RES (566)..(570): Any amino acid
XXXXXXXXXXXXXGKSDRICIXXXXXXSTTQVDTLLEKNVTVXHSVELLEDXXXXXXXXXXXXXXXXXXXXXXXXXXXXXXXXXXXXXXQSWSCIVERXXAQYGICYPGVMXXXXXXXXXXXXXXXXERFEMFPQXXXXXXXXXXXXXXXXXXXXXXXXXXXXXXXXXXXXXXXXXXXXXXXXXXXXXPVLYFWGVXXXXXXXXXXXXXXXXXXYVRLGTERXXXXXXXXXXXXXXXXGQKARIDYYWSVLRPGETLXXXXXXXXVAPWYAYRXXXXXXXXXXXXXXXXXXXXXXXXXXXXXXXXXXXXTFQNVSPIWIGXXXXXXXXXXXXXXXXXXXXXXXXXXXXXXXXXXXXXXXXXXXXXXXXXXXXXXXXXXXXXXXXESTQKAVDXXXXXXXSIINKMNAQFEAXXXXXXXXXXXXXNLNKRMENGFLDVWTXXXXXXXXXENERTLDQHDANVRNLXXXXXSQLKDNANDLGXXXXXXXXXXXXXXXXSVKNGTYKYPXXXXXXXXXXXXXXXXXXXXLGIYQILAIYXXXXXSLVLVGLVXXXXXXXXSNGSMQCKXXXXX

SEQ ID NO: 418588 - protein, 570 aa, Influenza virus
  MOD_RES (1)..(15): Any amino acid
  MOD_RES (25)..(242): Any amino acid
  MOD_RES (258)..(311): Any amino acid
  MOD_RES (321)..(403): Any amino acid
  MOD_RES (412)..(427): Any amino acid
  MOD_RES (436)..(454): Any amino acid
  MOD_RES (463)..(471): Any amino acid
  MOD_RES (481)..(497): Any amino acid
  MOD_RES (507)..(528): Any amino acid
  MOD_RES (542)..(557): Any amino acid
  MOD_RES (569)..(570): Any amino acid
XXXXXXXXXXXXXXXSHKICIGYHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRINYYWSVLNPGETLXXXXXXXXXXXXXXXXXXXXXXXXXXXXXXXXXXXXXXXXXXXXXXXXXXXXXXQNVSPLWVGXXXXXXXXXXXXXXXXXXXXXXXXXXXXXXXXXXXXXXXXXXXXXXXXXXXXXXXXXXXXXXXXXXXXXXXXXXXXXXXXXXXKMNTQFDAXXXXXXXXXXXXXXXXKRMQDGFMXXXXXXXXXXXXXXXXXXXDLHDANVRXXXXXXXXXLRDNAMILGXXXXXXXXXXXXXXXXXVENGTYDYPXXXXXXXXXXXXXXXXXXXXXXVYQILSIYSTVSSXXXXXXXXXXXXXXXXSNGSMQCNVCIXX

SEQ ID NO: 418589 - protein, 570 aa, Influenza virus
  MOD_RES (1)..(243): Any amino acid
  MOD_RES (252)..(317): Any amino acid
  MOD_RES (327)..(501): Any amino acid
  MOD_RES (510)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGYYWSVLXXXXXXXXXXXXXXXXXXXXXXXXXXXXXXXXXXXXXXXXXXXXXXXXXXXXXXXXXXXXXXXXXXWNGECPKYVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYNYPKYHXXXXXXXXXXXXXXXXXXXXXXXXXXXXXXXXXXXXXXXXXXXXXXXXXXXXXXXXXXXXX

SEQ ID NO: 418590 - protein, 619 aa, Influenza virus
  MOD_RES (14)..(23): Any amino acid
  MOD_RES (42)..(42): Any amino acid
  MOD_RES (67)..(93): Any amino acid
  MOD_RES (105)..(118): Any amino acid
  MOD_RES (127)..(169): Any amino acid
  MOD_RES (178)..(204): Any amino acid
  MOD_RES (214)..(251): Any amino acid
  MOD_RES (265)..(272): Any amino acid
  MOD_RES (289)..(320): Any amino acid
  MOD_RES (329)..(330): Any amino acid
  MOD_RES (341)..(341): Any amino acid
  MOD_RES (355)..(356): Any amino acid
  MOD_RES (374)..(375): Any amino acid
  MOD_RES (459)..(463): Any amino acid
  MOD_RES (480)..(480): Any amino acid
  MOD_RES (539)..(539): Any amino acid
  MOD_RES (552)..(553): Any amino acid
  MOD_RES (563)..(567): Any amino acid
  MOD_RES (593)..(598): Any amino acid
  MOD_RES (614)..(619): Any amino acid
SKSRGYKMNTQILXXXXXXXXXXGCDHSDNADKICLGHHAVXNGTKVNTLTERGIEVVNATETVETXXXXXXXXXXXXXXXXXXXXXXXXXXXGPPQCDQFLEFXXXXXXXXXXXXXXDVCYPGKFXXXXXXXXXXXXXXXXXXXXXXXXXXXXXXXXXXXXXXXXXXXGSSFYAEMXXXXXXXXXXXXXXXXXXXXXXXXXXXALIIWGVHHXXXXXXXXXXXXXXXXXXXXXXXXXXXXXXXXXXXXXXVNGQSGRIDFHWLXXXXXXXXTFTFNGAFIAPDRASFXXXXXXXXXXXXXXXXXXXXXXXXXXXXXXXXLPFQNINSXXVGKCPRYVKQXSLLLATGMRNVPEXXTHKQLTHHMRKKRGLFGXXRMTRGLFGAIGLFGAIAGLFGAIAGFIENGWEGLIDGWYGFRHQNAQGEGTAADYKSTQSAIDQITGKLNRLIEKTNQQFELIXXXXXEIEQQIGNVINWTRDSXTEVWSYNAELLVAMENQHTIDLADSEMNKLYERVRKQLRENAEEDGTGCFEIFHKCDDXCMESIRNNTYDHXXYRTESLQNRXXXXXVKLSSGYKDIILWFSFGASCFLLLAXXXXXXFICIKNGNMQCTICIXXXXXX

SEQ ID NO: 418591 - protein, 619 aa, Influenza virus
  MOD_RES (14)..(30): Any amino acid
  MOD_RES (39)..(42): Any amino acid
  MOD_RES (67)..(93): Any amino acid
  MOD_RES (105)..(118): Any amino acid
  MOD_RES (127)..(169): Any amino acid
  MOD_RES (178)..(204): Any amino acid
  MOD_RES (214)..(251): Any amino acid
  MOD_RES (265)..(272): Any amino acid
  MOD_RES (289)..(320): Any amino acid
  MOD_RES (329)..(330): Any amino acid
  MOD_RES (341)..(341): Any amino acid
  MOD_RES (355)..(356): Any amino acid
  MOD_RES (365)..(375): Any amino acid
  MOD_RES (393)..(402): Any amino acid
  MOD_RES (429)..(429): Any amino acid
  MOD_RES (459)..(463): Any amino acid
  MOD_RES (480)..(480): Any amino acid
  MOD_RES (539)..(539): Any amino acid
  MOD_RES (552)..(553): Any amino acid
  MOD_RES (563)..(567): Any amino acid
  MOD_RES (580)..(581): Any amino acid
  MOD_RES (593)..(598): Any amino acid
  MOD_RES (614)..(619): Any amino acid
MKSRGYKMNNQILXXXXXXXXXXXXXXXXXGDKICLGHXXXXNGTKVDTLTERGVEVVNATETVERXXXXXXXXXXXXXXXXXXXXXXXXXXXGPPQCDLFLEFXXXXXXXXXXXXXXDVCYPGRFXXXXXXXXXXXXXXXXXXXXXXXXXXXXXXXXXXXXXXXXXXXRSSFYAEMXXXXXXXXXXXXXXXXXXXXXXXXXXXALIIWGIHHXXXXXXXXXXXXXXXXXXXXXXXXXXXXXXXXXXXXXXINGQSGRINFHWLXXXXXXXXTFSFNGAFIAPNRASFXXXXXXXXXXXXXXXXXXXXXXXXXXXXXXXXLPFQNINPXXVGRCPRYVKQXSLMLATGMKNVPEXXAHKQLTHHXXXXXXXXXXXRETRGLFGARGLFGAIAXXXXXXXXXXENGWEGLVDGWYGFRHQNSQGEGTAAXYKSTQSAVDQITGKLNRIIGKTNQQFEMIXXXXXEVEKQIGNVINWTQDAXTEIWSYNAEFLVAVENQHTIDLTDSEMSKLYERVKKQLRENAEEDGNGCFEIFHQCDNXCMASIRNNTYNHXXYREEAMQNRXXXXXVKLSGGYKDIILXXSFGASCFILLAXXXXXXFICVKNGNMRCTICIXXXXXX

SEQ ID NO: 418592 - protein, 619 aa, Influenza virus
  MOD_RES (1)..(2): Any amino acid
  MOD_RES (14)..(42): Any amino acid
  MOD_RES (67)..(93): Any amino acid
  MOD_RES (105)..(118): Any amino acid
  MOD_RES (127)..(169): Any amino acid
  MOD_RES (178)..(204): Any amino acid
  MOD_RES (214)..(251): Any amino acid
  MOD_RES (265)..(272): Any amino acid
  MOD_RES (289)..(320): Any amino acid
  MOD_RES (329)..(330): Any amino acid
  MOD_RES (341)..(342): Any amino acid
  MOD_RES (352)..(356): Any amino acid
  MOD_RES (365)..(375): Any amino acid
  MOD_RES (385)..(403): Any amino acid
  MOD_RES (459)..(463): Any amino acid
  MOD_RES (480)..(480): Any amino acid
  MOD_RES (500)..(503): Any amino acid
  MOD_RES (524)..(530): Any amino acid
  MOD_RES (539)..(539): Any amino acid
  MOD_RES (552)..(553): Any amino acid
  MOD_RES (563)..(567): Any amino acid
  MOD_RES (593)..(598): Any amino acid
XXSRGYKMNIQILXXXXXXXXXXXXXXXXXXXXXXXXXXXXXNGTRVNTLTEKGIEVVNATETVEQXXXXXXXXXXXXXXXXXXXXXXXXXXXGPPQCDRFLEFXXXXXXXXXXXXXXDICYPGKFXXXXXXXXXXXXXXXXXXXXXXXXXXXXXXXXXXXXXXXXXXXESSFYAEMXXXXXXXXXXXXXXXXXXXXXXXXXXXALIVWGIHHXXXXXXXXXXXXXXXXXXXXXXXXXXXXXXXXXXXXXXMNGQSGRIDFYWLXXXXXXXXTFNFNGAFIAPDRVSFXXXXXXXXXXXXXXXXXXXXXXXXXXXXXXXXLPFQNVNSXXIGKCPRYVRQXXLLLATGMKNXXXXXIHKQLTHHXXXXXXXXXXXRKTRGLFGAXXXXXXXXXXXXXXXXXXXNGWEGLINGWYGFRHQNAQGEGIAADYKSTQSAINQITGKLNHLIDKTNQQFKLIXXXXXEVEQQIGNVINWTRDAXIEVWSYNAELLIAMENQHTXXXXDSEMDKLYERVKRQLRENAEXXXXXXXEIFHKCDNXCMASIRNSTYDHXXYRAESLQNRXXXXXIKLSSGYKEVILWFSFGASCLILLAXXXXXXFMCVKNGNMQCSALFVYSLRK

SEQ ID NO: 418593 - protein, 619 aa, Influenza virus
  MOD_RES (1)..(3): Any amino acid
  MOD_RES (14)..(42): Any amino acid
  MOD_RES (67)..(93): Any amino acid
  MOD_RES (105)..(118): Any amino acid
  MOD_RES (127)..(169): Any amino acid
  MOD_RES (178)..(204): Any amino acid
  MOD_RES (214)..(251): Any amino acid
  MOD_RES (264)..(272): Any amino acid
  MOD_RES (289)..(320): Any amino acid
  MOD_RES (329)..(330): Any amino acid
  MOD_RES (341)..(344): Any amino acid
  MOD_RES (355)..(375): Any amino acid
  MOD_RES (392)..(408): Any amino acid
  MOD_RES (424)..(432): Any amino acid
  MOD_RES (459)..(463): Any amino acid
  MOD_RES (472)..(480): Any amino acid
  MOD_RES (502)..(503): Any amino acid
  MOD_RES (523)..(553): Any amino acid
  MOD_RES (563)..(567): Any amino acid
  MOD_RES (593)..(598): Any amino acid
  MOD_RES (611)..(619): Any amino acid
XXXRGYKMNTRILXXXXXXXXXXXXXXXXXXXXXXXXXXXXXNGTKINTLTGRGIEVVDATETVERXXXXXXXXXXXXXXXXXXXXXXXXXXXGPPQCDKFLEFXXXXXXXXXXXXXXDICYPGRFXXXXXXXXXXXXXXXXXXXXXXXXXXXXXXXXXXXXXXXXXXXGPSFYAEMXXXXXXXXXXXXXXXXXXXXXXXXXXXALIVWGVHHXXXXXXXXXXXXXXXXXXXXXXXXXXXXXXXXXXXXXXVNGQFGRINFHWXXXXXXXXXNFSFNGAFVAPDRVSFXXXXXXXXXXXXXXXXXXXXXXXXXXXXXXXXLPFQSINSXXVGKCPKYVKQXXXXLATGMRNIPEXXXXXXXXXXXXXXXXXXXXXQMTRGLFGRRGLFGAIXXXXXXXXXXXXXXXXXLIDGWYGYRHQNAQGXXXXXXXXXTQSAIDQVTGKLNRLISKTNQQFGLIXXXXXEIEKQIGNXXXXXXXXXTELWSYNAELLVALENQHTIDXXDSEMNSCFERVRRQLRENAXXXXXXXXXXXXXXXXXXXXXXXXXXXXXXXYRKEAIQNRXXXXXVKLSNGYKDVILWFSFGASCFLFLAXXXXXXFICVRNGNMRCTXXXXXXXXX

SEQ ID NO: 418594 - protein, 619 aa, Influenza virus
  MOD_RES (1)..(3): Any amino acid
  MOD_RES (14)..(48): Any amino acid
  MOD_RES (63)..(118): Any amino acid
  MOD_RES (127)..(169): Any amino acid
  MOD_RES (178)..(204): Any amino acid
  MOD_RES (214)..(252): Any amino acid
  MOD_RES (265)..(272): Any amino acid
  MOD_RES (289)..(320): Any amino acid
  MOD_RES (329)..(330): Any amino acid
  MOD_RES (339)..(377): Any amino acid
  MOD_RES (386)..(409): Any amino acid
  MOD_RES (425)..(447): Any amino acid
  MOD_RES (458)..(463): Any amino acid
  MOD_RES (475)..(480): Any amino acid
  MOD_RES (497)..(497): Any amino acid
  MOD_RES (525)..(553): Any amino acid
  MOD_RES (563)..(568): Any amino acid
  MOD_RES (579)..(583): Any amino acid
  MOD_RES (593)..(600): Any amino acid
  MOD_RES (609)..(619): Any amino acid
XXXRGYKMNTKILXXXXXXXXXXXXXXXXXXXXXXXXXXXXXXXXXXXTHTERGVEVVDATEXXXXXXXXXXXXXXXXXXXXXXXXXXXXXXXXXXXXXXXXXXXXXXXXXXXXXXXXDVCYPGKIXXXXXXXXXXXXXXXXXXXXXXXXXXXXXXXXXXXXXXXXXXXDSSFYAEMXXXXXXXXXXXXXXXXXXXXXXXXXXXALITWGIHHXXXXXXXXXXXXXXXXXXXXXXXXXXXXXXXXXXXXXXXDGQSGRIDFHWMXXXXXXXXIFSFNGAFIAPDRATFXXXXXXXXXXXXXXXXXXXXXXXXXXXXXXXXLPFQNISPXXLGKCPRYVXXXXXXXXXXXXXXXXXXXXXXXXXXXXXXXXXXXXXXXPRGLFGAIXXXXXXXXXXXXXXXXXXXXXXXXIDGWYGFKHQNAQGEXXXXXXXXXXXXXXXXXXXXXXXIERTNQQFELXXXXXXEVERQIGNVINXXXXXXTEMWSYNAELLVAIENXHIIDLADSEMKKLYERVRRLLRENAEEXXXXXXXXXXXXXXXXXXXXXXXXXXXXXYREEAIQNRXXXXXXKLNSGYKDIIXXXXXGASCFLLIAXXXXXXXXCIKNGNMRXXXXXXXXXXX

SEQ ID NO: 418595 - protein, 619 aa, Influenza virus
  MOD_RES (1)..(58): Any amino acid
  MOD_RES (67)..(170): Any amino acid
  MOD_RES (185)..(254): Any amino acid
  MOD_RES (264)..(377): Any amino acid
  MOD_RES (386)..(413): Any amino acid
  MOD_RES (423)..(465): Any amino acid
  MOD_RES (477)..(505): Any amino acid
  MOD_RES (517)..(570): Any amino acid
  MOD_RES (580)..(619): Any amino acid
XXXXXXXXXXXXXXXXXXXXXXXXXXXXXXXXXXXXXXXXXXXXXXXXXXXXXXXXXXNATETVENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSSFYAEMKWLLSNXXXXXXXXXXXXXXXXXXXXXXXXXXXXXXXXXXXXXXXXXXXXXXXXXXXXXXXXXXXXXXXXXXXXXXQTGRIDFHWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRGLFGAIXXXXXXXXXXXXXXXXXXXXXXXXXXXXYGYKHQNAQXXXXXXXXXXXXXXXXXXXXXXXXXXXXXXXXXXXXXXXXXXXEKQLGNVINWTXXXXXXXXXXXXXXXXXXXXXXXXXXXXXEMNKLYEKVRRXXXXXXXXXXXXXXXXXXXXXXXXXXXXXXXXXXXXXXXXXXXXXXXXXXXXXXSSGYKDVILXXXXXXXXXXXXXXXXXXXXXXXXXXXXXXXXXXXXXXXX

SEQ ID NO: 418596 - protein, 619 aa, Influenza virus
  MOD_RES (1)..(171): Any amino acid
  MOD_RES (185)..(378): Any amino acid
  MOD_RES (391)..(513): Any amino acid
  MOD_RES (523)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPSFYAEMKWLLSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKPRPRRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKRLLRENAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418597 - protein, 619 aa, Influenza virus
  MOD_RES (1)..(171): Any amino acid
  MOD_RES (185)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSFYAEMEWLLSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418598 - protein, 573 aa, Influenza virus
  MOD_RES (15)..(21): Any amino acid
  MOD_RES (62)..(74): Any amino acid
  MOD_RES (137)..(138): Any amino acid
  MOD_RES (153)..(155): Any amino acid
  MOD_RES (175)..(191): Any amino acid
  MOD_RES (202)..(204): Any amino acid
  MOD_RES (219)..(221): Any amino acid
  MOD_RES (230)..(232): Any amino acid
  MOD_RES (254)..(255): Any amino acid
  MOD_RES (280)..(296): Any amino acid
  MOD_RES (568)..(573): Any amino acid
SKSRGYKMNTQILIXXXXXXXGAKGDKICLGHHAVANGTKVNTLTERGIEVVNATETVETAXXXXXXXXXXXXXDLGQCGLLGTLIGPPQCDQFLEFSSDLIIERREGTDVCYPGKFTNEESLRQILRRSGGIGKEXXGFTYSGIRTNGATSXXXRSGSSFYAEMKWLLSNSDNXXXXXXXXXXXXXXXXXALIIWGVHHSXXXSEQTKLYGSGNKLIXXXSSKYQQSFXXXPGARRIDFHWLGRIDFHWLLLXXNDTVTFTFNGAFIAPDRASFFRGEXXXXXXXXXXXXXXXXXCFHSGGTIVSSLPFQNINSRTVGKCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFLLLAIAMGLVFICIKNGNMQCTICIXXXXXX

SEQ ID NO: 418599 - protein, 573 aa, Influenza virus
  MOD_RES (1)..(21): Any amino acid
  MOD_RES (62)..(74): Any amino acid
  MOD_RES (137)..(138): Any amino acid
  MOD_RES (153)..(155): Any amino acid
  MOD_RES (175)..(191): Any amino acid
  MOD_RES (202)..(204): Any amino acid
  MOD_RES (219)..(221): Any amino acid
  MOD_RES (230)..(232): Any amino acid
  MOD_RES (254)..(255): Any amino acid
  MOD_RES (280)..(296): Any amino acid
  MOD_RES (353)..(356): Any amino acid
  MOD_RES (383)..(395): Any amino acid
  MOD_RES (477)..(484): Any amino acid
  MOD_RES (568)..(573): Any amino acid
XXXXXXXXXXXXXXXXXXXXXGVKGDKICLGHHAVSNGTKVNTLTEKGIEVVNATETVERTXXXXXXXXXXXXXDLGRCGLLGTLTGPPQCDQFLEFYADLIIERREGNDVCYPGRFTNEEPLRQILRGSGGIDKEXXGFTYNGIRTNGAASXXXRLGSSFYAEMKWLLSSSDNXXXXXXXXXXXXXXXXXALIIWGIHHSXXXTEQTKLYGNGNKLVXXXSSKYRQSFXXXPGARPQVNGQSGRIDFHWLMLXXNDTVTFSFNGAFIAPNRASFFRGAXXXXXXXXXXXXXXXXXCFHNGGTIISNLPFQNINPRTVGRCPRYVKQTSLLLATGMKNVPEIPKKRGLFGAIXXXXENGWEGLVDGWYGFRHQNTQGEGTAAXXXXXXXXXXXXXGKLNRLIDKTNQQFELINNEFNEVEQQIGNVINWTQDAMTEVWSYNAELLVALENQHTIDLTDSEMSKLYERVRKQLRENAXXXXXXXXEIFHKCDNQCMESIRNNTYNHTQYRTGSMQNRIQIDSVKLSSGYKDVILWFSFGASCFILLAIAIGLVFMCVKNGNMRCTICIXXXXXX

SEQ ID NO: 418600 - protein, 573 aa, Influenza virus
  MOD_RES (1)..(21): Any amino acid
  MOD_RES (33)..(34): Any amino acid
  MOD_RES (62)..(76): Any amino acid
  MOD_RES (137)..(138): Any amino acid
  MOD_RES (153)..(155): Any amino acid
  MOD_RES (175)..(191): Any amino acid
  MOD_RES (202)..(204): Any amino acid
  MOD_RES (219)..(221): Any amino acid
  MOD_RES (230)..(232): Any amino acid
  MOD_RES (254)..(255): Any amino acid
  MOD_RES (280)..(296): Any amino acid
  MOD_RES (353)..(357): Any amino acid
  MOD_RES (372)..(395): Any amino acid
  MOD_RES (441)..(445): Any amino acid
  MOD_RES (478)..(485): Any amino acid
  MOD_RES (529)..(539): Any amino acid
  MOD_RES (562)..(562): Any amino acid
XXXXXXXXXXXXXXXXXXXXXPTNADKICLGHXXVSNGTKINTLTERGVEVVNATETVETTXXXXXXXXXXXXXXXGQCGLLGILIGPPQCDKFLEFSSDLIIERKEGTDICYPGRFVNEEALRQILRESGGIDKEXXGFTYSEIRTNGTTSXXXRSSSSFYAEMKWLLSNTDNXXXXXXXXXXXXXXXXXALIVWGIHHSXXXAEQTKLYGSGSKLIXXXSSNYQQSFXXXPGTRRIDFHWFGRIDFHWLILXXNDTVTFIFNGAFIAPDRASFLRGKXXXXXXXXXXXXXXXXXCYHSGGTIISSLPFQNISPRTVGKCPKYVKQESLLLATGMRNIPENPKTRGLFGAIXXXXXNGWEGLIDGWYGFRXXXXXXXXXXXXXXXXXXXXXXXXGKLNRLISKTNQQFEMIDNEFTEVEKQIGNVINWTRDSMTEVWSYXXXXXVAIENQHTIDLADSEMNKLYERVRRQLRENAEXXXXXXXXIFHKCDDHCMESIRNNTYDHSKYREEAMQNRIQIDQVKLSSGYXXXXXXXXXXXSCFLLLAVVMGLVFICVKNGNMXCSALFVYSLRK

SEQ ID NO: 418601 - protein, 573 aa, Influenza virus
  MOD_RES (1)..(21): Any amino acid
  MOD_RES (31)..(53): Any amino acid
  MOD_RES (62)..(77): Any amino acid
  MOD_RES (99)..(101): Any amino acid
  MOD_RES (137)..(138): Any amino acid
  MOD_RES (152)..(155): Any amino acid
  MOD_RES (175)..(191): Any amino acid
  MOD_RES (202)..(204): Any amino acid
  MOD_RES (219)..(221): Any amino acid
  MOD_RES (230)..(232): Any amino acid
  MOD_RES (244)..(244): Any amino acid
  MOD_RES (254)..(255): Any amino acid
  MOD_RES (264)..(269): Any amino acid
  MOD_RES (280)..(296): Any amino acid
  MOD_RES (333)..(334): Any amino acid
  MOD_RES (353)..(395): Any amino acid
  MOD_RES (425)..(426): Any amino acid
  MOD_RES (442)..(454): Any amino acid
  MOD_RES (470)..(485): Any amino acid
  MOD_RES (515)..(518): Any amino acid
  MOD_RES (534)..(540): Any amino acid
  MOD_RES (562)..(573): Any amino acid
XXXXXXXXXXXXXXXXXXXXXGTKGDKICLXXXXXXXXXXXXXXXXXXXXXXXATETVETVXXXXXXXXXXXXXXXXQCGLLGTITGPPQCDQFLEFDXXXIIERREGADVCYPGGFVNGEALRQILRKSGGIGKEXXGFIYSGIRTNGTTXXXXRLGPSFYAEMKWLLSSTDNXXXXXXXXXXXXXXXXXALIVWGVHHSXXXDEQTKLYGSGNKLVXXXSSKYQQAFXXXTGARRIDFNWLXRIDFNWLLLXXNDTITFSFXXXXXXPDRASFFKGEXXXXXXXXXXXXXXXXXCFHGGGTIASNLPFQNINPKTVGKCPRYIKQKSLLLXXGMRNVPENPKGRGLFGAIXXXXXXXXXXXXXXXXXXXXXXXXXXXXXXXXXXXXXXXXXXXGKLNRLIEKTNQQFELIDHEFSEIEQQIGXXINWTRDSITEVWSYNXXXXXXXXXXXXXDLADSEMKKLYERVRXXXXXXXXXXXXXXXXIFHKCDDDCMASIRNNTYDHTKYRTESLQXXXXIDPVKLSGGYKDIILXXXXXXXCFLLLAIVMGLVFICMKNGNMXXXXXXXXXXXX

SEQ ID NO: 418602 - protein, 573 aa, Influenza virus
  MOD_RES (1)..(21): Any amino acid
  MOD_RES (32)..(77): Any amino acid
  MOD_RES (99)..(101): Any amino acid
  MOD_RES (137)..(142): Any amino acid
  MOD_RES (153)..(193): Any amino acid
  MOD_RES (202)..(210): Any amino acid
  MOD_RES (219)..(221): Any amino acid
  MOD_RES (230)..(236): Any amino acid
  MOD_RES (254)..(256): Any amino acid
  MOD_RES (266)..(271): Any amino acid
  MOD_RES (280)..(296): Any amino acid
  MOD_RES (313)..(315): Any amino acid
  MOD_RES (339)..(399): Any amino acid
  MOD_RES (418)..(429): Any amino acid
  MOD_RES (439)..(454): Any amino acid
  MOD_RES (477)..(499): Any amino acid
  MOD_RES (518)..(540): Any amino acid
  MOD_RES (557)..(573): Any amino acid
XXXXXXXXXXXXXXXXXXXXXGARGDKICLGXXXXXXXXXXXXXXXXXXXXXXXXXXXXXXXXXXXXXXXXXXXXXXQCGLLGTVTGPPQCDQFLEFAXXXIIERREGSDVCYPGKFVNEESLRQVLRRSGGISKEXXXXXXSGIRTNGVTSXXXXXXXXXXXXXXXXXXXXXXXXXXXXXXXXXXXXXXXXXVIWGVHHSXXXXXXXXXYGNGNKLIXXXSSKYHQSFXXXXXXXPQVNGQFGRIDFHWLFLXXXDTVTFNFNGXXXXXXRASFFRGGXXXXXXXXXXXXXXXXXCFYSGGTIVSSLPFQSXXXRAVGKCPRYVKQESLMLATGMKNXXXXXXXXXXXXXXXXXXXXXXXXXXXXXXXXXXXXXXXXXXXXXXXXXXXXXXXXXXXXXHLIGKTNQQFGLIDNEFNXXXXXXXXXXXXTRDAMTEVWXXXXXXXXXXXXXXXXDLTDSEMNKLYERVKRQLRENAXXXXXXXXXXXXXXXXXXXXXXXNNTYDHSRYREEAMQNRLXXXXXXXXXXXXXXXXXXXXXXXCFILLAIVMGLVFMCVXXXXXXXXXXXXXXXXX

SEQ ID NO: 418603 - protein, 573 aa, Influenza virus
  MOD_RES (1)..(85): Any amino acid
  MOD_RES (96)..(111): Any amino acid
  MOD_RES (134)..(143): Any amino acid
  MOD_RES (153)..(308): Any amino acid
  MOD_RES (325)..(334): Any amino acid
  MOD_RES (345)..(402): Any amino acid
  MOD_RES (416)..(505): Any amino acid
  MOD_RES (515)..(544): Any amino acid
  MOD_RES (564)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXIGPPHCDQFLXXXXXXXXXXXXXXXXCYPGKFANEESLRQIIRRSGGIXXXXXXXXXXGIRTNGTASXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNINPIAVGKCPKYXXXXXXXXXXGMRNIPEKPKXXXXXXXXXXXXXXXXXXXXXXXXXXXXXXXXXXXXXXXXXXXXXXXXXXXXXXXXXXGRTNQQFELIDSEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTQYRAESLQXXXXXXXXXXXXXXXXXXXXXXXXXXXXXXIAIAMGLVFMCIKNGNMRCXXXXXXXXXX

SEQ ID NO: 418604 - protein, 573 aa, Influenza virus
  MOD_RES (1)..(112): Any amino acid
  MOD_RES (122)..(309): Any amino acid
  MOD_RES (324)..(406): Any amino acid
  MOD_RES (422)..(544): Any amino acid
  MOD_RES (553)..(554): Any amino acid
  MOD_RES (564)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYPGKFVNGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFQNINSRAVGKCPKXXXXXXXXXXXXXXXXXXXXXXXXXXXXXXXXXXXXXXXXXXXXXXXXXXXXXXXXXXXXXXXXXXXXXXXXXXXXXXXXXXXQRFELIDNEFTEIEQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAIAMGLGXXCIKNGNVRCXXXXXXXXXX

SEQ ID NO: 418605 - protein, 573 aa, Influenza virus
  MOD_RES (1)..(409): Any amino acid
  MOD_RES (422)..(545): Any amino acid
  MOD_RES (554)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXELIDNEFSEIEQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIAMGFVFXXXXXXXXXXXXXXXXXXXX

SEQ ID NO: 418606 - protein, 469 aa, Influenza virus
  MOD_RES (30)..(58): Any amino acid
  MOD_RES (72)..(83): Any amino acid
  MOD_RES (210)..(210): Any amino acid
  MOD_RES (308)..(308): Any amino acid
  MOD_RES (393)..(393): Any amino acid
  MOD_RES (469)..(469): Any amino acid
MNPNQKIITIGSVSLTIATVCFLMQIAILXXXXXXXXXXXXXXXXXXXXXXXXXXXXXERNITEIVYLNNTXXXXXXXXXXXXYRSWSKPQCQITGFAPFSKDNSIRLSAGGDIWITREPYVSCDTSKCYQFALGQGTTLDNKHSNGTIHDRIPHRTLLMNELGVPFHLGTKQVCIAWSSSSCHDGKAWLHVCVTGDDRNATASFIYNGXLVDSIGSWSQNILRTQESECVCINGSCTVVMTDGSASGKADTRILFVKEGKIVHISPLSGSAQHIEECSCYPRYPNVRCVCRDNWKGSNRPVIDINMXDYSIDSSYVCSGLVGDTPRNEDSSSSSNCRDPNEERGNPGVKGWAFDSGDDVWMGRTISRDSRSGYETFRVIGGWTTANSKSQTXRQVIVDNNNWSGYSGIFSVEHKSCINRCFYVELIRGRPKETRVWWTSNSIVVFCGTSGTYGTGSWPDGANINFMPX

SEQ ID NO: 418607 - protein, 469 aa, Influenza virus
  MOD_RES (1)..(5): Any amino acid
  MOD_RES (30)..(58): Any amino acid
  MOD_RES (72)..(83): Any amino acid
  MOD_RES (162)..(164): Any amino acid
  MOD_RES (180)..(184): Any amino acid
  MOD_RES (209)..(210): Any amino acid
  MOD_RES (224)..(228): Any amino acid
  MOD_RES (271)..(275): Any amino acid
  MOD_RES (291)..(294): Any amino acid
  MOD_RES (308)..(308): Any amino acid
  MOD_RES (393)..(393): Any amino acid
  MOD_RES (410)..(414): Any amino acid
  MOD_RES (452)..(457): Any amino acid
  MOD_RES (469)..(469): Any amino acid
XXXXXKIITIGSISLTIAAVCFLMQIAVLXXXXXXXXXXXXXXXXXXXXXXXXXXXXXEKNITEIVYLNSTXXXXXXXXXXXXYRNWSKPQCQISGFAPFAKDNSIRLSAGGHIWVTREPYVSCSLNKCYQFALGQGTTLYNKHSNGTTHDRISHRTLLMNXXXVPFHLGTRQVCIAWSXXXXXDGKAWLHICVTGDDRNATASLIYDXXLVDSIVSWSQNILXXXXXECVCINGTCTVVMTDGNASGKADTRILFIKEGKIIHISPLSGXXXXXEECSCYPQYPNVRCVXXXXWKGSNRPIIDINMXDYNIDSSYLCSGLVGDTPRNDDSSSSSNCKDPNNERGNPGVKGWAFDNGDDVWMGRTISKDSRSGYETFKVIGGWTIANSKSQTXRQVIVDNSNWSGYSGVXXXXXKSCVNRCFYVELIRGMPQETRVWWTSSSIIVFCGTSGXXXXXXWPDGANISFMPX

SEQ ID NO: 418608 - protein, 469 aa, Influenza virus
  MOD_RES (1)..(8): Any amino acid
  MOD_RES (30)..(58): Any amino acid
  MOD_RES (72)..(83): Any amino acid
  MOD_RES (161)..(169): Any amino acid
  MOD_RES (184)..(186): Any amino acid
  MOD_RES (210)..(210): Any amino acid
  MOD_RES (220)..(230): Any amino acid
  MOD_RES (271)..(278): Any amino acid
  MOD_RES (294)..(295): Any amino acid
  MOD_RES (306)..(308): Any amino acid
  MOD_RES (321)..(323): Any amino acid
  MOD_RES (393)..(393): Any amino acid
  MOD_RES (424)..(424): Any amino acid
  MOD_RES (453)..(457): Any amino acid
  MOD_RES (469)..(469): Any amino acid
XXXXXXXXTIGSVSLIIATVCFFMQIAILXXXXXXXXXXXXXXXXXXXXXXXXXXXXXKRNITEIVYLNHTXXXXXXXXXXXXYRDWSKPQCQIIGFAPFSKDNSVRLSAGGDIWVTREPYVSCGPGKCYQFALGQGTTLENKHSNGTIHDRTPHRTLLMXXXXXXXXXGTKQVCMAWSSSSCXXXKAWLHVCITGDDRNATASFIYDGXLIDSIGSWSXXXXXXXXXXXVCINGSCAVVMTDGSASGRADTRIIFVKEGKIAHISPLSGXXXXXXXXSCYPRYPDVRCVCRDXXKGSNRPVVDIXXXDYSINSSYVCSGXXXDTPRNEDGSSSSNCRDPNNEKGNPGVKGWAFDYGNDVWMGRTISMDSRSGYETFRVISGWTTANSKSKTXRQIIVDNNNWFGYFGIFFVEHKRCINRCFYXELIRGRPQETTVWWTSNSIIVFCGTSATXXXXXWPDGANIDFVPX

SEQ ID NO: 418609 - protein, 469 aa, Influenza virus
  MOD_RES (1)..(10): Any amino acid
  MOD_RES (30)..(58): Any amino acid
  MOD_RES (72)..(83): Any amino acid
  MOD_RES (100)..(104): Any amino acid
  MOD_RES (161)..(191): Any amino acid
  MOD_RES (210)..(230): Any amino acid
  MOD_RES (271)..(297): Any amino acid
  MOD_RES (308)..(308): Any amino acid
  MOD_RES (321)..(326): Any amino acid
  MOD_RES (364)..(373): Any amino acid
  MOD_RES (393)..(394): Any amino acid
  MOD_RES (407)..(407): Any amino acid
  MOD_RES (416)..(426): Any amino acid
  MOD_RES (442)..(458): Any amino acid
  MOD_RES (469)..(469): Any amino acid
XXXXXXXXXXGSVSLTITTICFLMQIATLXXXXXXXXXXXXXXXXXXXXXXXXXXXXXERNVTETLYLNHTXXXXXXXXXXXXYRIWSKPQCQIAGFAPXXXXXSVRLSASGDIWITREPYVSCSPDKCYQFALGQGTTLNNKHSNGTTHDRTSHRTLLMXXXXXXXXXXXXXXXXXXXXXXXXXXXXXXXVCVTGDDKNATASFIYGGXXXXXXXXXXXXXXXXXXXXXVCINGTCAVVMTDGSASRKADTRILFIREGKISHISPLSGXXXXXXXXXXXXXXXXXXXXXXXXXXXSNRPVIDVNMXDYSIDSGYVCSGXXXXXXRNEDSSSNSNCKDPNEERGSPGVKGWAFDNGNDVWMGXXXXXXXXXXYETFRVIDGWTTANSKSQVXXQVIVDNNSWSGYXGIFSVENKXXXXXXXXXXXIRGRPQENRVWWTSNXXXXXXXXXXXXXXXXXPDGANINLMPX

SEQ ID NO: 418610 - protein, 469 aa, Influenza virus
  MOD_RES (1)..(11): Any amino acid
  MOD_RES (30)..(58): Any amino acid
  MOD_RES (72)..(87): Any amino acid
  MOD_RES (96)..(105): Any amino acid
  MOD_RES (151)..(191): Any amino acid
  MOD_RES (200)..(201): Any amino acid
  MOD_RES (210)..(230): Any amino acid
  MOD_RES (241)..(243): Any amino acid
  MOD_RES (270)..(308): Any amino acid
  MOD_RES (320)..(326): Any amino acid
  MOD_RES (350)..(350): Any amino acid
  MOD_RES (364)..(376): Any amino acid
  MOD_RES (393)..(395): Any amino acid
  MOD_RES (404)..(407): Any amino acid
  MOD_RES (416)..(426): Any amino acid
  MOD_RES (435)..(460): Any amino acid
  MOD_RES (469)..(469): Any amino acid
XXXXXXXXXXXSVSLTIAIVCFLMQITILXXXXXXXXXXXXXXXXXXXXXXXXXXXXXEKNITKIVYLNSTXXXXXXXXXXXXXXXXSKPQCRITXXXXXXXXXXIRLSAGGNIWITREPYVSCDNNRCYQFALGQGTTLDNEHSNGTIHXXXXXXXXXXXXXXXXXXXXXXXXXXXXXXXXXXXXXXXXXVCVTGDDGXXTASFIYNEXXXXXXXXXXXXXXXXXXXXXVCINGSCIVVXXXGSASGKAETRILFVKEGKVVHISPLSXXXXXXXXXXXXXXXXXXXXXXXXXXXXXXXXXXXXXXXDYSIGSSYVCSXXXXXXXRNDDSSSNSNCRDPNDERGNPGVXGWAFDYGSDVWMGXXXXXXXXXXXXXFRVIGGWATANSKSQIXXXVIVENNNWXXXXGIFSVEGKXXXXXXXXXXXVRGRPQETXXXXXXXXXXXXXXXXXXXXXXXXXXGANIKFMPX

SEQ ID NO: 418611 - protein, 469 aa, Influenza virus
  MOD_RES (1)..(19): Any amino acid
  MOD_RES (28)..(88): Any amino acid
  MOD_RES (100)..(141): Any amino acid
  MOD_RES (151)..(249): Any amino acid
  MOD_RES (262)..(313): Any amino acid
  MOD_RES (322)..(356): Any amino acid
  MOD_RES (365)..(396): Any amino acid
  MOD_RES (405)..(407): Any amino acid
  MOD_RES (416)..(430): Any amino acid
  MOD_RES (442)..(469): Any amino acid
XXXXXXXXXXXXXXXXXXXACFLMQIAXXXXXXXXXXXXXXXXXXXXXXXXXXXXXXXXXXXXXXXXXXXXXXXXXXXXXXXXXXXXXKQQCQITGLAPXXXXXXXXXXXXXXXXXXXXXXXXXXXXXXXXXXXXXXXXXXNEHSNGTTHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXADTKYLFIKEGKXXXXXXXXXXXXXXXXXXXXXXXXXXXXXXXXXXXXXXXXXXXXXXXXXXXXSSYMCSGLXXXXXXXXXXXXXXXXXXXXXXXXXXXXXXXXXXXEDDVWMGRXXXXXXXXXXXXXXXXXXXXXXXXXXXXXXXXIVNNNNWSXXXGIFSVESKXXXXXXXXXXXXXXXPQEDRVWWTSNXXXXXXXXXXXXXXXXXXXXXXXXXXXX

SEQ ID NO: 418612 - protein, 469 aa, Influenza virus
  MOD_RES (1)..(88): Any amino acid
  MOD_RES (99)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCQIKGFAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418613 - protein, 597 aa, Influenza virus
  MOD_RES (15)..(24): Any amino acid
  MOD_RES (61)..(74): Any amino acid
  MOD_RES (99)..(99): Any amino acid
  MOD_RES (117)..(123): Any amino acid
  MOD_RES (137)..(137): Any amino acid
  MOD_RES (151)..(163): Any amino acid
  MOD_RES (182)..(183): Any amino acid
  MOD_RES (192)..(197): Any amino acid
  MOD_RES (211)..(212): Any amino acid
  MOD_RES (244)..(244): Any amino acid
  MOD_RES (284)..(303): Any amino acid
  MOD_RES (335)..(335): Any amino acid
  MOD_RES (352)..(352): Any amino acid
  MOD_RES (578)..(582): Any amino acid
SKSRGYKMNTQILVXXXXXXXXXXGDKICLGHHAVANGTKVNTLTERGIEVVNATETVETXXXXXXXXXXXXXXTDLGQCGLLGTLIGPPQCDQFLEFXADLIIERREGTDVCYPGXXXXXXXESLRQILRGSGGIXKESMGFTYSGIRTXXXXXXXXXXXXXGSSFYAEMMKWLLSNSDNXXFPQMTKSYXXXXXXPALIIWGVHHSGSXXEQTKLYGSGNKLITVGSSKYQQSFTPSPGARXQVNGQSGRIDFHWLLLDPNDTVTFTFNGAFIAPDRASFFXXXXXXXXXXXXXXXXXXXXCFHSGGTIVSSLPFQNINPRTVGKCPRYVKQXSLLLATGMRNVPENPKXCSPLSRCRETRGLFGAIGLFGAIAGLFGAIAGFIENGWEGLIDGWYGFRHQNAQGEGTAADYKSTQSAIDQITGKLNRLIDKTNQQFELIDNEFTEVEKQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIXXXXXFICIKNGNMRCTICI

SEQ ID NO: 418614 - protein, 597 aa, Influenza virus
  MOD_RES (1)..(2): Any amino acid
  MOD_RES (15)..(24): Any amino acid
  MOD_RES (61)..(74): Any amino acid
  MOD_RES (95)..(99): Any amino acid
  MOD_RES (108)..(108): Any amino acid
  MOD_RES (117)..(123): Any amino acid
  MOD_RES (137)..(137): Any amino acid
  MOD_RES (151)..(163): Any amino acid
  MOD_RES (182)..(183): Any amino acid
  MOD_RES (192)..(197): Any amino acid
  MOD_RES (211)..(212): Any amino acid
  MOD_RES (244)..(244): Any amino acid
  MOD_RES (284)..(303): Any amino acid
  MOD_RES (335)..(335): Any amino acid
  MOD_RES (352)..(352): Any amino acid
  MOD_RES (370)..(386): Any amino acid
  MOD_RES (402)..(402): Any amino acid
  MOD_RES (479)..(484): Any amino acid
  MOD_RES (508)..(514): Any amino acid
  MOD_RES (578)..(582): Any amino acid
  MOD_RES (594)..(597): Any amino acid
XXSRGYKMNNQILIXXXXXXXXXXADKICLGHHAVSNGTKVDTLTEKGIEVVNATETVERXXXXXXXXXXXXXXVDLGQCGLLGIITGPPQCDQXXXXXSDLIIERRXGNDVCYPGXXXXXXXEALRQILRESGGIXKETMGFTYSGIMTXXXXXXXXXXXXXESSFYAEMMKWLLSNTDNXXFPQTTKSYXXXXXXPALIIWGIHHSGSXXEQTRLYGSGNKLVTVGSSNYQQSFVPSPGARXQVNGQFGRINFHWLMLNPNDTVTFSFNGAFIAPDRVSFLXXXXXXXXXXXXXXXXXXXXCYHSGGTIISNLPFQNINSRAIGKCPRYVRQXSLMLATGMKNVPEIPKXKRKRGLFGAARGLFGAIXXXXXXXXXXXXXXXXXENGWEGLVDGWYGFRXQNAQGEGIAADYKSTPSAIDQITGKLNRIIEKTNQQFEMIDNEFNEIEQQIGNVINWTRDAMTEIWSYNAELLIAMXXXXXXDLADSEMDKLYERVRRQLRENAEXXXXXXXEIFHKCDNDCMASIRNNTYDHSKYREEAMQNRIQINPVKLSSGYKEVILWFSFGASCFILLAIXXXXXFICVKNGNMRCXXXX

SEQ ID NO: 418615 - protein, 597 aa, Influenza virus
  MOD_RES (1)..(3): Any amino acid
  MOD_RES (15)..(28): Any amino acid
  MOD_RES (61)..(74): Any amino acid
  MOD_RES (99)..(99): Any amino acid
  MOD_RES (117)..(123): Any amino acid
  MOD_RES (137)..(137): Any amino acid
  MOD_RES (151)..(163): Any amino acid
  MOD_RES (182)..(183): Any amino acid
  MOD_RES (192)..(197): Any amino acid
  MOD_RES (211)..(212): Any amino acid
  MOD_RES (244)..(244): Any amino acid
  MOD_RES (284)..(303): Any amino acid
  MOD_RES (335)..(336): Any amino acid
  MOD_RES (352)..(353): Any amino acid
  MOD_RES (377)..(387): Any amino acid
  MOD_RES (403)..(413): Any amino acid
  MOD_RES (455)..(456): Any amino acid
  MOD_RES (472)..(484): Any amino acid
  MOD_RES (501)..(522): Any amino acid
  MOD_RES (564)..(566): Any amino acid
  MOD_RES (578)..(582): Any amino acid
  MOD_RES (592)..(597): Any amino acid
XXXRGYKMNTRILIXXXXXXXXXXXXXXCLGHHAVPNGTKVDTLTGRGIEVVNATETVEQXXXXXXXXXXXXXXIDLGQCGLLGTITGPPQCDLFLEFXSDLIVERQEGSDVCYPGXXXXXXXEALRQVLRESGGIXKETIGFTYSGMRTXXXXXXXXXXXXXGPSFYAEMMKWLLSNNDNXXFPQMTQSYXXXXXXPALIVWGIHHSVSXXEQAKLYGSGAKLITVESSNYHQSFVPSPGVRXQVNGQTGRIDFHWMMLNPNDTITFSFNGAFVAPDRVSFFXXXXXXXXXXXXXXXXXXXXCYHNGGTITSPLPFQNINSRTVGRCPRYVKQXXLLLATGMKNVPETPKXXSPLSRCRKTRGLFGARGLFGAIAXXXXXXXXXXXNGWEGLINGWYGFRHXXXXXXXXXXXYKSTQSAVDQITGKLNRLIEKTNQQFKLIDNEFSEIEQQIGXXINWTRDSITEVWSYNXXXXXXXXXXXXXDQADSEMNNLYERVRKXXXXXXXXXXXXXXXXXXXXXXNCMASIRNSTYDHSRYREEAMQNRMQINPVKLSGGYKDIILXXXFGASCFLFLAIXXXXXFMCVKNGNMXXXXXX

SEQ ID NO: 418616 - protein, 597 aa, Influenza virus
  MOD_RES (1)..(6): Any amino acid
  MOD_RES (15)..(28): Any amino acid
  MOD_RES (61)..(74): Any amino acid
  MOD_RES (99)..(99): Any amino acid
  MOD_RES (117)..(123): Any amino acid
  MOD_RES (137)..(137): Any amino acid
  MOD_RES (151)..(163): Any amino acid
  MOD_RES (182)..(183): Any amino acid
  MOD_RES (192)..(197): Any amino acid
  MOD_RES (209)..(213): Any amino acid
  MOD_RES (231)..(234): Any amino acid
  MOD_RES (244)..(244): Any amino acid
  MOD_RES (284)..(303): Any amino acid
  MOD_RES (333)..(341): Any amino acid
  MOD_RES (352)..(353): Any amino acid
  MOD_RES (370)..(393): Any amino acid
  MOD_RES (409)..(414): Any amino acid
  MOD_RES (439)..(440): Any amino acid
  MOD_RES (454)..(456): Any amino acid
  MOD_RES (475)..(485): Any amino acid
  MOD_RES (501)..(522): Any amino acid
  MOD_RES (578)..(584): Any amino acid
  MOD_RES (596)..(597): Any amino acid
XXXXXXKMNTQILIXXXXXXXXXXXXXXCLGHHAVTNGTKVNTLTEKGIEVVDATETVERXXXXXXXXXXXXXXTDLGQCGILGILTGPPQCDRFLEFXANLIIERREGKDVCYPGXXXXXXXEPLRQILRRSGGIXKEAMGFTYSEIRTXXXXXXXXXXXXXDSSFYAEMMKWLLSNADNXXFPQMTRSYXXXXXXPALIVWGVHHSXXXXXQTKLYGNGAKLITVESPXXXXSFTPSPGTRXPVNGQSGRINFHWLILNPNDTVIFSFNGAFIAPDRATFLXXXXXXXXXXXXXXXXXXXXCFHNGGTITSNLPFQNVNSRAVGKCPKYVXXXXXXXXXGMRNVPEKPKXXRRRGLFGAPRGLFGAIXXXXXXXXXXXXXXXXXXXXXXXXIDGWYGFKHQNAQGEXXXXXXKSTQSAINQITGKLNRFIEKTNQQXXLIDNEFNEVEKQIXXXINWTRDSVTELWSYNAELXXXXXXXXXXXLANSEMNKLHERVRKXXXXXXXXXXXXXXXXXXXXXXQCMASIRNNTYDHNKYRAESLQNRIRIDPVKLSGGYKDVILWFSFGASCFLLIAIXXXXXXXCVKNGNHAVHYXX

SEQ ID NO: 418617 - protein, 597 aa, Influenza virus
  MOD_RES (1)..(32): Any amino acid
  MOD_RES (61)..(74): Any amino acid
  MOD_RES (94)..(99): Any amino acid
  MOD_RES (108)..(108): Any amino acid
  MOD_RES (117)..(128): Any amino acid
  MOD_RES (137)..(137): Any amino acid
  MOD_RES (151)..(163): Any amino acid
  MOD_RES (182)..(202): Any amino acid
  MOD_RES (211)..(215): Any amino acid
  MOD_RES (228)..(228): Any amino acid
  MOD_RES (244)..(244): Any amino acid
  MOD_RES (273)..(275): Any amino acid
  MOD_RES (284)..(303): Any amino acid
  MOD_RES (325)..(343): Any amino acid
  MOD_RES (352)..(353): Any amino acid
  MOD_RES (362)..(362): Any amino acid
  MOD_RES (376)..(426): Any amino acid
  MOD_RES (455)..(459): Any amino acid
  MOD_RES (471)..(485): Any amino acid
  MOD_RES (507)..(522): Any amino acid
  MOD_RES (531)..(531): Any amino acid
  MOD_RES (561)..(569): Any amino acid
  MOD_RES (578)..(597): Any amino acid
XXXXXXXXXXXXXXXXXXXXXXXXXXXXXXXXHAVANGTRVNTLTERGVEVVNATETVENXXXXXXXXXXXXXXTDMGQCGLLGTVTGPPQCDXXXXXXTDLIIERRXGNDICYPGXXXXXXXXXXXXILRGSGGVXKETTGFTYSGVRTXXXXXXXXXXXXXGSSSFYAEMKWLLSNSNNXXXXXXXXXXXXXXXXXXXXXWGIHHSASXXXXXKLYGSGSKLITVXSSKCQQSFVPSPGSRXKVDGQSGRIDFHWLMLNSNDTVTGSFNGXXXAPDRASFLXXXXXXXXXXXXXXXXXXXXYFHSGGTIASSLPFQNINSRVXXXXXXXXXXXXXXXXXXXKNVPEIPRXXKKRGLFGAXTKPRPRRGLFGAIXXXXXXXXXXXXXXXXXXXXXXXXXXXXXXXXXXXXXXXXXXXXXXXXXXXKLNRLIDRTNHQFELIDNEFIEVEKQIGXXXXXTRDSMTEIWSYXXXXXXXXXXXXXXXLADSEMSKLYERVKRQLRENAXXXXXXXXXXXXXXXXGCMASIRNXTYDHSTYREEAMQNRVKIDPVKLSNGYKDXXXXXXXXXSCFVLLAIXXXXXXXXXXXXXXXXXXXX

SEQ ID NO: 418618 - protein, 597 aa, Influenza virus
  MOD_RES (1)..(40): Any amino acid
  MOD_RES (57)..(86): Any amino acid
  MOD_RES (95)..(100): Any amino acid
  MOD_RES (110)..(112): Any amino acid
  MOD_RES (123)..(165): Any amino acid
  MOD_RES (174)..(216): Any amino acid
  MOD_RES (227)..(228): Any amino acid
  MOD_RES (238)..(255): Any amino acid
  MOD_RES (275)..(355): Any amino acid
  MOD_RES (369)..(446): Any amino acid
  MOD_RES (459)..(460): Any amino acid
  MOD_RES (478)..(488): Any amino acid
  MOD_RES (503)..(536): Any amino acid
  MOD_RES (545)..(549): Any amino acid
  MOD_RES (564)..(597): Any amino acid
XXXXXXXXXXXXXXXXXXXXXXXXXXXXXXXXXXXXXXXXVNTLAERGVEVVDATEXXXXXXXXXXXXXXXXXXXXXXXXXXXXXXIGPPQCDLXXXXXXDLIVERQDGXXXDVCYPGKFTNXXXXXXXXXXXXXXXXXXXXXXXXXXXXXXXXXXXXXXXXXXXPSFYAEMKXXXXXXXXXXXXXXXXXXXXXXXXXXXXXXXXXXXXXXXXXXXLYGSENKLITXXSYNYHQSFVXXXXXXXXXXXXXXXXXXRWLLLDPNGTITFSSNGAFXXXXXXXXXXXXXXXXXXXXXXXXXXXXXXXXXXXXXXXXXXXXXXXXXXXXXXXXXXXXXXXXXXXXXXXXXXXXXXXXXAYRKRMTRGLFGAXXXXXXXXXXXXXXXXXXXXXXXXXXXXXXXXXXXXXXXXXXXXXXXXXXXXXXXXXXXXXXXXXXXXXXXXXXXXXXTEVERQIGNVINXXRDSMTEVMVVYAELLVAXXXXXXXXXXXSEMDKLYTRVKRQLXXXXXXXXXXXXXXXXXXXXXXXXXXXXXXXXXXQYRAESLQXXXXXNPVKQSSGYKDVILXXXXXXXXXXXXXXXXXXXXXXXXXXXXXXXXXX

SEQ ID NO: 418619 - protein, 597 aa, Influenza virus
  MOD_RES (1)..(86): Any amino acid
  MOD_RES (95)..(112): Any amino acid
  MOD_RES (122)..(219): Any amino acid
  MOD_RES (228)..(229): Any amino acid
  MOD_RES (238)..(255): Any amino acid
  MOD_RES (266)..(266): Any amino acid
  MOD_RES (277)..(355): Any amino acid
  MOD_RES (366)..(461): Any amino acid
  MOD_RES (470)..(550): Any amino acid
  MOD_RES (563)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXIGPPQCDRXXXXXXXXXXXXXXXXXXDICYPGKFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGNKLITVXXSKYLQSFTXXXXXXXXXXXXXXXXXXHWMLLDPNDTXTFTFNGSFIAXXXXXXXXXXXXXXXXXXXXXXXXXXXXXXXXXXXXXXXXXXXXXXXXXXXXXXXXXXXXXXXXXXXXXXXXXXXXXXXAYQKRMTRGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDSITELWSXXXXXXXXXXXXXXXXXXXXXXXXXXXXXXXXXXXXXXXXXXXXXXXXXXXXXXXXXXXXXXXXXXXXXXXXXXXXXXXXXPVKLNSGYKDIIXXXXXXXXXXXXXXXXXXXXXXXXXXXXXXXXXXX

SEQ ID NO: 418620 - protein, 597 aa, Influenza virus
  MOD_RES (1)..(113): Any amino acid
  MOD_RES (123)..(256): Any amino acid
  MOD_RES (265)..(267): Any amino acid
  MOD_RES (276)..(355): Any amino acid
  MOD_RES (368)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVCYPGKFVNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWLMLNPNGXXXFNFNGAFIXXXXXXXXXXXXXXXXXXXXXXXXXXXXXXXXXXXXXXXXXXXXXXXXXXXXXXXXXXXXXXXXXXXXXXXXXXXXXXXXAYQKQMTRGLFGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418621 - protein, 597 aa, Influenza virus
  MOD_RES (1)..(113): Any amino acid
  MOD_RES (123)..(260): Any amino acid
  MOD_RES (269)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVCYPGKFANXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNPNDTVTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418622 - protein, 597 aa, Influenza virus
  MOD_RES (1)..(113): Any amino acid
  MOD_RES (123)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVCYPGKFSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418623 - protein, 515 aa, Influenza virus
  MOD_RES (1)..(10): Any amino acid
  MOD_RES (39)..(62): Any amino acid
  MOD_RES (80)..(84): Any amino acid
  MOD_RES (127)..(127): Any amino acid
  MOD_RES (200)..(255): Any amino acid
  MOD_RES (309)..(318): Any amino acid
  MOD_RES (458)..(459): Any amino acid
  MOD_RES (478)..(478): Any amino acid
XXXXXXXXXXGVVNTTLSTIALLIGVGNLVFNTVIHEKXXXXXXXXXXXXXXXXXXXXXXXXITYNNTVINNITTTIITXXXXXFKSPLPLCPFRGFFPFHKDNAIRLGENKDVIVTREPYVSCDNXNCWSFALAQGALLGTKHSNGTIKDRTPYRSLIRFPIGTAPVLGNYKEICIAWSSSSCFDGKEWMHVCMTGNDXXXXXXXXXXXXXXXXXXXXXXXXXXXXXXXXXXXXXXXXXXXXXXXXXXXXXXXXGRMTDSIKSWRKDILRTQESECQCIDGTCVVAVTDGPAANSADHRVYWIREGRXXXXXXXXXXKIQHLEECSCYVDIDVYCICRDNWKGSNRPWMRINNETILETGYVCSKFHSDTPRPADPSTVSCDSPSNVNGGPGVKGFGFKAGNDVWLGRTVSTSGRSGFEIIKVTEGWINSPNHAKSVTQTLVSNNDWSGYSGSFIVXXKDCFQPCFYVELIRGRPNXNDDVSWTSNSIVTFCGLDNEPGSGNWPDGSNIGFMPK

SEQ ID NO: 418624 - protein, 515 aa, Influenza virus
  MOD_RES (1)..(10): Any amino acid
  MOD_RES (39)..(62): Any amino acid
  MOD_RES (80)..(84): Any amino acid
  MOD_RES (96)..(98): Any amino acid
  MOD_RES (127)..(127): Any amino acid
  MOD_RES (198)..(255): Any amino acid
  MOD_RES (309)..(318): Any amino acid
  MOD_RES (366)..(367): Any amino acid
  MOD_RES (457)..(459): Any amino acid
  MOD_RES (478)..(478): Any amino acid
  MOD_RES (514)..(515): Any amino acid
XXXXXXXXXXGIVNTTLSTIALIIGVGNLIFNTVIHGKXXXXXXXXXXXXXXXXXXXXXXXXITYNSTVVNNITTTIVTXXXXXFKSSLPLCPFRXXXPFHKGNSARLIHHTDVIITREPYVSCDYXDCWSFALAQGVLLGTKHSNGTVKDRTSYRSLIRFPVGTAPVLGNYREICIAWSSTSCFDGKEWMHICMTGXXXXXXXXXXXXXXXXXXXXXXXXXXXXXXXXXXXXXXXXXXXXXXXXXXXXXXXXXXGKMTDSIKSWRRDILRTQESECLCIDGTCVVTVTDGPAANNADHRIYWIREGKXXXXXXXXXXKIKHLEECSCYMDIDVYCVCRDNWKGSNRPWIRINNETIVETGYVCSXXHSDTPRPDDPSTMSCDSPSNINGGLGVKGFGFKTGDDVWLGRTVSNSGRSGFEVIKVTDGWINSPNHVKSITQTLVSNSDWSGYSGSFVXXXNGCFQPCFYIELIRGRPIXNDNVSWTSNSIVTFCGLNNEPGSGNWPDGANIGFMXX

SEQ ID NO: 418625 - protein, 515 aa, Influenza virus
  MOD_RES (1)..(10): Any amino acid
  MOD_RES (38)..(62): Any amino acid
  MOD_RES (80)..(84): Any amino acid
  MOD_RES (112)..(112): Any amino acid
  MOD_RES (123)..(127): Any amino acid
  MOD_RES (183)..(186): Any amino acid
  MOD_RES (200)..(255): Any amino acid
  MOD_RES (267)..(272): Any amino acid
  MOD_RES (306)..(318): Any amino acid
  MOD_RES (340)..(342): Any amino acid
  MOD_RES (458)..(459): Any amino acid
  MOD_RES (478)..(478): Any amino acid
  MOD_RES (489)..(495): Any amino acid
XXXXXXXXXXGAVNTTLSTIALFIGVGNLAFNAVIHGXXXXXXXXXXXXXXXXXXXXXXXXXITYNNTVVNNITTTITTXXXXXFKPPLPLCPFKGFFPFHKDNAIRPGENXGVIVTREPCVXXXXXHCWSFALAQGALVGTKHSNGTNKDRAPYRSLIQFPMGTAPVLGNYREVCIAWSSSXXXXGKEWMHVSMTGNDXXXXXXXXXXXXXXXXXXXXXXXXXXXXXXXXXXXXXXXXXXXXXXXXXXXXXXXXGRMSDSIKSWRXXXXXXQESECQRIDGICVVAVTDGPADNKADHRIYWIKXXXXXXXXXXXXXRIQHLEECSCYVDTDVYCICRXXXKGSNRPWVRINNETILETRYVCSKFHSDTPRPVDPSTISCDSPSNVKGGPGVKGFGFKKGSDVWLGRTVSISGRSSFEIIRVAEGWINSPSQAKSITQTLVSNDDWSGYSGSFIIXXGGCFQPCFYIELIRGKPNXNDEVSWTSNSXXXXXXXDNEPGSGKWPDGSDIGFMPK

SEQ ID NO: 418626 - protein, 515 aa, Influenza virus
  MOD_RES (1)..(10): Any amino acid
  MOD_RES (38)..(62): Any amino acid
  MOD_RES (78)..(84): Any amino acid
  MOD_RES (127)..(127): Any amino acid
  MOD_RES (183)..(186): Any amino acid
  MOD_RES (200)..(255): Any amino acid
  MOD_RES (267)..(272): Any amino acid
  MOD_RES (309)..(318): Any amino acid
  MOD_RES (340)..(345): Any amino acid
  MOD_RES (403)..(406): Any amino acid
  MOD_RES (445)..(449): Any amino acid
  MOD_RES (458)..(459): Any amino acid
  MOD_RES (468)..(468): Any amino acid
  MOD_RES (478)..(478): Any amino acid
  MOD_RES (493)..(496): Any amino acid
  MOD_RES (511)..(515): Any amino acid
XXXXXXXXXXGVVNTALSTIALLIGIGNLVFNTVIHGXXXXXXXXXXXXXXXXXXXXXXXXXITYNKTVINNITNVVXXXXXXXFKPSLPLCPFQGFFPFHKDNALRLAENKDVLVTREPYISCDNXGCWSFALAQGALLGTNHSNGTIEDRTPYRSLIQFPIGTAPILGNYKEIRIAWSSSXXXXGKEWLHVCITGNDXXXXXXXXXXXXXXXXXXXXXXXXXXXXXXXXXXXXXXXXXXXXXXXXXXXXXXXXGKMRDSIKSWRXXXXXXQESECQCLYGTCIVAVTDGPAANSAHHRVYWIREGKXXXXXXXXXXKIRHLEECSCYVDVDVYCICRXXXXXXNRPWMRISNETILETGYICSKFHSDTPRPTDPSIMSCDSPSNINGEPGVKGFGFKVGXXXXLGRTVSINGRSGFEVIRVTEGWIDSPNHAKSLTQTLVSXXXXXGYSGSFTVXXKGCFQPCFXVELIRGRLNXNDDVSWASNSIVTFXXXXNEPGSGHWPDGSNIXXXXX

SEQ ID NO: 418627 - protein, 515 aa, Influenza virus
  MOD_RES (1)..(10): Any amino acid
  MOD_RES (39)..(62): Any amino acid
  MOD_RES (80)..(86): Any amino acid
  MOD_RES (95)..(104): Any amino acid
  MOD_RES (113)..(114): Any amino acid
  MOD_RES (123)..(135): Any amino acid
  MOD_RES (184)..(187): Any amino acid
  MOD_RES (198)..(255): Any amino acid
  MOD_RES (266)..(273): Any amino acid
  MOD_RES (283)..(293): Any amino acid
  MOD_RES (309)..(322): Any amino acid
  MOD_RES (342)..(345): Any amino acid
  MOD_RES (360)..(375): Any amino acid
  MOD_RES (392)..(393): Any amino acid
  MOD_RES (403)..(409): Any amino acid
  MOD_RES (430)..(434): Any amino acid
  MOD_RES (446)..(459): Any amino acid
  MOD_RES (473)..(478): Any amino acid
  MOD_RES (487)..(515): Any amino acid
XXXXXXXXXXGSVNTVLSIIALLIGIGNLIFNTVIHERXXXXXXXXXXXXXXXXXXXXXXXXVTYNNTVINNMTTTIINXXXXXXXLPLPLCPFXXXXXXXXXXAIRLGENRXXIVTREPYIXXXXXXXXXXXXXQGALLGTRHSNGTIKDKTPYRSLIRFPIGVAPVLGNYKEMCAAWSSSSXXXXKEWMHVCITGXXXXXXXXXXXXXXXXXXXXXXXXXXXXXXXXXXXXXXXXXXXXXXXXXXXXXXXXXXGRMADSIKSWXXXXXXXXESECQCIGGXXXXXXXXXXXANSADHRIYWIRKGRXXXXXXXXXXXXXXSEECSCYVDIDIYCICRDNXXXXNRPWVRMNNETILEXXXXXXXXXXXXXXXXDPSVVSCDSPSNANGGXXVKGFGFKSGXXXXXXXTVSTSGRLGFEIIKVAEGWIXXXXXAKAATQTLVSNXXXXXXXXXXXXXXKDCFQSCFYVELIXXXXXXDDDVSWTSXXXXXXXXXXXXXXXXXXXXXXXXXXXXX

SEQ ID NO: 418628 - protein, 515 aa, Influenza virus
  MOD_RES (1)..(11): Any amino acid
  MOD_RES (34)..(65): Any amino acid
  MOD_RES (76)..(87): Any amino acid
  MOD_RES (96)..(144): Any amino acid
  MOD_RES (158)..(169): Any amino acid
  MOD_RES (185)..(188): Any amino acid
  MOD_RES (200)..(256): Any amino acid
  MOD_RES (266)..(273): Any amino acid
  MOD_RES (283)..(293): Any amino acid
  MOD_RES (302)..(380): Any amino acid
  MOD_RES (391)..(413): Any amino acid
  MOD_RES (432)..(515): Any amino acid
XXXXXXXXXXXVVNTILSTKALLIGIGNLAFNAXXXXXXXXXXXXXXXXXXXXXXXXXXXXXXXXNHTTINNITNXXXXXXXXXXXXSLPLCPFKXXXXXXXXXXXXXXXXXXXXXXXXXXXXXXXXXXXXXXXXXXXXXXXXXSNGTINDRTPYRSXXXXXXXXXXXXGNYKEICVAWSSSSCXXXXEWMHVCMAGNDXXXXXXXXXXXXXXXXXXXXXXXXXXXXXXXXXXXXXXXXXXXXXXXXXXXXXXXXXRVTDSIKSWXXXXXXXXESECQCISGXXXXXXXXXXXANNADHRVXXXXXXXXXXXXXXXXXXXXXXXXXXXXXXXXXXXXXXXXXXXXXXXXXXXXXXXXXXXXXXXXXXXXXXXXXXXXXXXSCSSPSGIEGXXXXXXXXXXXXXXXXXXXXXXXSSRSGFEVIKVSNGWINSXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418629 - protein, 515 aa, Influenza virus
  MOD_RES (1)..(27): Any amino acid
  MOD_RES (36)..(71): Any amino acid
  MOD_RES (80)..(174): Any amino acid
  MOD_RES (185)..(191): Any amino acid
  MOD_RES (200)..(300): Any amino acid
  MOD_RES (309)..(415): Any amino acid
  MOD_RES (433)..(515): Any amino acid
XXXXXXXXXXXXXXXXXXXXXXXXXXXNLAFNTVIXXXXXXXXXXXXXXXXXXXXXXXXXXXXXXXXXXXXNITTTIIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXICVAWSSTSCXXXXXXXHVCMTGDDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIYWIREGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRSGFEIIRVIEGWINSPXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418630 - protein, 585 aa, Influenza virus
  MOD_RES (15)..(23): Any amino acid
  MOD_RES (42)..(42): Any amino acid
  MOD_RES (67)..(80): Any amino acid
  MOD_RES (104)..(105): Any amino acid
  MOD_RES (115)..(115): Any amino acid
  MOD_RES (124)..(125): Any amino acid
  MOD_RES (140)..(143): Any amino acid
  MOD_RES (156)..(161): Any amino acid
  MOD_RES (178)..(182): Any amino acid
  MOD_RES (195)..(196): Any amino acid
  MOD_RES (210)..(211): Any amino acid
  MOD_RES (236)..(241): Any amino acid
  MOD_RES (258)..(261): Any amino acid
  MOD_RES (282)..(302): Any amino acid
  MOD_RES (311)..(311): Any amino acid
  MOD_RES (334)..(334): Any amino acid
  MOD_RES (348)..(349): Any amino acid
  MOD_RES (528)..(529): Any amino acid
  MOD_RES (566)..(568): Any amino acid
SKSRGYKMNTQILVXXXXXXXXXGCDHSDNADKICLGHHAVXNGTKVNTLTERGVEVVNATETVERXXXXXXXXXXXXXXDLGQCGLLGTITGPPQCDQFLEFXXDLIIERREGXDVCYPGKFXXEEALRQILRESGGIXXXXMGFTYSGIRTNGXXXXXXRSGSSFYAEMKWLLSNXXXXXFPQMTKSYKNTRXXPALIIWGIHHSGSXXEQTKLYGSGNKLITVGSSNYQQSFXXXXXXRPQVNGQSGRIDFHWLXXXXNDTVTFSFNGAFIAPDRASFXXXXXXXXXXXXXXXXXXXXXCYHSGGTIXSNLPFQNINSRAVGKCPRYVKQXSLLLATGMKNVPEXXTHKQLTHHMRKKRGLFGFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYRXXAMQNRIQIDPVKLSSGYKDVILWFSFGASCFILLAIXXXLVFICVKNGNMRCTICI

SEQ ID NO: 418631 - protein, 585 aa, Influenza virus
  MOD_RES (15)..(29): Any amino acid
  MOD_RES (42)..(42): Any amino acid
  MOD_RES (67)..(80): Any amino acid
  MOD_RES (100)..(105): Any amino acid
  MOD_RES (114)..(115): Any amino acid
  MOD_RES (124)..(125): Any amino acid
  MOD_RES (140)..(143): Any amino acid
  MOD_RES (156)..(161): Any amino acid
  MOD_RES (178)..(182): Any amino acid
  MOD_RES (195)..(196): Any amino acid
  MOD_RES (210)..(211): Any amino acid
  MOD_RES (236)..(241): Any amino acid
  MOD_RES (258)..(261): Any amino acid
  MOD_RES (282)..(302): Any amino acid
  MOD_RES (311)..(311): Any amino acid
  MOD_RES (332)..(334): Any amino acid
  MOD_RES (345)..(349): Any amino acid
  MOD_RES (358)..(358): Any amino acid
  MOD_RES (374)..(374): Any amino acid
  MOD_RES (401)..(401): Any amino acid
  MOD_RES (528)..(529): Any amino acid
  MOD_RES (566)..(568): Any amino acid
MKSRGYKMNIQILIXXXXXXXXXXXXXXXRADKICLGRHAVXNGTKVDTLTEKGIEVVNATETVEQXXXXXXXXXXXXXXDLGQCGFLGTTIGPPQCDQXXXXXXNLIIERREXXDICYPGKFXXEETLRQILRKSGGIXXXXMGFTYTGVRTNGXXXXXXRSRSSFYAEMEWLLSNXXXXXFPQTTKSYKNTKXXPALIVWGIHHPGSXXEQTRLYGSGSKLITVGSSKYQQSFXXXXXXRPQINGQSGRIDFYWLXXXXNDTVTFTFNGAFIAPNRASFXXXXXXXXXXXXXXXXXXXXXCYHNGGTIXSSLPFQNINPRTIGKCPRYVXXXSLMLATGMKNXXXXXAHKQLTHHXKKREKRGLFGAIAGFXENGWEGLVDGWYGFRHQNSQGEGTAAXYKSTQSAVNQITGKLNRLIDKTNQQFEMIDNEFNEIEKQIGNVINWTRDSITEMWSYNAELLIAMENQHTIDLTDSEMNKLYEKVRRQLRENAEEDCTGCFEIFHQCDNDCMESIRNNTYDHKKYRXXAIQNRIQIDAVKLSSGYKEVILWFSFGASCFLLLAIXXXLVFMCVKNGNMQCTICI

SEQ ID NO: 418632 - protein, 585 aa, Influenza virus
  MOD_RES (1)..(3): Any amino acid
  MOD_RES (15)..(29): Any amino acid
  MOD_RES (42)..(42): Any amino acid
  MOD_RES (67)..(80): Any amino acid
  MOD_RES (104)..(105): Any amino acid
  MOD_RES (115)..(115): Any amino acid
  MOD_RES (124)..(125): Any amino acid
  MOD_RES (140)..(143): Any amino acid
  MOD_RES (156)..(161): Any amino acid
  MOD_RES (178)..(182): Any amino acid
  MOD_RES (195)..(196): Any amino acid
  MOD_RES (210)..(211): Any amino acid
  MOD_RES (236)..(241): Any amino acid
  MOD_RES (258)..(261): Any amino acid
  MOD_RES (282)..(302): Any amino acid
  MOD_RES (311)..(311): Any amino acid
  MOD_RES (334)..(335): Any amino acid
  MOD_RES (348)..(349): Any amino acid
  MOD_RES (360)..(361): Any amino acid
  MOD_RES (370)..(380): Any amino acid
  MOD_RES (400)..(402): Any amino acid
  MOD_RES (435)..(435): Any amino acid
  MOD_RES (528)..(529): Any amino acid
  MOD_RES (566)..(568): Any amino acid
XXXRGYKMNTKILVXXXXXXXXXXXXXXXKGDKICLGHHAAXNGIKVDTLTERGIEVVNATETVETXXXXXXXXXXXXXXDLSQCGLLGTLIGPPQCDLFLEFXXNLIVERREGXDVCYPGKIXXEESLRQILRGSGGIXXXXTGFTYSGIRTDGXXXXXXRSGPSFYAEMKWLLSSXXXXXFPQMTRSYKNKRXXPALIIWGVHHSGSXXEQIKLYGSGDKLITVWSSKYQQSLXXXXXXRPQMNGQSGRIDFHWMXXXXNDTITFSFNGAFVAPDRVSFXXXXXXXXXXXXXXXXXXXXXCYHIGGTIXSNLPFQNVNSRAVGKCPKYVKQXXLLLATGMRNVPEXXKKKKKKRGLFXXRRRGLFGAXXXXXXXXXXXLIDGWYGYRHQNAQGEGIAXXXKSTQSAINQITGKLNRLIERTNQQFELIDNKFXEIEQQIGNVINWTRDSLTEIWSYNAEFLVAVENQHTIDLTNSEMNKLYERVKRQLRENAEEDGNGCFEIFHKCDDQCMANIRNNTYDHTQYRXXSLQNRIQINPVKLSSGYKDIILWFSFGASCFTLLAIXXXLAFICIKNGNMRCTSCI

SEQ ID NO: 418633 - protein, 585 aa, Influenza virus
  MOD_RES (1)..(6): Any amino acid
  MOD_RES (15)..(29): Any amino acid
  MOD_RES (42)..(42): Any amino acid
  MOD_RES (56)..(80): Any amino acid
  MOD_RES (99)..(105): Any amino acid
  MOD_RES (115)..(125): Any amino acid
  MOD_RES (139)..(143): Any amino acid
  MOD_RES (153)..(161): Any amino acid
  MOD_RES (178)..(183): Any amino acid
  MOD_RES (195)..(196): Any amino acid
  MOD_RES (207)..(211): Any amino acid
  MOD_RES (235)..(241): Any amino acid
  MOD_RES (252)..(261): Any amino acid
  MOD_RES (281)..(302): Any amino acid
  MOD_RES (311)..(311): Any amino acid
  MOD_RES (334)..(349): Any amino acid
  MOD_RES (358)..(358): Any amino acid
  MOD_RES (370)..(381): Any amino acid
  MOD_RES (397)..(402): Any amino acid
  MOD_RES (422)..(427): Any amino acid
  MOD_RES (479)..(480): Any amino acid
  MOD_RES (496)..(496): Any amino acid
  MOD_RES (528)..(529): Any amino acid
  MOD_RES (566)..(568): Any amino acid
XXXXXXKMNTQILIXXXXXXXXXXXXXXXSADKICLGHHAEXNGAKVNTLTEKGIXXXXXXXXXXXXXXXXXXXXXXXXXDLGRCGLLGTIIGPPQCDXXXXXXXDLIIERRDGXXXXXXXXXXXEETLRKILRKSGGXXXXXMRFTYSGIRXXXXXXXXXRSESSFYAEMKWLLSDXXXXXXPQMTKSYRNPRXXPALITWGIHHXXXXXEQTKLYGNGSKLVTVWSSKYRRSXXXXXXXRPPVNGQSGRXXXXXXXXXXNDTVNFSFNGAFVAPDRASXXXXXXXXXXXXXXXXXXXXXXCFHSGGTIXSKLPFQNINSRTVGRCPRYVKQXXXXXXXXXXXXXXXXIHKQLTHHXKKRRKRGLFGAXXXXXXXXXXXXIDGWYGYKHQNAQGEXXXXXXKSTQAAIDQITGTLNRLIDXXXXXXELIDNEFNEVERQIGNVINWTRDSIIEVWSYNADLLVAMENQHIIDLADSEXXKLYERVRKQLRENAEXDGTGCFELFHKCDDDCMTSIRNNTYDHRKYKXXAMQNRVKIDPVKLSGGYKDVILWFSLGASCFLLIAIXXXLVFICIKNGNHAVHYCI

SEQ ID NO: 418634 - protein, 585 aa, Influenza virus
  MOD_RES (1)..(29): Any amino acid
  MOD_RES (38)..(46): Any amino acid
  MOD_RES (62)..(81): Any amino acid
  MOD_RES (90)..(90): Any amino acid
  MOD_RES (99)..(105): Any amino acid
  MOD_RES (115)..(125): Any amino acid
  MOD_RES (140)..(143): Any amino acid
  MOD_RES (152)..(161): Any amino acid
  MOD_RES (171)..(186): Any amino acid
  MOD_RES (195)..(215): Any amino acid
  MOD_RES (236)..(261): Any amino acid
  MOD_RES (276)..(311): Any amino acid
  MOD_RES (320)..(323): Any amino acid
  MOD_RES (334)..(350): Any amino acid
  MOD_RES (360)..(361): Any amino acid
  MOD_RES (370)..(384): Any amino acid
  MOD_RES (395)..(410): Any amino acid
  MOD_RES (421)..(427): Any amino acid
  MOD_RES (449)..(452): Any amino acid
  MOD_RES (461)..(468): Any amino acid
  MOD_RES (482)..(503): Any amino acid
  MOD_RES (527)..(529): Any amino acid
  MOD_RES (566)..(568): Any amino acid
  MOD_RES (582)..(585): Any amino acid
XXXXXXXXXXXXXXXXXXXXXXXXXXXXXTADKICLGXXXXXXXXXVNTLTEREVEVVNATXXXXXXXXXXXXXXXXXXXXLGKCGLLGXVIGPPQCDXXXXXXXNLIIERSEGXXXXXXXXXXXGEALRQILRRSGGIXXXXTRFTYSGIXXXXXXXXXXRLGSSFYAEXXXXXXXXXXXXXXXXTKSYKNIRXXXXXXXXXXXXXXXXXXXXXLYGSGSILVTVGSSKYQRSFXXXXXXXXXXXXXXXXXXXXXXXXXXNDTVTFNFNGAFVAXXXXXXXXXXXXXXXXXXXXXXXXXXXXXXXXXXXXNNLPFQNIXXXXVGECPRYVKQXXXXXXXXXXXXXXXXXKKRKKRGLFXXKKRGLFGAXXXXXXXXXXXXXXXWYGFKHQNAQXXXXXXXXXXXXXXXXQITRKLNRLIXXXXXXXELIDNEFSEIEKQLGNVINWTXXXXIEIWSYNAXXXXXXXXQHTIDSTDSEMNKXXXXXXXXXXXXXXXXXXXXXXIFHKCDDRCMASIRNNSYDHSKYXXXAMQNIIQIDPVELSSGYKDVIIWFSFGASCFLFLAIXXXLIFMCVKNGNHAVXXXX

SEQ ID NO: 418635 - protein, 585 aa, Influenza virus
  MOD_RES (1)..(47): Any amino acid
  MOD_RES (56)..(82): Any amino acid
  MOD_RES (91)..(91): Any amino acid
  MOD_RES (100)..(131): Any amino acid
  MOD_RES (140)..(146): Any amino acid
  MOD_RES (156)..(225): Any amino acid
  MOD_RES (235)..(273): Any amino acid
  MOD_RES (282)..(358): Any amino acid
  MOD_RES (367)..(387): Any amino acid
  MOD_RES (396)..(427): Any amino acid
  MOD_RES (439)..(454): Any amino acid
  MOD_RES (463)..(469): Any amino acid
  MOD_RES (484)..(504): Any amino acid
  MOD_RES (513)..(513): Any amino acid
  MOD_RES (528)..(531): Any amino acid
  MOD_RES (541)..(547): Any amino acid
  MOD_RES (556)..(575): Any amino acid
  MOD_RES (585)..(585): Any amino acid
XXXXXXXXXXXXXXXXXXXXXXXXXXXXXXXXXXXXXXXXXXXXXXXNTLTERGIXXXXXXXXXXXXXXXXXXXXXXXXXXXGQCGLLGIXTGPPQCDLXXXXXXXXXXXXXXXXXXXXXXXXXXXXXXXXILRGSGGVXXXXXXXTYTGVRTDGXXXXXXXXXXXXXXXXXXXXXXXXXXXXXXXXXXXXXXXXXXXXXXXXXXXXXXXXXXXXXXXXXXXXXXVWSSKYQRSXXXXXXXXXXXXXXXXXXXXXXXXXXXXXXXXXXXXXXXIAPDRAGFXXXXXXXXXXXXXXXXXXXXXXXXXXXXXXXXXXXXXXXXXXXXXXXXXXXXXXXXXXXXXXXXXXXXXXXXXXXXXKKKRGLFGXXXXXXXXXXXXXXXXXXXXXFRHQKAQGXXXXXXXXXXXXXXXXXXXXXXXXXXXXXXXXKLIDNEFTEIEXXXXXXXXXXXXXXXXVWSYNAEFXXXXXXXHTIDLAESEMNKLYXXXXXXXXXXXXXXXXXXXXXFHKCDDNCXGSIRNNTYDHSTYRXXXXQNRIRIDPVXXXXXXXEIILWFSFXXXXXXXXXXXXXXXXXXXXNGNMRGTNWX

SEQ ID NO: 418636 - protein, 585 aa, Influenza virus
  MOD_RES (1)..(225): Any amino acid
  MOD_RES (234)..(358): Any amino acid
  MOD_RES (367)..(429): Any amino acid
  MOD_RES (445)..(534): Any amino acid
  MOD_RES (544)..(585): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVESSNYQQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKRGLFGAXXXXXXXXXXXXXXXXXXXXXXXXXXXXXXXXXXXXXXXXXXXXXXXXXXXXXXXXXXXXXXXIDNEFSEVEKQLGNVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKIDPVELSXXXXXXXXXXXXXXXXXXXXXXXXXXXXXXXXXXXXXXXXXX

SEQ ID NO: 418637 - protein, 585 aa, Influenza virus
  MOD_RES (1)..(363): Any amino acid
  MOD_RES (372)..(585): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418638 - protein, 471 aa, Influenza virus
  MOD_RES (39)..(61): Any amino acid
  MOD_RES (73)..(81): Any amino acid
  MOD_RES (164)..(168): Any amino acid
  MOD_RES (254)..(267): Any amino acid
  MOD_RES (285)..(286): Any amino acid
  MOD_RES (309)..(309): Any amino acid
  MOD_RES (332)..(333): Any amino acid
  MOD_RES (389)..(391): Any amino acid
  MOD_RES (416)..(416): Any amino acid
  MOD_RES (454)..(454): Any amino acid
MNPNQKLFALSGVAIALSVLNLLIGISNVGLNVSLHLKXXXXXXXXXXXXXXXXXXXXXXXENTYVNNTTIIXXXXXXXXXSYLLLNKSLCNVEGWVVIAKDNAVRFGESEQIIVTREPYVSCDPTGCKMYALHQGTTIRNKHSNGTIHDRTAFRGLISTPLGXXXXXSNSDFMCVGWSSTTCHDGIGRMTICIQGNNDNATATVYYNRRLTTTIKTWARNILRTQESECVCHNGTCAVVMTDGSASSQAYTKXXXXXXXXXXXXXXLKGSARHIEECSCYGHNXXVTCVCRDNWQGANRPIIEIDMNXLEHTSRYVCTGILTDTSRPGDKXXGDCSNPITGSPGAPGVKGFGFLNGDNTWLGRTISPRSRSGFEMLKIPNAGTDPNSXXXERQEIVDNNNWSGYSGSFIDYWNDXSECYNPCFYVELIRGRPEEAKYVWWTSNSLIALCGSPXPVGSGSFPDGAQIQYFS

SEQ ID NO: 418639 - protein, 471 aa, Influenza virus
  MOD_RES (39)..(61): Any amino acid
  MOD_RES (73)..(81): Any amino acid
  MOD_RES (135)..(138): Any amino acid
  MOD_RES (164)..(168): Any amino acid
  MOD_RES (254)..(267): Any amino acid
  MOD_RES (285)..(286): Any amino acid
  MOD_RES (309)..(309): Any amino acid
  MOD_RES (332)..(333): Any amino acid
  MOD_RES (389)..(391): Any amino acid
  MOD_RES (416)..(416): Any amino acid
  MOD_RES (425)..(432): Any amino acid
  MOD_RES (448)..(454): Any amino acid
MNPSQKLFALSGIAIVLGIINLLIGISNMSLNISLYSKXXXXXXXXXXXXXXXXXXXXXXXKNTYVNNTTVIXXXXXXXXXNYLMLNKSLCKVEGWVVVAKDNAIRFGESEQVIVTREPYVSCDPLSCKMYALHXXXXIRNKHSNSTTHDRTAFRGLMSTPLGXXXXXSNSDFICVGWSSTSCHDGIARMTICIQGDNENATATVYYDRRLTTTIRTWAKNILRTQESECVRHNGTCAVVMTDGPANNQAFTKXXXXXXXXXXXXXXLKGSAKHIEECSCYGHSXXATCVCRDNWQGANRPVIEIDMNXLEHTSRYICTGVLTDTSRPSDKXXGDCNNPITGSPCAPGIKGFGFLNEGNTWLGRTISPKLRSGFEMLRIPNAGIDPNSXXXERQEIVSNDNWSGYSGSFIDYWDEXNECYNPCFXXXXXXXXPEEAKYVEWTSNSLIXXXXXXXSVGSGSFPDGAQIKYFS

SEQ ID NO: 418640 - protein, 471 aa, Influenza virus
  MOD_RES (1)..(1): Any amino acid
  MOD_RES (39)..(61): Any amino acid
  MOD_RES (72)..(81): Any amino acid
  MOD_RES (137)..(140): Any amino acid
  MOD_RES (164)..(168): Any amino acid
  MOD_RES (254)..(267): Any amino acid
  MOD_RES (285)..(286): Any amino acid
  MOD_RES (295)..(300): Any amino acid
  MOD_RES (309)..(309): Any amino acid
  MOD_RES (332)..(333): Any amino acid
  MOD_RES (389)..(391): Any amino acid
  MOD_RES (406)..(407): Any amino acid
  MOD_RES (416)..(434): Any amino acid
  MOD_RES (450)..(454): Any amino acid
  MOD_RES (466)..(471): Any amino acid
XNPNQKLFTLSGVAIALSILNLLIGISNIGLNVSLHLRXXXXXXXXXXXXXXXXXXXXXXXENKYVNNTTIXXXXXXXXXXGYLLLNKSLCSVEGWVVIEKDNAVRFGESEQIVVTREPYVSCDPSGCRMYALHQGXXXXNKHSNGTTHDRTAFRGLISTHLGXXXXXSNSDFLCVGWSSTSCHDGVGRMTICVQGNNNNATATVYYNKRLTTTIKTWAKNILRTQDSECVSHNGTWAVVMTDGPASSQAHTKXXXXXXXXXXXXXXLRGSARHIEEWSCYGHSXXITCVCRDNXXXXXXPIIEIDMTXMEHTSQYLCTGVLTDTSRPKDKXXGECFNPITGSPGVPGVKGFGFLDSSNTWLGRTISPRLRSGFEMLKIHNAGTDPESXXXERQEIVGNDNWSGYXXSFIDYWDDXXXXXXXXXXXXXXXXXXXEAKYVWWASNSLIALXXXXXPVGPGSFPDGAXXXXXX

SEQ ID NO: 418641 - protein, 471 aa, Influenza virus
  MOD_RES (1)..(2): Any amino acid
  MOD_RES (18)..(18): Any amino acid
  MOD_RES (39)..(61): Any amino acid
  MOD_RES (70)..(81): Any amino acid
  MOD_RES (109)..(118): Any amino acid
  MOD_RES (127)..(144): Any amino acid
  MOD_RES (164)..(168): Any amino acid
  MOD_RES (199)..(201): Any amino acid
  MOD_RES (254)..(276): Any amino acid
  MOD_RES (285)..(286): Any amino acid
  MOD_RES (296)..(300): Any amino acid
  MOD_RES (309)..(309): Any amino acid
  MOD_RES (332)..(338): Any amino acid
  MOD_RES (389)..(391): Any amino acid
  MOD_RES (408)..(439): Any amino acid
  MOD_RES (454)..(454): Any amino acid
XXPNQKLFASSGIAIVLXVLNLLIGVSNVGLNMSLHLKXXXXXXXXXXXXXXXXXXXXXXXGNTYVNNTXXXXXXXXXXXXNYLLLNKSLCKIEGWVVVAQDNAIRFGXXXXXXXXXXPYVSCDPKXXXXXXXXXXXXXXXXXXNGTIHDRAAFRGLISTQLGXXXXXSNSEFICVGWSSTTCHDGVNRMTICVQGDNXXXTATVYYNGRLTTTIKTWAGNILRTQESECVCHNSTCVVVMTDGPASSRAYTKXXXXXXXXXXXXXXXXXXXXXXXECSCYGHDXXVSCVCRDNWXXXXXPIIEIDMSXLEHTSKYVCTGVLTDTSRPGDRXXXXXXXPITGSPGSPGVKGFGFLSGNNTWLGRTISPRSRNGFEMLKIPNAETDPNSXXXGRQEIVDNSNWSGYSGXXXXXXXXXXXXXXXXXXXXXXXXXXXXXXXXWWTSNSLVALCGSPXPIGSGFFPDGPQIQYFS

SEQ ID NO: 418642 - protein, 471 aa, Influenza virus
  MOD_RES (1)..(8): Any amino acid
  MOD_RES (38)..(62): Any amino acid
  MOD_RES (73)..(91): Any amino acid
  MOD_RES (100)..(118): Any amino acid
  MOD_RES (127)..(145): Any amino acid
  MOD_RES (164)..(182): Any amino acid
  MOD_RES (205)..(207): Any amino acid
  MOD_RES (223)..(230): Any amino acid
  MOD_RES (254)..(286): Any amino acid
  MOD_RES (298)..(300): Any amino acid
  MOD_RES (309)..(309): Any amino acid
  MOD_RES (319)..(345): Any amino acid
  MOD_RES (357)..(357): Any amino acid
  MOD_RES (367)..(376): Any amino acid
  MOD_RES (386)..(392): Any amino acid
  MOD_RES (408)..(471): Any amino acid
XXXXXXXXASSGIAIALGIINLLIGISNVVLNVSLHLXXXXXXXXXXXXXXXXXXXXXXXXXNTYINNATIIXXXXXXXXXXXXXXXXXXXNVEGWVVVXXXXXXXXXXXXXXXXXXXPYVSCDPIXXXXXXXXXXXXXXXXXXXGTIHDRTTFRGLLSTPLGXXXXXXXXXXXXXXXXXXXCHDGVSRMTICVQGNNENATATXXXDRRLTTTVKTWAGNIXXXXXXXXVCHNGTCVVIMTDGSASGQAYTKXXXXXXXXXXXXXXXXXXXXXXXXXXXXXXXXXVTCGCRDNWQGXXXPVIEIDMSXMDHTSQYLCXXXXXXXXXXXXXXXXXXXXXXXXXXXAPGTKGFGFLNXDSTWLGRTIXXXXXXXXXXLKIPNAGIDXXXXXXXRQEIVDNKNWSGYSGXXXXXXXXXXXXXXXXXXXXXXXXXXXXXXXXXXXXXXXXXXXXXXXXXXXXXXXXXXXXXXXX

SEQ ID NO: 418643 - protein, 471 aa, Influenza virus
  MOD_RES (1)..(62): Any amino acid
  MOD_RES (73)..(93): Any amino acid
  MOD_RES (107)..(150): Any amino acid
  MOD_RES (161)..(219): Any amino acid
  MOD_RES (228)..(232): Any amino acid
  MOD_RES (251)..(315): Any amino acid
  MOD_RES (325)..(380): Any amino acid
  MOD_RES (389)..(399): Any amino acid
  MOD_RES (410)..(471): Any amino acid
XXXXXXXXXXXXXXXXXXXXXXXXXXXXXXXXXXXXXXXXXXXXXXXXXXXXXXXXXXXXXXNTYINNTTIIXXXXXXXXXXXXXXXXXXXXXEGWVVIAQDNAIRXXXXXXXXXXXXXXXXXXXXXXXXXXXXXXXXXXXXXXXXXXXXRTTFRGLISTXXXXXXXXXXXXXXXXXXXXXXXXXXXXXXXXXXXXXXXXXXXXXXXXXXXXXXXXXXXRNILRTQDXXXXXHNGTCVVVMTDGSASSRAXXXXXXXXXXXXXXXXXXXXXXXXXXXXXXXXXXXXXXXXXXXXXXXXXXXXXXXXXXXXXXXXXYICTGILTDXXXXXXXXXXXXXXXXXXXXXXXXXXXXXXXXXXXXXXXXXXXXXXXXXXXXXXXXNAGTDPDSXXXXXXXXXXXSNRSGYSGSFXXXXXXXXXXXXXXXXXXXXXXXXXXXXXXXXXXXXXXXXXXXXXXXXXXXXXXXXXXXXXX

SEQ ID NO: 418644 - protein, 471 aa, Influenza virus
  MOD_RES (1)..(97): Any amino acid
  MOD_RES (107)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIAKDNAIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418645 - protein, 567 aa, Influenza virus
  MOD_RES (1)..(8): Any amino acid
XXXXXXXXMLLASTNAYDRICIGYQSNNSTDTVNTLIEQNVPVTQTMELVETEKHPAYCNTDLGAPLELRDCKIEAVIYGNPKCDIHLKDQGWSYIVERPSAPEGMCYPGSVENLEELRFVFSNAASYKRIRLFDYSRWNVTSSGTSKACNASTGGQSFYRSINWLTKKKPDTYDFNNEGSYVNNEDGDIIFLWGIHHPPDTKEQTTLYKNANTLSSVTTNTINRSFQPNIGPRPLVRGQQGRMDYYWGILKRGETLKIRTNGNLIAPEFGYLLKGESHGRIIQNEDIPIGNCHTKCQTYAGAINSSKPFQNASRHYMGECPKYVKKASLRLAVGLRNTPSIEPKGLFGAIAGFIEGGWSGMIDGWYGFHHSNSEGTGMAADQKSTQEAIDKITNKVNNIVDKMNREFEVVNHEFSEVEKRINMINDKIDDQIEDLWAYNAELLVLLENQKTLDEHDSNVKNLFDEVKRRLSANAIDAGNGCFDILHKCNNECMETIKNGTYNHKEYEEEAKLERSKINGVKLEENTTYKILSIYSTVAASLCLAILIAGGLILGMQNGSCRCMFCI

SEQ ID NO: 418646 - protein, 567 aa, Influenza virus
  MOD_RES (1)..(8): Any amino acid
  MOD_RES (20)..(23): Any amino acid
  MOD_RES (100)..(103): Any amino acid
  MOD_RES (159)..(162): Any amino acid
  MOD_RES (251)..(267): Any amino acid
  MOD_RES (350)..(352): Any amino acid
  MOD_RES (382)..(383): Any amino acid
  MOD_RES (399)..(401): Any amino acid
  MOD_RES (443)..(444): Any amino acid
  MOD_RES (536)..(538): Any amino acid
XXXXXXXXMLLVSTNAYDRXXXXYQSNNSTNTVNTLIEQKVPVTQTMELVEAEKHSAYCNTDLGTPLELRDCKVEAVIYGNPKCDVHLKDQDWSYIVERXXXXEGMCYPGFVENLEELRFVFSSAASYKRIRLFDYSKWNVTRSGTSKACSASTGGQSXXXXINWLTKKEPDTYDFNNEGTYINNEDGNIIFLWGIHHPPNTKEQTALYKNANTLTSVTTNTINRIFQPNIGPRALVRGQQGTMDYYWGIXXXXXXXXXXXXXXXXXPEFGYLLRGESHGRTIQNEDIPIENCNTKCQTYAGAVNSSKPFQNTSRHYMGECPNYVKKESLRLAVGLRNTPSVEPKGLFGXXXGFIEGGWCGMIDGWYGFHHSNAEGTGMAAXXKSTQEAINKITNKVNXXXDKMNREFGVVNHEFSGVEKRINMISDKIDDQIENLWAYNAEXXVLLENQKILDEHDSNVENLFDEVRRRLSANAVDTGNGCFDILHKCDNECMETIKNGTYDHKEYEEEAKLEKSRINGVKLEENTSYKILSIYXXXAASLCLAVLIAGGLILGMQNGSYRCMFCI

SEQ ID NO: 418647 - protein, 567 aa, Influenza virus
  MOD_RES (1)..(8): Any amino acid
  MOD_RES (20)..(26): Any amino acid
  MOD_RES (73)..(78): Any amino acid
  MOD_RES (100)..(104): Any amino acid
  MOD_RES (143)..(145): Any amino acid
  MOD_RES (161)..(163): Any amino acid
  MOD_RES (194)..(194): Any amino acid
  MOD_RES (247)..(271): Any amino acid
  MOD_RES (351)..(383): Any amino acid
  MOD_RES (399)..(403): Any amino acid
  MOD_RES (438)..(447): Any amino acid
  MOD_RES (484)..(484): Any amino acid
  MOD_RES (512)..(512): Any amino acid
  MOD_RES (538)..(540): Any amino acid
  MOD_RES (556)..(567): Any amino acid
XXXXXXXXMLLMSTNAYDRXXXXXXXNNSTDTVDTLIEQNIPVTQTMELVETKKHPAYCNTDLGSPLELRDCXXXXXXYGNPKCDTHLKDQSWSYIVERXXXXXGMCYPGSIENLEELRFVFSIAASYKRIRLFDYSGWNVTXXXTSKACNALTGGQSFYXXXNWLTKKKNPEAYNFNEGSYVNNKDGDIIFLXGIHHPPDAKEQTTLYKNTNTLSSVTTNTINRNFQPNIGPRPLVREQQGRMDYXXXXXXXXXXXXXXXXXXXXXXXXXYLLKGESYGRIIQNEDIPIGSCHTKCQTYTGAINSSKPLQNASRHYMGECPEYVKKESLRLALGLRNTPSIDPKGLFGAXXXXXXXXXXXXXXXXXXXXXXXXXXXXXXXXXKSTQEAIGKITNKVNXXXXXMNREFEVMNHEFSEIEKRTNMINDKINDQIEDLWXXXXXXXXXXENQKTLDKHDSNVKNLFDEVRRRLSTNAIDTGNGCFXILHKCDNKCMETIKNGTYNRKEYEEEAXLERSKINEVKLEENTTYRILSIYSTXXXSLCLAILVAGGLILGXXXXXXXXXXXX

SEQ ID NO: 418648 - protein, 567 aa, Influenza virus
  MOD_RES (1)..(8): Any amino acid
  MOD_RES (25)..(29): Any amino acid
  MOD_RES (63)..(81): Any amino acid
  MOD_RES (97)..(123): Any amino acid
  MOD_RES (164)..(165): Any amino acid
  MOD_RES (251)..(272): Any amino acid
  MOD_RES (288)..(291): Any amino acid
  MOD_RES (353)..(383): Any amino acid
  MOD_RES (399)..(404): Any amino acid
  MOD_RES (443)..(465): Any amino acid
  MOD_RES (484)..(498): Any amino acid
  MOD_RES (514)..(514): Any amino acid
  MOD_RES (530)..(567): Any amino acid
XXXXXXXXTLASTNAYHDRICIGYXXXXXTDTVNTLMEQNVPVTQAMELVEAEKNPAYCNTDXXXXXXXXXXXXXXXXXXXPKCDIHLRDQGWSYIXXXXXXXXXXXXXXXXXXXXXXXXXXXSAASYKRVRLFDYSRWNVSSSGTSKACNASTGAQSFYRSIXXLTKKKPDIYDFNNEGTYVNNEEGDIIFLWGIHHPPDETEQTKLYKNTNTLSSVNTNTINRSFRPNIGPRPLVRGQQGWMDYYWGIXXXXXXXXXXXXXXXXXXXXXXLLKGESHCRIIQNEDXXXXNCKTKCQTYAGAINSSRPFQNASRYYMGECPKYAKKASLRLAIGLRNTPSVEPRGLFGAIAXXXXXXXXXXXXXXXXXXXXXXXXXXXXXXXKSTQEAIEKITNKVNXXXXXXNREFEVVDHEFSEAEKRINVINDKIDDQIEGLWAYNAEXXXXXXXXXXXXXXXXXXXXXXXEVKRRLSTNAMDAGNGCFXXXXXXXXXXXXXXXNGTYNHKDYEEEAKLXRSKINGVILEENTTYXXXXXXXXXXXXXXXXXXXXXXXXXXXXXXXXXXXXXX

SEQ ID NO: 418649 - protein, 567 aa, Influenza virus
  MOD_RES (1)..(8): Any amino acid
  MOD_RES (18)..(29): Any amino acid
  MOD_RES (45)..(47): Any amino acid
  MOD_RES (64)..(86): Any amino acid
  MOD_RES (100)..(134): Any amino acid
  MOD_RES (143)..(150): Any amino acid
  MOD_RES (166)..(171): Any amino acid
  MOD_RES (195)..(201): Any amino acid
  MOD_RES (210)..(211): Any amino acid
  MOD_RES (220)..(273): Any amino acid
  MOD_RES (289)..(291): Any amino acid
  MOD_RES (302)..(309): Any amino acid
  MOD_RES (334)..(337): Any amino acid
  MOD_RES (350)..(389): Any amino acid
  MOD_RES (405)..(409): Any amino acid
  MOD_RES (443)..(465): Any amino acid
  MOD_RES (488)..(498): Any amino acid
  MOD_RES (511)..(514): Any amino acid
  MOD_RES (530)..(567): Any amino acid
XXXXXXXXMILVSTNAYXXXXXXXXXXXXTDTVNTLTEQNVPVTXXXELVETEKNLAYCNTDLXXXXXXXXXXXXXXXXXXXXXXXHLKDQAWSYIVERXXXXXXXXXXXXXXXXXXXXXXXXXXXXXXXXXXXDYSKWNVSXXXXXXXXNASTGGQAFYRSINWXXXXXXPDTYDFNEGSYINNENGDIIFLWXXXXXXXAKEQTALYXXANTLSSVNXXXXXXXXXXXXXXXXXXXXXXXXXXXXXXXXXXXXXXXXXXXXXXXXXXXXXXLKGESHGKIIQNEDIXXXNCYTKCQTYAXXXXXXXXFQNASRHHMGECPKYVRKASLRLAXXXXNTPSIEPRGLFGXXXXXXXXXXXXXXXXXXXXXXXXXXXXXXXXXXXXXXXXIDKITNKINNIVDKMXXXXXVVNHEFSKVEKKINMINDKIDDQIEELWAYNAEXXXXXXXXXXXXXXXXXXXXXXXEVRRRLSVNAIDTGKGCFDILHXXXXXXXXXXXNGTYDHKDYEEEXXXXRSKINGVRLEENTTYXXXXXXXXXXXXXXXXXXXXXXXXXXXXXXXXXXXXXX

SEQ ID NO: 418650 - protein, 567 aa, Influenza virus
  MOD_RES (1)..(9): Any amino acid
  MOD_RES (24)..(52): Any amino acid
  MOD_RES (63)..(171): Any amino acid
  MOD_RES (182)..(300): Any amino acid
  MOD_RES (309)..(326): Any amino acid
  MOD_RES (336)..(567): Any amino acid
XXXXXXXXXLLASTNAHDRICIGXXXXXXXXXXXXXXXXXXXXXXXXXXXXXEKHLAYCNTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDIYDFNEGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGAINSSRXXXXXXXXXXXXXXXXXXKESLRLAIGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418651 - protein, 567 aa, Influenza virus
  MOD_RES (1)..(173): Any amino acid
  MOD_RES (185)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYDFNEGTYVNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418652 - protein, 567 aa, Influenza virus
  MOD_RES (1)..(173): Any amino acid
  MOD_RES (186)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYDFNEGAYVNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418653 - protein, 567 aa, Influenza virus
  MOD_RES (1)..(176): Any amino acid
  MOD_RES (185)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNEGTYINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418654 - protein, 562 aa, Influenza virus
  MOD_RES (10)..(25): Any amino acid
  MOD_RES (39)..(55): Any amino acid
  MOD_RES (65)..(76): Any amino acid
  MOD_RES (89)..(94): Any amino acid
  MOD_RES (106)..(155): Any amino acid
  MOD_RES (166)..(237): Any amino acid
  MOD_RES (269)..(296): Any amino acid
  MOD_RES (320)..(322): Any amino acid
  MOD_RES (334)..(339): Any amino acid
  MOD_RES (378)..(421): Any amino acid
  MOD_RES (464)..(471): Any amino acid
  MOD_RES (487)..(487): Any amino acid
  MOD_RES (499)..(520): Any amino acid
  MOD_RES (539)..(543): Any amino acid
  MOD_RES (553)..(562): Any amino acid
RWKHVTNTIXXXXXXXXXXXXXXXXGYQSTNSTETVDTXXXXXXXXXXXXXXXXXEHNGMLCATXXXXXXXXXXXXIEGLIYGNPSCDXXXXXXEWSYIVERPSAXXXXXXXXXXXXXXXXXXXXXXXXXXXXXXXXXXXXXXXXXXXXXXXXXXSFYRSMRWLTXXXXXXXXXXXXXXXXXXXXXXXXXXXXXXXXXXXXXXXXXXXXXXXXXXXXXXXXXXXXXXXXXXXXXXXXGRIDYYWSVLKPGQTLRIRSNGNLIAPWYGHXXXXXXXXXXXXXXXXXXXXXXXXXXXXGGLNTTLPFQNVSKYAFGNCSKYXXXKSLKLAVGLRNXXXXXXRGLFGAIAGFIEGGWSGLVAGWYGFQHSNDQGVGMAADXXXXXXXXXXXXXXXXXXXXXXXXXXXXXXXXXXXXXXXXXXXXNKIDDQIQDIWAYNAELLVLLENQKTLDEHDANVNNLYNKVKXXXXXXXXEDGKGCFELYHKCDDXCMETIRNGTYNXXXXXXXXXXXXXXXXXXXXXXEGTYKILTIYSTVASSLVXXXXXAAFLFWAMSXXXXXXXXXX

SEQ ID NO: 418655 - protein, 562 aa, Influenza virus
  MOD_RES (1)..(25): Any amino acid
  MOD_RES (39)..(55): Any amino acid
  MOD_RES (65)..(76): Any amino acid
  MOD_RES (89)..(94): Any amino acid
  MOD_RES (106)..(155): Any amino acid
  MOD_RES (166)..(237): Any amino acid
  MOD_RES (269)..(296): Any amino acid
  MOD_RES (320)..(322): Any amino acid
  MOD_RES (334)..(339): Any amino acid
  MOD_RES (378)..(421): Any amino acid
  MOD_RES (464)..(471): Any amino acid
  MOD_RES (487)..(487): Any amino acid
  MOD_RES (499)..(520): Any amino acid
  MOD_RES (539)..(543): Any amino acid
  MOD_RES (553)..(562): Any amino acid
XXXXXXXXXXXXXXXXXXXXXXXXXGHQSTNSTEAVDTXXXXXXXXXXXXXXXXXEHNGILCATXXXXXXXXXXXXIEGLVYGNPSCDXXXXXXKWSYIVERSSAXXXXXXXXXXXXXXXXXXXXXXXXXXXXXXXXXXXXXXXXXXXXXXXXXXSFYRNMRWLTXXXXXXXXXXXXXXXXXXXXXXXXXXXXXXXXXXXXXXXXXXXXXXXXXXXXXXXXXXXXXXXXXXXXXXXXGRINYYWSILKPGQTLRVRSNGNLIAPLYGHXXXXXXXXXXXXXXXXXXXXXXXXXXXXGGLNSTLPFHNVSKYAFGTCPKYXXXKSLKLAIGLRNXXXXXXRGIFGAIAGFIEGGWPGLVAGWYGFQHSNAQGTGMAADXXXXXXXXXXXXXXXXXXXXXXXXXXXXXXXXXXXXXXXXXXXXDKIDDQIQNIWAYNAELLVLLGNQKTLDEHEANVNNLYNKVRXXXXXXXXEDGNGCFELYHRCDDXCMATIRNGTYDXXXXXXXXXXXXXXXXXXXXXXEGIYKILTIYSTAASSLVXXXXXAAFMFWAMSXXXXXXXXXX

SEQ ID NO: 418656 - protein, 562 aa, Influenza virus
  MOD_RES (1)..(25): Any amino acid
  MOD_RES (39)..(55): Any amino acid
  MOD_RES (65)..(76): Any amino acid
  MOD_RES (89)..(94): Any amino acid
  MOD_RES (106)..(155): Any amino acid
  MOD_RES (164)..(237): Any amino acid
  MOD_RES (269)..(296): Any amino acid
  MOD_RES (316)..(322): Any amino acid
  MOD_RES (334)..(350): Any amino acid
  MOD_RES (378)..(421): Any amino acid
  MOD_RES (464)..(471): Any amino acid
  MOD_RES (487)..(487): Any amino acid
  MOD_RES (499)..(520): Any amino acid
  MOD_RES (539)..(543): Any amino acid
  MOD_RES (553)..(562): Any amino acid
XXXXXXXXXXXXXXXXXXXXXXXXXGYLSTNSTETVNTXXXXXXXXXXXXXXXXXEHNGVLCATXXXXXXXXXXXXVEGLIYGNPSCNXXXXXXDWSYIVERPTAXXXXXXXXXXXXXXXXXXXXXXXXXXXXXXXXXXXXXXXXXXXXXXXXXXTFYRNMRWXXXXXXXXXXXXXXXXXXXXXXXXXXXXXXXXXXXXXXXXXXXXXXXXXXXXXXXXXXXXXXXXXXXXXXXXXXGRIDYYWAVLKPGQTLRVKSNGNLIAPWFGHXXXXXXXXXXXXXXXXXXXXXXXXXXXXSGLNTTLPFHNISKYAFGTXXXXXXXNSLKLAVGMRNXXXXXXXXXXXXXXXXXEGGWSGLIAGWYGFQHSNEQGVGIAADXXXXXXXXXXXXXXXXXXXXXXXXXXXXXXXXXXXXXXXXXXXXNKVDDQIQDVWAYNAELLVLIENQKTLDEHVANVNNLYKKVKXXXXXXXXEDGKGCFDLYHKCDNXCMGTIRNGTYSXXXXXXXXXXXXXXXXXXXXXXEETYKILTIYSTVASSIVXXXXXAAFLFWVMSXXXXXXXXXX

SEQ ID NO: 418657 - protein, 562 aa, Influenza virus
  MOD_RES (1)..(25): Any amino acid
  MOD_RES (39)..(55): Any amino acid
  MOD_RES (64)..(76): Any amino acid
  MOD_RES (89)..(94): Any amino acid
  MOD_RES (103)..(155): Any amino acid
  MOD_RES (166)..(237): Any amino acid
  MOD_RES (269)..(296): Any amino acid
  MOD_RES (320)..(322): Any amino acid
  MOD_RES (331)..(361): Any amino acid
  MOD_RES (378)..(421): Any amino acid
  MOD_RES (439)..(439): Any amino acid
  MOD_RES (464)..(472): Any amino acid
  MOD_RES (487)..(487): Any amino acid
  MOD_RES (497)..(520): Any amino acid
  MOD_RES (539)..(543): Any amino acid
  MOD_RES (553)..(562): Any amino acid
XXXXXXXXXXXXXXXXXXXXXXXXXVHQSTNSTETVYTXXXXXXXXXXXXXXXXXEHNGLLCAXXXXXXXXXXXXXVEGLVYGNPACDXXXXXXGWSYIVERXXXXXXXXXXXXXXXXXXXXXXXXXXXXXXXXXXXXXXXXXXXXXXXXXXXXXSFYRGMRWLTXXXXXXXXXXXXXXXXXXXXXXXXXXXXXXXXXXXXXXXXXXXXXXXXXXXXXXXXXXXXXXXXXXXXXXXXGRIDYYWPVLKPGQTLRVRSDGNLIAPWYGYXXXXXXXXXXXXXXXXXXXXXXXXXXXXGGLNTILPFHNVSRYAFGNCPKYXXXNSLKLAIGXXXXXXXXXXXXXXXXXXXXXXXXXXXXXXXYGFQHTNDQGIGMAADXXXXXXXXXXXXXXXXXXXXXXXXXXXXXXXXXXXXXXXXXXXXDKVDDQIQDLWAYNAELXVLLENQKPLDEHDANANNLYNRVKXXXXXXXXXNGNGCFELYHKCNDXCMEAIRNGTXXXXXXXXXXXXXXXXXXXXXXXXEGAYKILTIYSTVASSFVXXXXXAAFLFWTMSXXXXXXXXXX

SEQ ID NO: 418658 - protein, 562 aa, Influenza virus
  MOD_RES (1)..(30): Any amino acid
  MOD_RES (39)..(55): Any amino acid
  MOD_RES (64)..(97): Any amino acid
  MOD_RES (106)..(155): Any amino acid
  MOD_RES (166)..(244): Any amino acid
  MOD_RES (253)..(254): Any amino acid
  MOD_RES (263)..(296): Any amino acid
  MOD_RES (320)..(322): Any amino acid
  MOD_RES (334)..(369): Any amino acid
  MOD_RES (378)..(421): Any amino acid
  MOD_RES (431)..(443): Any amino acid
  MOD_RES (464)..(478): Any amino acid
  MOD_RES (487)..(489): Any amino acid
  MOD_RES (499)..(520): Any amino acid
  MOD_RES (529)..(530): Any amino acid
  MOD_RES (539)..(543): Any amino acid
  MOD_RES (552)..(562): Any amino acid
XXXXXXXXXXXXXXXXXXXXXXXXXXXXXXNSPETVDTXXXXXXXXXXXXXXXXXGHNGMLCAXXXXXXXXXXXXXXXXXXXXXXXXXXXXXXXXXXYIIERPSAXXXXXXXXXXXXXXXXXXXXXXXXXXXXXXXXXXXXXXXXXXXXXXXXXXSFYKSMRWLTXXXXXXXXXXXXXXXXXXXXXXXXXXXXXXXXXXXXXXXXXXXXXXXXXXXXXXXXXXXXXXXXXXXXXXXXXXXXXXXSLLKPGQTXXIRSNGNLVXXXXXXXXXXXXXXXXXXXXXXXXXXXXXXXXXXGGLNITLPFQNISKYAFGNCPRYXXXRSLKLAVGLKNXXXXXXXXXXXXXXXXXXXXXXXXXXXXXXXXXXXXQGAGMAADXXXXXXXXXXXXXXXXXXXXXXXXXXXXXXXXXXXXXXXXXXXXNKIEDQIQDXXXXXXXXXXXXXNQKILDEHDANVHNLYNKVKXXXXXXXXXXXXXXXELYHKCDNXXXETTRNGTYNXXXXXXXXXXXXXXXXXXXXXXDGTYKILTXXSTVASPLVXXXXXTAFLFWAMXXXXXXXXXXX

SEQ ID NO: 418659 - protein, 562 aa, Influenza virus
  MOD_RES (1)..(156): Any amino acid
  MOD_RES (166)..(245): Any amino acid
  MOD_RES (255)..(255): Any amino acid
  MOD_RES (266)..(299): Any amino acid
  MOD_RES (320)..(422): Any amino acid
  MOD_RES (435)..(445): Any amino acid
  MOD_RES (455)..(544): Any amino acid
  MOD_RES (553)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFYRSVRWLTXXXXXXXXXXXXXXXXXXXXXXXXXXXXXXXXXXXXXXXXXXXXXXXXXXXXXXXXXXXXXXXXXXXXXXXXXXXXXXXXVLRPGQTLRXRSNENLIAPWXXXXXXXXXXXXXXXXXXXXXXXXXXXXXXXXXXNTTLPFQDISKYAFGICPKYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKIDDRIQDIWAYXXXXXXXXXXXKTLDEHDSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAFFFWAMSXXXXXXXXXX

SEQ ID NO: 418660 - protein, 562 aa, Influenza virus
  MOD_RES (1)..(302): Any amino acid
  MOD_RES (314)..(446): Any amino acid
  MOD_RES (457)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPFQNVSRYAFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLDEHDTNVNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418661 - protein, 562 aa, Influenza virus
  MOD_RES (10)..(25): Any amino acid
  MOD_RES (39)..(50): Any amino acid
  MOD_RES (65)..(76): Any amino acid
  MOD_RES (89)..(94): Any amino acid
  MOD_RES (106)..(155): Any amino acid
  MOD_RES (166)..(237): Any amino acid
  MOD_RES (269)..(296): Any amino acid
  MOD_RES (320)..(322): Any amino acid
  MOD_RES (335)..(339): Any amino acid
  MOD_RES (378)..(390): Any amino acid
  MOD_RES (399)..(421): Any amino acid
  MOD_RES (464)..(471): Any amino acid
  MOD_RES (487)..(487): Any amino acid
  MOD_RES (499)..(519): Any amino acid
  MOD_RES (539)..(543): Any amino acid
  MOD_RES (553)..(562): Any amino acid
RWKHVTNTIXXXXXXXXXXXXXXXXGYQSTNSTETVDTXXXXXXXXXXXXELLHTEHNGMLCATXXXXXXXXXXXXIEGLIYGNPSCDXXXXXXEWSYIVERPSAXXXXXXXXXXXXXXXXXXXXXXXXXXXXXXXXXXXXXXXXXXXXXXXXXXSFYRSMRWLTXXXXXXXXXXXXXXXXXXXXXXXXXXXXXXXXXXXXXXXXXXXXXXXXXXXXXXXXXXXXXXXXXXXXXXXXGRIDYYWSVLKPGQTLRIRSNGNLIAPWYGHXXXXXXXXXXXXXXXXXXXXXXXXXXXXGGLNTTLPFQNVSKYAFGNCSKYXXXKSLKLAVGLRNVXXXXXRGLFGAIAGFIEGGWSGLVAGWYGFQHSNDQGVGMAADXXXXXXXXXXXXXKVNNIVDKXXXXXXXXXXXXXXXXXXXXXXXNKIDDQIQDIWAYNAELLVLLENQKTLDEHDANVNNLYNKVKXXXXXXXXEDGKGCFELYHKCDDXCMETIRNGTYNXXXXXXXXXXXXXXXXXXXXXSEGTYKILTIYSTVASSLVXXXXXAAFLFWAMSXXXXXXXXXX

SEQ ID NO: 418662 - protein, 562 aa, Influenza virus
  MOD_RES (1)..(25): Any amino acid
  MOD_RES (39)..(50): Any amino acid
  MOD_RES (65)..(76): Any amino acid
  MOD_RES (89)..(94): Any amino acid
  MOD_RES (106)..(155): Any amino acid
  MOD_RES (166)..(237): Any amino acid
  MOD_RES (269)..(296): Any amino acid
  MOD_RES (320)..(322): Any amino acid
  MOD_RES (335)..(347): Any amino acid
  MOD_RES (378)..(390): Any amino acid
  MOD_RES (399)..(421): Any amino acid
  MOD_RES (464)..(471): Any amino acid
  MOD_RES (487)..(487): Any amino acid
  MOD_RES (499)..(519): Any amino acid
  MOD_RES (539)..(543): Any amino acid
  MOD_RES (553)..(562): Any amino acid
XXXXXXXXXXXXXXXXXXXXXXXXXGHQSTNSTEAVDTXXXXXXXXXXXXELLQTEHNGILCATXXXXXXXXXXXXIEGLVYGNPSCDXXXXXXKWSYIVERSSAXXXXXXXXXXXXXXXXXXXXXXXXXXXXXXXXXXXXXXXXXXXXXXXXXXSFYRNMRWLTXXXXXXXXXXXXXXXXXXXXXXXXXXXXXXXXXXXXXXXXXXXXXXXXXXXXXXXXXXXXXXXXXXXXXXXXGRINYYWSILKPGQTLRVRSNGNLIAPLYGHXXXXXXXXXXXXXXXXXXXXXXXXXXXXGGLNSTLPFHNVSKYAFGTCPKYXXXKSLKLAIGLRNVXXXXXXXXXXXXXGFIEGGWPGLVAGWYGFQHSNAQGTGMAADXXXXXXXXXXXXXKVNNIIDKXXXXXXXXXXXXXXXXXXXXXXXDKIDDQIQNIWAYNAELLVLLGNQKTLDEHEANVNNLYKKVKXXXXXXXXEDGNGCFELYHRCDDXCMATIRNGTYDXXXXXXXXXXXXXXXXXXXXXFEGTYKILTIYSTAASSLVXXXXXAAFMFWAMSXXXXXXXXXX

SEQ ID NO: 418663 - protein, 562 aa, Influenza virus
  MOD_RES (1)..(25): Any amino acid
  MOD_RES (39)..(50): Any amino acid
  MOD_RES (65)..(76): Any amino acid
  MOD_RES (89)..(94): Any amino acid
  MOD_RES (106)..(155): Any amino acid
  MOD_RES (164)..(237): Any amino acid
  MOD_RES (269)..(296): Any amino acid
  MOD_RES (316)..(322): Any amino acid
  MOD_RES (335)..(350): Any amino acid
  MOD_RES (378)..(390): Any amino acid
  MOD_RES (399)..(421): Any amino acid
  MOD_RES (439)..(439): Any amino acid
  MOD_RES (464)..(471): Any amino acid
  MOD_RES (487)..(487): Any amino acid
  MOD_RES (499)..(519): Any amino acid
  MOD_RES (539)..(543): Any amino acid
  MOD_RES (553)..(562): Any amino acid
XXXXXXXXXXXXXXXXXXXXXXXXXGYLSTNSTETVNTXXXXXXXXXXXXELLNTEHNGVLCATXXXXXXXXXXXXVEGLIYGNPSCNXXXXXXDWSYIVERPTAXXXXXXXXXXXXXXXXXXXXXXXXXXXXXXXXXXXXXXXXXXXXXXXXXXTFYRNMRWXXXXXXXXXXXXXXXXXXXXXXXXXXXXXXXXXXXXXXXXXXXXXXXXXXXXXXXXXXXXXXXXXXXXXXXXXXGRIDYYWAVLKPGQTLRVKSNGNLIAPWFGHXXXXXXXXXXXXXXXXXXXXXXXXXXXXSGLNTTLPFHNISKYAFGTXXXXXXXNSLKLAVGMRNVXXXXXXXXXXXXXXXXEGGWSGLIAGWYGFQHSNEQGVGIAADXXXXXXXXXXXXXKVNSIVDKXXXXXXXXXXXXXXXXXXXXXXXNKVDDQIQDVWAYNAELXVLIENQKTLDEHVANVNNLYNRVKXXXXXXXXEDGKGCFDLYHKCDNXCMGTIRNGTYSXXXXXXXXXXXXXXXXXXXXXSEGIYKILTIYSTVASSIVXXXXXAAFLFWVMSXXXXXXXXXX

SEQ ID NO: 418664 - protein, 562 aa, Influenza virus
  MOD_RES (1)..(25): Any amino acid
  MOD_RES (39)..(50): Any amino acid
  MOD_RES (64)..(76): Any amino acid
  MOD_RES (89)..(94): Any amino acid
  MOD_RES (103)..(155): Any amino acid
  MOD_RES (166)..(237): Any amino acid
  MOD_RES (269)..(296): Any amino acid
  MOD_RES (320)..(322): Any amino acid
  MOD_RES (331)..(361): Any amino acid
  MOD_RES (378)..(390): Any amino acid
  MOD_RES (399)..(421): Any amino acid
  MOD_RES (439)..(445): Any amino acid
  MOD_RES (464)..(472): Any amino acid
  MOD_RES (487)..(487): Any amino acid
  MOD_RES (497)..(519): Any amino acid
  MOD_RES (539)..(543): Any amino acid
  MOD_RES (553)..(562): Any amino acid
XXXXXXXXXXXXXXXXXXXXXXXXXVHQSTNSTETVYTXXXXXXXXXXXXELLHAEHNGLLCAXXXXXXXXXXXXXVEGLVYGNPACDXXXXXXGWSYIVERXXXXXXXXXXXXXXXXXXXXXXXXXXXXXXXXXXXXXXXXXXXXXXXXXXXXXSFYRGMRWLTXXXXXXXXXXXXXXXXXXXXXXXXXXXXXXXXXXXXXXXXXXXXXXXXXXXXXXXXXXXXXXXXXXXXXXXXGRIDYYWPVLKPGQTLRVRSDGNLIAPWYGYXXXXXXXXXXXXXXXXXXXXXXXXXXXXGGLNTILPFHNVSRYAFGNCPKYXXXNSLKLAIGXXXXXXXXXXXXXXXXXXXXXXXXXXXXXXXYGFQHTNDQGIGMAADXXXXXXXXXXXXXKVNNMVDKXXXXXXXXXXXXXXXXXXXXXXXDKVDDQIQDLWAYNAELXXXXXXXKPLDEHDANANNLYNKVRXXXXXXXXXNGNGCFELYHKCNDXCMEAIRNGTXXXXXXXXXXXXXXXXXXXXXXXSEETYKILTIYSTVASSFVXXXXXAAFLFWTMSXXXXXXXXXX

SEQ ID NO: 418665 - protein, 562 aa, Influenza virus
  MOD_RES (1)..(30): Any amino acid
  MOD_RES (39)..(50): Any amino acid
  MOD_RES (59)..(97): Any amino acid
  MOD_RES (106)..(155): Any amino acid
  MOD_RES (166)..(241): Any amino acid
  MOD_RES (263)..(296): Any amino acid
  MOD_RES (319)..(322): Any amino acid
  MOD_RES (335)..(369): Any amino acid
  MOD_RES (378)..(390): Any amino acid
  MOD_RES (399)..(421): Any amino acid
  MOD_RES (431)..(445): Any amino acid
  MOD_RES (464)..(478): Any amino acid
  MOD_RES (487)..(489): Any amino acid
  MOD_RES (499)..(519): Any amino acid
  MOD_RES (539)..(543): Any amino acid
  MOD_RES (552)..(562): Any amino acid
XXXXXXXXXXXXXXXXXXXXXXXXXXXXXXNSPETVDTXXXXXXXXXXXXELLHTGHNXXXXXXXXXXXXXXXXXXXXXXXXXXXXXXXXXXXXXXXYIIERPSAXXXXXXXXXXXXXXXXXXXXXXXXXXXXXXXXXXXXXXXXXXXXXXXXXXSFYKSMRWLTXXXXXXXXXXXXXXXXXXXXXXXXXXXXXXXXXXXXXXXXXXXXXXXXXXXXXXXXXXXXXXXXXXXXXXXXXXXXYYWSVLRPGQTLRIRSNGNLVXXXXXXXXXXXXXXXXXXXXXXXXXXXXXXXXXXGGLNITLPFQNISKYAFGNCPMXXXXRSLKLAVGLKNVXXXXXXXXXXXXXXXXXXXXXXXXXXXXXXXXXXXQGAGMAADXXXXXXXXXXXXXKVDNIVDKXXXXXXXXXXXXXXXXXXXXXXXNKIEDQIQDXXXXXXXXXXXXXXXKTLDEHDSNVHNLYNKVKXXXXXXXXXXXXXXXELYHKCDNXXXETTRNGTYNXXXXXXXXXXXXXXXXXXXXXSEGAYKILTIYSTVASPLVXXXXXTAFLFWAMXXXXXXXXXXX

SEQ ID NO: 418666 - protein, 562 aa, Influenza virus
  MOD_RES (1)..(156): Any amino acid
  MOD_RES (166)..(244): Any amino acid
  MOD_RES (253)..(255): Any amino acid
  MOD_RES (266)..(299): Any amino acid
  MOD_RES (320)..(326): Any amino acid
  MOD_RES (335)..(446): Any amino acid
  MOD_RES (455)..(544): Any amino acid
  MOD_RES (553)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFYRSVRWLTXXXXXXXXXXXXXXXXXXXXXXXXXXXXXXXXXXXXXXXXXXXXXXXXXXXXXXXXXXXXXXXXXXXXXXXXXXXXXXXSLLKPGQTXXXRSNENLIAPWXXXXXXXXXXXXXXXXXXXXXXXXXXXXXXXXXXNTTLPFQDISKYAFGICPKYXXXXXXXLAVGLRNLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLDEHDTNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAFFFWAMSXXXXXXXXXX

SEQ ID NO: 418667 - protein, 562 aa, Influenza virus
  MOD_RES (1)..(302): Any amino acid
  MOD_RES (320)..(448): Any amino acid
  MOD_RES (461)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPFQNVSRYAFGNRSKYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDEHDANVHNLYNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418668 - protein, 562 aa, Influenza virus
  MOD_RES (1)..(451): Any amino acid
  MOD_RES (461)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDANVNKLYNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418669 - protein, 473 aa, Influenza virus
  MOD_RES (1)..(8): Any amino acid
  MOD_RES (17)..(51): Any amino acid
  MOD_RES (62)..(90): Any amino acid
  MOD_RES (108)..(108): Any amino acid
  MOD_RES (130)..(131): Any amino acid
  MOD_RES (145)..(157): Any amino acid
  MOD_RES (174)..(174): Any amino acid
  MOD_RES (203)..(224): Any amino acid
  MOD_RES (252)..(273): Any amino acid
  MOD_RES (289)..(292): Any amino acid
  MOD_RES (307)..(319): Any amino acid
  MOD_RES (333)..(350): Any amino acid
  MOD_RES (360)..(362): Any amino acid
  MOD_RES (371)..(420): Any amino acid
  MOD_RES (436)..(438): Any amino acid
  MOD_RES (448)..(449): Any amino acid
  MOD_RES (469)..(473): Any amino acid
XXXXXXXXIAIGSVSRXXXXXXXXXXXXXXXXXXXXXXXXXXXXXXXXXXXVPLVPCEPIIXXXXXXXXXXXXXXXXXXXXXXXXXXXXXWSKPQCQITGFAPFSKDXSIRLSAGGDIWVTREPYVSCGXXKCYQFALGQGTTLXXXXXXXXXXXXXPHRTLLMNELGVPFHLXTKQVCIAWSSSSCHDGKAWLHVCVTGDDXXXXXXXXXXXXXXXXXXXXXXNILRTQESECVCINGTCTVVMTDGSASXXXXXXXXXXXXXXXXXXXXXXGSAQHVEECSCYPRYXXXXCVCRDNWKGSNRPVXXXXXXXXXXXXXYVCSGLVGDTPRNXXXXXXXXXXXXXXXXXXPGVKGWAFDXXXDIWMGRTIXXXXXXXXXXXXXXXXXXXXXXXXXXXXXXXXXXXXXXXXXXXXXXXXXXCINRCFYVELIRGRPXXXRVWWTSNSIXXFCGTSGTYGTGSWPDGANIXXXXX

SEQ ID NO: 418670 - protein, 473 aa, Influenza virus
  MOD_RES (1)..(90): Any amino acid
  MOD_RES (108)..(108): Any amino acid
  MOD_RES (130)..(131): Any amino acid
  MOD_RES (145)..(157): Any amino acid
  MOD_RES (173)..(174): Any amino acid
  MOD_RES (203)..(224): Any amino acid
  MOD_RES (252)..(273): Any amino acid
  MOD_RES (289)..(292): Any amino acid
  MOD_RES (307)..(319): Any amino acid
  MOD_RES (333)..(350): Any amino acid
  MOD_RES (359)..(362): Any amino acid
  MOD_RES (371)..(420): Any amino acid
  MOD_RES (436)..(438): Any amino acid
  MOD_RES (448)..(449): Any amino acid
  MOD_RES (466)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWLKPQCQITGSAPFSKGXSIRLSASGDIWLTREPYVSCSXXNCYQFALGHGTTLXXXXXXXXXXXXXPYRTLLMSELGVPFHXXTKQVCMAWSSSSCYDGKAWLHICVTGDDXXXXXXXXXXXXXXXXXXXXXXSILRTQESECICINGTCAVVMTDGSSSXXXXXXXXXXXXXXXXXXXXXXGSAQHIEECSCYPQYXXXXCVCRDNWRGSNRPVXXXXXXXXXXXXXYLCSGLVGDTPRSXXXXXXXXXXXXXXXXXXSGVKGWAFXXXXDVWMGRTIXXXXXXXXXXXXXXXXXXXXXXXXXXXXXXXXXXXXXXXXXXXXXXXXXXCVNRCFYVELVRGRPXXXKVWWTSNSLXXFCGTSGSYGTGSWPDEXXXXXXXX

SEQ ID NO: 418671 - protein, 473 aa, Influenza virus
  MOD_RES (1)..(90): Any amino acid
  MOD_RES (108)..(108): Any amino acid
  MOD_RES (130)..(131): Any amino acid
  MOD_RES (144)..(157): Any amino acid
  MOD_RES (174)..(174): Any amino acid
  MOD_RES (203)..(224): Any amino acid
  MOD_RES (249)..(273): Any amino acid
  MOD_RES (289)..(292): Any amino acid
  MOD_RES (307)..(319): Any amino acid
  MOD_RES (333)..(351): Any amino acid
  MOD_RES (360)..(362): Any amino acid
  MOD_RES (371)..(426): Any amino acid
  MOD_RES (436)..(438): Any amino acid
  MOD_RES (448)..(449): Any amino acid
  MOD_RES (469)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSKPQCLITGFAPFTKDXSVRLSAGGSIWVNREPYVSCDXXRCYQFALGQGATXXXXXXXXXXXXXXPHRTLLMSELGVPLHLXTQQVCIAWSSASCHDGRAWLHVCITGDDXXXXXXXXXXXXXXXXXXXXXXTILRTQESECVGISGTCAVVMTVGXXXXXXXXXXXXXXXXXXXXXXXXXGNAQHVEECSCYPSYXXXXCVYRDNWKGSNRPIXXXXXXXXXXXXXYACSGLVGDTPRDXXXXXXXXXXXXXXXXXXXGVKGWGFDXXXDLWMGRTIXXXXXXXXXXXXXXXXXXXXXXXXXXXXXXXXXXXXXXXXXXXXXXXXXXXXXXXXYVELIRGKPXXXRVWWTANSIXXFCGTTGTYGTGSWADGANIXXXXX

SEQ ID NO: 418672 - protein, 473 aa, Influenza virus
  MOD_RES (1)..(91): Any amino acid
  MOD_RES (108)..(108): Any amino acid
  MOD_RES (130)..(131): Any amino acid
  MOD_RES (140)..(157): Any amino acid
  MOD_RES (174)..(174): Any amino acid
  MOD_RES (203)..(224): Any amino acid
  MOD_RES (252)..(273): Any amino acid
  MOD_RES (289)..(292): Any amino acid
  MOD_RES (301)..(324): Any amino acid
  MOD_RES (333)..(362): Any amino acid
  MOD_RES (371)..(438): Any amino acid
  MOD_RES (447)..(449): Any amino acid
  MOD_RES (466)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKPQCQIAGFAPLSKDXSIRLAAAGDIWITREPYVSCNXXTCYQFALGXXXXXXXXXXXXXXXXXXSYRTLLMSELGVPFNLXTRQVCIAWSSSSCHDGRAWLHVCVSGDDXXXXXXXXXXXXXXXXXXXXXXNILITQESECVCISGTCTAVMTDGSATXXXXXXXXXXXXXXXXXXXXXXGGAQHVEECSCYPRHXXXXCDCRDNWKXXXXXXXXXXXXXXXXXXXXXXXXLVGDTPRTXXXXXXXXXXXXXXXXXXXXXXXXXXXXXXDAWMGRTIXXXXXXXXXXXXXXXXXXXXXXXXXXXXXXXXXXXXXXXXXXXXXXXXXXXXXXXXXXXXXXXXXXXXIVWWTSNSXXXFCGTPGTYGTGPWPDGXXXXXXXX

SEQ ID NO: 418673 - protein, 473 aa, Influenza virus
  MOD_RES (1)..(94): Any amino acid
  MOD_RES (108)..(110): Any amino acid
  MOD_RES (128)..(163): Any amino acid
  MOD_RES (173)..(174): Any amino acid
  MOD_RES (183)..(186): Any amino acid
  MOD_RES (203)..(229): Any amino acid
  MOD_RES (252)..(273): Any amino acid
  MOD_RES (289)..(298): Any amino acid
  MOD_RES (307)..(438): Any amino acid
  MOD_RES (448)..(449): Any amino acid
  MOD_RES (469)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQCQITGFVPFSKDXXXRLSAGGGIWVTRDPYVSXXXXXXXXXXXXXXXXXXXXXXXXXXXXXXXXXXXXMNELGVPLHXXTKQVFIAWXXXXCHDGKEWLHACVTGDDXXXXXXXXXXXXXXXXXXXXXXXXXXXQGSECVCIDGTCTVVMTDGGASXXXXXXXXXXXXXXXXXXXXXXGSAKHVEECSCYPQHXXXXXXXXXXGKGSNRPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRVLWTSNSIXXFCGTSGTCGAGSWPDGADIXXXXX

SEQ ID NO: 418674 - protein, 473 aa, Influenza virus
  MOD_RES (1)..(164): Any amino acid
  MOD_RES (173)..(175): Any amino acid
  MOD_RES (184)..(193): Any amino acid
  MOD_RES (202)..(230): Any amino acid
  MOD_RES (248)..(452): Any amino acid
  MOD_RES (469)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNELGVPFNXXXKQVCRAGSXXXXXXXXXXLHICVSGDXXXXXXXXXXXXXXXXXXXXXXXXXXXXXESECVCIDGICTVVMTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSGTYGAGSWPDGANVXXXXX

SEQ ID NO: 418675 - protein, 473 aa, Influenza virus
  MOD_RES (1)..(230): Any amino acid
  MOD_RES (246)..(454): Any amino acid
  MOD_RES (467)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYECVCINGICTVVMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTHGTGSWPDRAXXXXXXX

SEQ ID NO: 418676 - protein, 473 aa, Influenza virus
  MOD_RES (1)..(239): Any amino acid
  MOD_RES (248)..(458): Any amino acid
  MOD_RES (467)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSCTVVMTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGSCHDGAXXXXXXX

SEQ ID NO: 418677 - protein, 473 aa, Influenza virus
  MOD_RES (1)..(241): Any amino acid
  MOD_RES (250)..(460): Any amino acid
  MOD_RES (469)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVVMTDGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWPDGGNIXXXXX

SEQ ID NO: 418678 - protein, 473 aa, Influenza virus
  MOD_RES (1)..(241): Any amino acid
  MOD_RES (250)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVVLTDGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418679 - protein, 275 aa, Influenza virus
  MOD_RES (143)..(145): Any amino acid
  MOD_RES (210)..(211): Any amino acid
  MOD_RES (227)..(233): Any amino acid
MLKMSLLTEVETYVLSIVPSGPLKAEIAQRLEDVFAGKNTDLEALMEWLKTRPILSPLTKGILGFVFTLTVPSERGLQRRRFVQNALNGNGDPNNMDRAVKLYRKLKREITFHGAKEVALSYSTGALASCMGLIYNRMGTVTXXXAFGLVCATCEQIADSQHRSHRQMVTTTNPLIRHENRMVLASTTAKAMEQMAGSSEQAAEAMEVAXXARQMVQAMRTIGTHPXXXXXXXDDLLENLQAYQKRMGVQMQRFKRPDSSWLFGGWNLALDIVDS

SEQ ID NO: 418680 - protein, 275 aa, Influenza virus
  MOD_RES (1)..(10): Any amino acid
  MOD_RES (70)..(75): Any amino acid
  MOD_RES (132)..(132): Any amino acid
  MOD_RES (143)..(145): Any amino acid
  MOD_RES (185)..(187): Any amino acid
  MOD_RES (210)..(211): Any amino acid
  MOD_RES (227)..(233): Any amino acid
  MOD_RES (256)..(256): Any amino acid
  MOD_RES (273)..(275): Any amino acid
XXXXXXXXXXETYVLSIIPSGPLKAEIAQKLEDVFAGKNADLEALMEWIKTRPILSPLTKGMLGFVFTLXXXXXXGLQRRRFIQNALNGNGDPNNMDKAVKLYRKLKREMTFHGAKEIALSYSAGALASCMXLIYNRMGAVTXXXAFGLICATCEQIADAQHRSHRQMAATTNPLIKHENRMVLXXXTAKAMEQVAGSSEQAAEAIEVAXXTRQMVHAMRTIGTQPXXXXXXXDNLLENLQAYQKRMGLQMQRFKXSSRHCSKYHWNLALDIXXX

SEQ ID NO: 418681 - protein, 275 aa, Influenza virus
  MOD_RES (1)..(10): Any amino acid
  MOD_RES (19)..(25): Any amino acid
  MOD_RES (48)..(58): Any amino acid
  MOD_RES (67)..(80): Any amino acid
  MOD_RES (127)..(133): Any amino acid
  MOD_RES (143)..(145): Any amino acid
  MOD_RES (169)..(169): Any amino acid
  MOD_RES (192)..(199): Any amino acid
  MOD_RES (208)..(211): Any amino acid
  MOD_RES (227)..(233): Any amino acid
  MOD_RES (256)..(275): Any amino acid
XXXXXXXXXXETYVLSVIXXXXXXXEIAQRLESVFAGKNSDLEALMEXXXXXXXXXXXTKGVLGFVXXXXXXXXXXXXXXRFVQNALSGNGDPNNMARAVKLYKKLKREITFHGAKEVSLSYSTGAXXXXXXXIYNRMGTITXXXALGLVCATCEQIADSHHRSHRQMXTITNPLIRHENRMVIASTTAKAXXXXXXXXEQAAEAMDXXXXARRMVQAMRAIGTHPXXXXXXXNDLLENLQTYQKRMGVQLQRFKXXXXXXXXXXXXXXXXXXXX

SEQ ID NO: 418682 - protein, 275 aa, Influenza virus
  MOD_RES (1)..(25): Any amino acid
  MOD_RES (47)..(91): Any amino acid
  MOD_RES (122)..(134): Any amino acid
  MOD_RES (143)..(155): Any amino acid
  MOD_RES (178)..(200): Any amino acid
  MOD_RES (210)..(211): Any amino acid
  MOD_RES (227)..(233): Any amino acid
  MOD_RES (256)..(275): Any amino acid
XXXXXXXXXXXXXXXXXXXXXXXXXEIAQRLEGVFAGKNTDLEVLMXXXXXXXXXXXXXXXXXXXXXXXXXXXXXXXXXXXXXXXXXXXXXDPSNMDRAVKLYKKLKREMTFHGAKEISLSXXXXXXXXXXXXXYNRMGTVAXXXXXXXXXXXXXQIADSQHKSHRQMVATTNPLIRXXXXXXXXXXXXXXXXXXXXXXXQAAEAMEIAXXARQMVHAMRTVGTHPXXXXXXXDDLIENLQAYQKRMGVQIQRFKXXXXXXXXXXXXXXXXXXXX

SEQ ID NO: 418683 - protein, 275 aa, Influenza virus
  MOD_RES (1)..(25): Any amino acid
  MOD_RES (40)..(96): Any amino acid
  MOD_RES (106)..(113): Any amino acid
  MOD_RES (129)..(211): Any amino acid
  MOD_RES (227)..(233): Any amino acid
  MOD_RES (256)..(275): Any amino acid
XXXXXXXXXXXXXXXXXXXXXXXXXEIAQRLENVFAGKNXXXXXXXXXXXXXXXXXXXXXXXXXXXXXXXXXXXXXXXXXXXXXXXXXXXXXXXXXDKAVKLYKKXXXXXXXXGAKEVALGYSTGALAXXXXXXXXXXXXXXXXXXXXXXXXXXXXXXXXXXXXXXXXXXXXXXXXXXXXXXXXXXXXXXXXXXXXXXXXXXXXXXXXXXXTRQMVQAMRAVGTHPXXXXXXXNDLLDNLQAYQKRMGVQMHRFKXXXXXXXXXXXXXXXXXXXX

SEQ ID NO: 418684 - protein, 275 aa, Influenza virus
  MOD_RES (1)..(116): Any amino acid
  MOD_RES (126)..(214): Any amino acid
  MOD_RES (225)..(248): Any amino acid
  MOD_RES (263)..(275): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVALSYSAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMVQAMRTVGTXXXXXXXXXXXXXXXXXXXXXXXXVQMQRFRRPDSSWLXXXXXXXXXXXXX

SEQ ID NO: 418685 - protein, 99 aa, Influenza virus
  MOD_RES (12)..(34): Any amino acid
  MOD_RES (44)..(67): Any amino acid
  MOD_RES (82)..(91): Any amino acid
MSLLTEVETPTXXXXXXXXXXXXXXXXXXXXXXXGILHLILWIXXXXXXXXXXXXXXXXXXXXXXXXGVPESMREEYRQEQXXXXXXXXXXFVSIELEG

SEQ ID NO: 418686 - protein, 99 aa, Influenza virus
  MOD_RES (1)..(2): Any amino acid
  MOD_RES (12)..(34): Any amino acid
  MOD_RES (44)..(67): Any amino acid
  MOD_RES (82)..(91): Any amino acid
XXLLTEVETLTXXXXXXXXXXXXXXXXXXXXXXXGIVHLILWIXXXXXXXXXXXXXXXXXXXXXXXXGVPKSMREEYRKEQXXXXXXXXXXFVNIELED

SEQ ID NO: 418687 - protein, 99 aa, Influenza virus
  MOD_RES (1)..(2): Any amino acid
  MOD_RES (12)..(34): Any amino acid
  MOD_RES (44)..(67): Any amino acid
  MOD_RES (82)..(99): Any amino acid
XXLLTEVETHTXXXXXXXXXXXXXXXXXXXXXXXGVLHLILWIXXXXXXXXXXXXXXXXXXXXXXXXGIPESMREEYQQEQXXXXXXXXXXXXXXXXXX

SEQ ID NO: 418688 - protein, 99 aa, Influenza virus
  MOD_RES (1)..(2): Any amino acid
  MOD_RES (12)..(35): Any amino acid
  MOD_RES (44)..(67): Any amino acid
  MOD_RES (82)..(99): Any amino acid
XXQLTEVETPIXXXXXXXXXXXXXXXXXXXXXXXXILHLVLWIXXXXXXXXXXXXXXXXXXXXXXXXGMPESMREEYREEQXXXXXXXXXXXXXXXXXX

SEQ ID NO: 418689 - protein, 99 aa, Influenza virus
  MOD_RES (1)..(9): Any amino acid
  MOD_RES (18)..(72): Any amino acid
  MOD_RES (82)..(99): Any amino acid
XXXXXXXXXRPTRNGWGXXXXXXXXXXXXXXXXXXXXXXXXXXXXXXXXXXXXXXXXXXXXXXXXXXXXXXXMREEYRQKQXXXXXXXXXXXXXXXXXX

SEQ ID NO: 418690 - protein, 527 aa, Influenza virus
  MOD_RES (33)..(34): Any amino acid
  MOD_RES (116)..(121): Any amino acid
  MOD_RES (146)..(146): Any amino acid
  MOD_RES (305)..(305): Any amino acid
  MOD_RES (328)..(335): Any amino acid
  MOD_RES (367)..(375): Any amino acid
  MOD_RES (394)..(397): Any amino acid
  MOD_RES (445)..(452): Any amino acid
  MOD_RES (477)..(480): Any amino acid
SKSRVDNHSMSDIEAMASQGTKRSYEQMETGGXXRQNATEIRASVGRMVGGIGRFYIQMCTELKLSDYEGRLIQNSITIERMVLSAFDERRNKYLEEHPSAGKDPKKTGGPIYRRXXXXXXRELILYDKEEIRRIWRQANNGEDAXAGLTHIMIWHSNLNDATYQRTRALVRTGMDPRMCSLMQGSTLPRRSGAAGAAVKGVGTMVMELIRMIKRGINDRNFWRGENGRRTRIAYERMCNILKGKFQTAAAQRAMMDQVRESRNPGNAEIEDLIFLARSALILRGRGSVAHKSCLPACVYGLAVXSGYDFEREGYSLVGIDPFKLLQXXXXXXXXSLIRPNENPAHKSQLVWMACHSAAFEDLRVSXXXXXXXXXPRGKLSTRGVQIASNENMXXXXSSTLELRSRYWAIRTRSGGNTNQQRASAGQISVQPTFSVQRNLPFERXXXXXXXXGNTEGRTSDMRTEIIRIIIRMMENXXXXDVSFQGRGVFELSSDEKATNPIVPSFDMSNEGSYFFGDNAEEYRRLR

SEQ ID NO: 418691 - protein, 527 aa, Influenza virus
  MOD_RES (1)..(9): Any amino acid
  MOD_RES (33)..(34): Any amino acid
  MOD_RES (116)..(121): Any amino acid
  MOD_RES (146)..(146): Any amino acid
  MOD_RES (181)..(191): Any amino acid
  MOD_RES (241)..(242): Any amino acid
  MOD_RES (305)..(305): Any amino acid
  MOD_RES (328)..(335): Any amino acid
  MOD_RES (367)..(375): Any amino acid
  MOD_RES (394)..(397): Any amino acid
  MOD_RES (445)..(452): Any amino acid
  MOD_RES (469)..(480): Any amino acid
  MOD_RES (523)..(527): Any amino acid
XXXXXXXXXMSDINIMASQGTKRPYEQMETDGXXRQDATEIRSSVGKMIDGIGRFYIQMCTELQLSDYDGRLIQNSLTIEKMVLSAFDERRNRYLEEHPSTGKDPKKTGGPIYKRXXXXXXRELVLYDKEEIRRVWRQANNGDDAXAGLTHLMIWHSNLNDTTYQRTRALVRSGMDPRMCXXXXXXXXXXXSGAAGAAIKGVGTMAMELIRMIKRGVNDRNFWRGDNGRRTRVAYERMCNXXSKGSSKQQAQRAMVDQVRESRSPGNAEIEDLTFLARSALALILRGSVAHKSCLPACAYGPAVXSGHDFEREGYSLVGVDPFKLLQXXXXXXXXSLMRPNENPVHKSQLIWMACHSAAFEDLRLLXXXXXXXXXPRGQLSTRGVQVASNENMXXXXSNTLELRSGYWAIRTRSGGNTSQQKASAGQISTQPTFSVQRSLPFERXXXXXXXXGNNEGRTSDMRAEIIRXXXXXXXXXXXXDLSFQGRGVFEFSSDERATNPVVPSFDMSKEGSYFFGDNAKEXXXXX

SEQ ID NO: 418692 - protein, 527 aa, Influenza virus
  MOD_RES (1)..(9): Any amino acid
  MOD_RES (33)..(34): Any amino acid
  MOD_RES (58)..(58): Any amino acid
  MOD_RES (83)..(92): Any amino acid
  MOD_RES (116)..(121): Any amino acid
  MOD_RES (146)..(146): Any amino acid
  MOD_RES (160)..(194): Any amino acid
  MOD_RES (221)..(222): Any amino acid
  MOD_RES (241)..(243): Any amino acid
  MOD_RES (305)..(305): Any amino acid
  MOD_RES (328)..(335): Any amino acid
  MOD_RES (367)..(375): Any amino acid
  MOD_RES (394)..(397): Any amino acid
  MOD_RES (445)..(452): Any amino acid
  MOD_RES (469)..(480): Any amino acid
  MOD_RES (493)..(493): Any amino acid
  MOD_RES (524)..(527): Any amino acid
XXXXXXXXXMSDIEIMASQGTKRSHEQMETGGXXRQNANEIRASVGKMISGIGRFYIXMCTELKLNDHEGRLIQNSMTIERMXXXXXXXXXXKYLEEHPNAGKDPKKTGGPIYKKXXXXXXRELILHDKEEIMRIWRQANNGEEAXAGLTHMMIWHSNLXXXXXXXXXXXXXXXXXXXXXXXXXXXXXXXXXXXAGAAVKGIGTMVMELIRMVKRGINDRXXWRGENGRKTRSAYERMCNXXXKGKFQTAAQRAMMDQVREGRNPGNAEIEDLIFSARSALILILRGSIAHKSCLPACIYGLVVXSGYDFEKEGYSLVGIDPFRLLQXXXXXXXXSLIRPKENPAHKSQLIWMACNSAAFEDLRISXXXXXXXXXPRGQLATRGVQIASNENVXXXXSITLELRSKYWAIRTRSGGNNNQQRSSAGQTSVQPAFSVQRNLPFDKXXXXXXXXGNAEGRTSDMRTEVIRXXXXXXXXXXXXEVSFRGRGVFELXSDEKATSPIVPSFDMNNEGSYFFGDSAEEYXXXX

SEQ ID NO: 418693 - protein, 527 aa, Influenza virus
  MOD_RES (1)..(10): Any amino acid
  MOD_RES (20)..(23): Any amino acid
  MOD_RES (32)..(34): Any amino acid
  MOD_RES (83)..(92): Any amino acid
  MOD_RES (106)..(121): Any amino acid
  MOD_RES (146)..(146): Any amino acid
  MOD_RES (155)..(197): Any amino acid
  MOD_RES (215)..(230): Any amino acid
  MOD_RES (241)..(245): Any amino acid
  MOD_RES (261)..(268): Any amino acid
  MOD_RES (292)..(294): Any amino acid
  MOD_RES (305)..(305): Any amino acid
  MOD_RES (317)..(318): Any amino acid
  MOD_RES (328)..(335): Any amino acid
  MOD_RES (348)..(348): Any amino acid
  MOD_RES (367)..(375): Any amino acid
  MOD_RES (394)..(397): Any amino acid
  MOD_RES (406)..(410): Any amino acid
  MOD_RES (431)..(436): Any amino acid
  MOD_RES (445)..(452): Any amino acid
  MOD_RES (469)..(480): Any amino acid
  MOD_RES (515)..(515): Any amino acid
  MOD_RES (524)..(527): Any amino acid
XXXXXXXXXXSDIEAMATQXXXXSYEQMETDXXXRQNTTEIRASVGRMIGGIGRFYVQMCTELKLSENEGRLIQNSLTIERMXXXXXXXXXXRYLEENPSAGKDPXXXXXXXXXXXXXXXXRELTLYDKEEVRRIWRQANNGEDSXSGLTHIMIXXXXXXXXXXXXXXXXXXXXXXXXXXXXXXXXXXXXXXXXXXXAVKGVGTIVLELIRMIKXXXXXXXXXXXXXXXXTRTAYERMCNXXXXXKFQTAAQKAMMDQVRXXXXXXXXEIEDLIFMARSALILILRGAVAHXXXLPACVYGPAVXSGYNFEKEGYSXXGVDPFRLLQXXXXXXXXSLIRSNENPAHKXQLVWMACNSAAFEDLRVLXXXXXXXXXPRGRLSTRGIQIASNENTXXXXSGTLELRSXXXXXRTKSGGNTNQHRASAGQTSVXXXXXXQRNLPFEKXXXXXXXXGNSEGRTSDMRAEIIKXXXXXXXXXXXXEVSFQGRGGVFELSDEKATNPIVPSFEMSNEGSYXFGDNAEEFXXXX

SEQ ID NO: 418694 - protein, 527 aa, Influenza virus
  MOD_RES (1)..(11): Any amino acid
  MOD_RES (22)..(23): Any amino acid
  MOD_RES (33)..(34): Any amino acid
  MOD_RES (43)..(49): Any amino acid
  MOD_RES (62)..(67): Any amino acid
  MOD_RES (76)..(77): Any amino acid
  MOD_RES (87)..(95): Any amino acid
  MOD_RES (108)..(122): Any amino acid
  MOD_RES (137)..(205): Any amino acid
  MOD_RES (218)..(230): Any amino acid
  MOD_RES (241)..(248): Any amino acid
  MOD_RES (258)..(269): Any amino acid
  MOD_RES (278)..(278): Any amino acid
  MOD_RES (290)..(295): Any amino acid
  MOD_RES (305)..(305): Any amino acid
  MOD_RES (314)..(320): Any amino acid
  MOD_RES (333)..(375): Any amino acid
  MOD_RES (394)..(412): Any amino acid
  MOD_RES (421)..(421): Any amino acid
  MOD_RES (433)..(452): Any amino acid
  MOD_RES (469)..(480): Any amino acid
  MOD_RES (500)..(504): Any amino acid
  MOD_RES (515)..(527): Any amino acid
XXXXXXXXXXXDIGAMASQGTXXSYEQMETSGXXRQNASEIRXXXXXXXGGIGKFYIQMCTXXXXXXQEGRLIQNXXTVERMVLSAXXXXXXXXXEEHPSAGRDPKKXXXXXXXXXXXXXXXELILYDKDEIRRIWXXXXXXXXXXXXXXXXXXXXXXXXXXXXXXXXXXXXXXXXXXXXXXXXXXXXXXXXXXXXXXXXXXXXXVMELVRMIKRGIXXXXXXXXXXXXXTRGAYERMCNXXXXXXXXTAAQRAMVDXXXXXXXXXXXXIEDLIFLTXSASALILRGSIXXXXXXPACVYGLVVXGGYDFEREXXXXXXXDPDPFRLLQNSQXXXXXXXXXXXXXXXXXXXXXXXXXXXXXXXXXXXXXXXXXXXPRGQLTTRGVQIASNENIXXXXXXXXXXXXXXXXXXXRSGGNTNHXRASAGQVSVQPXXXXXXXXXXXXXXXXXXXXGNPEGRTSDMRTEIIKXXXXXXXXXXXXEMSFQGRGVVFELSDERATXXXXXSFDMSNDGSYXXXXXXXXXXXXX

SEQ ID NO: 418695 - protein, 527 aa, Influenza virus
  MOD_RES (1)..(15): Any amino acid
  MOD_RES (37)..(37): Any amino acid
  MOD_RES (47)..(71): Any amino acid
  MOD_RES (81)..(130): Any amino acid
  MOD_RES (139)..(281): Any amino acid
  MOD_RES (290)..(322): Any amino acid
  MOD_RES (333)..(422): Any amino acid
  MOD_RES (438)..(462): Any amino acid
  MOD_RES (471)..(486): Any amino acid
  MOD_RES (495)..(497): Any amino acid
  MOD_RES (507)..(507): Any amino acid
  MOD_RES (516)..(527): Any amino acid
XXXXXXXXXXXXXXXMALQGTKRSYSEQMETGGERQXATEIRTSVGXXXXXXXXXXXXXXXXXXXXXXXXXLVQNSITIEXXXXXXXXXXXXXXXXXXXXXXXXXXXXXXXXXXXXXXXXXXXXXXXXXXELRRIWRQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALILRGAVXXXXXXXXXXXXXXXXXXXXXXXXXXXXXXXXXDPFKLLQNSQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASAGQISIQPTFSVQXXXXXXXXXXXXXXXXXXXXXXXXXRRAEIIKMXXXXXXXXXXXXXXXXRRGQGHLDXXXAANPIVPSFXISNEGSYFXXXXXXXXXXXX

SEQ ID NO: 418696 - protein, 527 aa, Influenza virus
  MOD_RES (1)..(26): Any amino acid
  MOD_RES (37)..(134): Any amino acid
  MOD_RES (143)..(322): Any amino acid
  MOD_RES (333)..(466): Any amino acid
  MOD_RES (476)..(487): Any amino acid
  MOD_RES (502)..(527): Any amino acid
XXXXXXXXXXXXXXXXXXXXXXXXXXEQMETDGDRQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNWRQANNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPFKLLQTSQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTEIIIRMMEXXXXXXXXXXXXRGVFELSDEKAANPXXXXXXXXXXXXXXXXXXXXXXXXXX

SEQ ID NO: 418697 - protein, 527 aa, Influenza virus
  MOD_RES (1)..(26): Any amino acid
  MOD_RES (37)..(322): Any amino acid
  MOD_RES (333)..(487): Any amino acid
  MOD_RES (502)..(527): Any amino acid
XXXXXXXXXXXXXXXXXXXXXXXXXXEQMETDGERQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPFRLLQSSQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGVFEFSDERAANPXXXXXXXXXXXXXXXXXXXXXXXXXX

SEQ ID NO: 418698 - protein, 527 aa, Influenza virus
  MOD_RES (1)..(26): Any amino acid
  MOD_RES (37)..(325): Any amino acid
  MOD_RES (335)..(491): Any amino acid
  MOD_RES (500)..(527): Any amino acid
XXXXXXXXXXXXXXXXXXXXXXXXXXEQMETSGERQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRLLQNSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXELSDERAAXXXXXXXXXXXXXXXXXXXXXXXXXXXX

SEQ ID NO: 418699 - protein, 527 aa, Influenza virus
  MOD_RES (1)..(326): Any amino acid
  MOD_RES (335)..(527): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLLQNSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418700 - protein, 527 aa, Influenza virus
  MOD_RES (1)..(326): Any amino acid
  MOD_RES (335)..(527): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLLQNSQIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418701 - protein, 527 aa, Influenza virus
  MOD_RES (1)..(326): Any amino acid
  MOD_RES (335)..(527): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLLQTSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418702 - protein, 527 aa, Influenza virus
  MOD_RES (1)..(326): Any amino acid
  MOD_RES (335)..(527): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLLQSSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418703 - protein, 308 aa, Influenza virus
  MOD_RES (37)..(44): Any amino acid
  MOD_RES (65)..(74): Any amino acid
  MOD_RES (90)..(123): Any amino acid
  MOD_RES (136)..(183): Any amino acid
  MOD_RES (193)..(222): Any amino acid
  MOD_RES (231)..(262): Any amino acid
  MOD_RES (280)..(286): Any amino acid
MLFVQSYFQLFLVCVSLLQSAILSSFQVDCFLWHVRXXXXXXXXGDAPFLDRLRRDNLCRFLETXXXXXXXXXXPMRTPIAFLTSSIVCXXXXXXXXXXXXXXXXXXXXXXXXXXXXXXXXXXIASVPASRYLIDXXXXXXXXXXXXXXXXXXXXXXXXXXXXXXXXXXXXXXXXXXXXXXXXAGVETMVILXXXXXXXXXXXXXXXXXXXXXXXXXXXXXXNWPSSSGGXXXXXXXXXXXXXXXXXXXXXXXXXXXXXXXXSRNGKWREQLSQKFEEIXXXXXXXRRDQMAHCRMFEQITFMQALQL

SEQ ID NO: 418704 - protein, 308 aa, Influenza virus
  MOD_RES (1)..(23): Any amino acid
  MOD_RES (37)..(44): Any amino acid
  MOD_RES (57)..(57): Any amino acid
  MOD_RES (72)..(124): Any amino acid
  MOD_RES (136)..(286): Any amino acid
  MOD_RES (304)..(308): Any amino acid
XXXXXXXXXXXXXXXXXXXXXXXTSFQVDCYLWHIRXXXXXXXXSDAPFLDRIRRDXLDRLRRDQKSLRGRXXXXXXXXXXXXXXXXXXXXXXXXXXXXXXXXXXXXXXXXXXXXXXXXXXXXXLKMPASRYLTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRHRLKITENSFEQITFMXXXXX

SEQ ID NO: 418705 - protein, 308 aa, Influenza virus
  MOD_RES (1)..(23): Any amino acid
  MOD_RES (37)..(44): Any amino acid
  MOD_RES (57)..(57): Any amino acid
  MOD_RES (72)..(125): Any amino acid
  MOD_RES (136)..(286): Any amino acid
  MOD_RES (295)..(308): Any amino acid
XXXXXXXXXXXXXXXXXXXXXXXLSFQVDCFIWHIRXXXXXXXXCDAPFDDRLRRDXDDRLRRDQRSLRGRXXXXXXXXXXXXXXXXXXXXXXXXXXXXXXXXXXXXXXXXXXXXXXXXXXXXXXSKITLKFAFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGDQMAHCXXXXXXXXXXXXXX

SEQ ID NO: 418706 - protein, 308 aa, Influenza virus
  MOD_RES (1)..(27): Any amino acid
  MOD_RES (37)..(49): Any amino acid
  MOD_RES (72)..(126): Any amino acid
  MOD_RES (135)..(308): Any amino acid
XXXXXXXXXXXXXXXXXXXXXXXXXXXVDCFLWHIRXXXXXXXXXXXXXSLLLLQANLCRFLEDQKSLKGRXXXXXXXXXXXXXXXXXXXXXXXXXXXXXXXXXXXXXXXXXXXXXXXXXXXXXXXVPASRYLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418707 - protein, 308 aa, Influenza virus
  MOD_RES (1)..(49): Any amino acid
  MOD_RES (71)..(308): Any amino acid
XXXXXXXXXXXXXXXXXXXXXXXXXXXXXXXXXXXXXXXXXXXXXXXXXSSLLLQANLDRIRRDQKSLKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418708 - protein, 308 aa, Influenza virus
  MOD_RES (1)..(57): Any amino acid
  MOD_RES (72)..(308): Any amino acid
XXXXXXXXXXXXXXXXXXXXXXXXXXXXXXXXXXXXXXXXXXXXXXXXXXXXXXXXXIDRLRRDQKALKGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418709 - protein, 308 aa, Influenza virus
  MOD_RES (1)..(59): Any amino acid
  MOD_RES (72)..(308): Any amino acid
XXXXXXXXXXXXXXXXXXXXXXXXXXXXXXXXXXXXXXXXXXXXXXXXXXXXXXXXXXXRLRRDQRALKGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418710 - protein, 205 aa, Influenza virus
  MOD_RES (13)..(13): Any amino acid
  MOD_RES (95)..(100): Any amino acid
  MOD_RES (109)..(146): Any amino acid
  MOD_RES (160)..(168): Any amino acid
TAFSGMSANGDIXFQYLLFQDILMRRFADQELGDAPFLDRLRRDQKSLRGRGSTLGLDIRTATREGKHIVERILEEESDEALKMTIASDILKRMXXXXXXRPHPEDLNXXXXXXXXXXXXXXXXXXXXXXXXXXXXXXXXXXXXXXQLGQKFEEIRWLIXXXXXXXXXTENSFEQITFMQALQLLLEVEQEIRTFSFQLINNKKP

SEQ ID NO: 418711 - protein, 205 aa, Influenza virus
  MOD_RES (1)..(13): Any amino acid
  MOD_RES (33)..(84): Any amino acid
  MOD_RES (95)..(146): Any amino acid
  MOD_RES (160)..(168): Any amino acid
  MOD_RES (201)..(205): Any amino acid
XXXXXXXXXXXXXFQVDCFLWHVRKRFADQELXXXXXXXXXXXXXXXXXXXXXXXXXXXXXXXXXXXXXXXXXXXXXXXXXXXXTIASDILTRMXXXXXXXXXXXXXXXXXXXXXXXXXXXXXXXXXXXXXXXXXXXXXXXXXXXXQLSQKFEEIKWLIXXXXXXXXXTESSFEQITFLQALQLLLEVESEIRTFSFQFIXXXXX

SEQ ID NO: 418712 - protein, 205 aa, Influenza virus
  MOD_RES (1)..(146): Any amino acid
  MOD_RES (160)..(176): Any amino acid
  MOD_RES (203)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXELSQKFEEMRWLIXXXXXXXXXXXXXXXXXTFIQALQLLLEVENEIRTFSFQLILLXXX

SEQ ID NO: 418713 - protein, 205 aa, Influenza virus
  MOD_RES (1)..(146): Any amino acid
  MOD_RES (160)..(178): Any amino acid
  MOD_RES (203)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQLSHKFEEVRWLIXXXXXXXXXXXXXXXXXXXMQALQLLFEVEQEIRAFSFQLILIXXX

SEQ ID NO: 418714 - protein, 205 aa, Influenza virus
  MOD_RES (1)..(147): Any amino acid
  MOD_RES (158)..(186): Any amino acid
  MOD_RES (200)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGQKFEEVRWXXXXXXXXXXXXXXXXXXXXXXXXXXXXXEVEQEMRTFSFQLXXXXXX

SEQ ID NO: 418715 - protein, 734 aa, Influenza virus
  MOD_RES (27)..(29): Any amino acid
  MOD_RES (58)..(66): Any amino acid
  MOD_RES (96)..(101): Any amino acid
  MOD_RES (208)..(214): Any amino acid
  MOD_RES (228)..(229): Any amino acid
  MOD_RES (256)..(277): Any amino acid
  MOD_RES (325)..(352): Any amino acid
  MOD_RES (361)..(370): Any amino acid
  MOD_RES (388)..(410): Any amino acid
  MOD_RES (426)..(428): Any amino acid
  MOD_RES (554)..(568): Any amino acid
  MOD_RES (623)..(625): Any amino acid
MEDFVRQCFNPMIVELAEKAMKEYGEXXXIETNKFAAICTHLEVCFMYSDFHFIDERXXXXXXXXXDPNALLKHRFEIIEGRDRTMAWTVVNSICXXXXXXKPKFLPDLYDYKENRFIEIGVTRREVHIYYLEKANKIKSEKTHIHIFSFTGEEMATKADYTLDEESRARRIKTRLFTIRQEMASRGLWDSFRQSERGEETIEERFEXXXXXXXRLADQSLPPNFSSXXNFRAYVDGFEPNGCIEGKLSQMSKEVXXXXXXXXXXXXXXXXXXXXXXCSQRSKFLLMDALKLSIEDPSHSHEGEGIPLYDAIKCMKTFFGWKEPXXXXXXXXXXXXXXXXXXXXXXXXXXXXLKDEEKIPXXXXXXXXXXLKWALGENMAPEKVDFDXXXXXXXXXXXXXXXXXXXXXXXWIQSEFNKACELTDSXXXWIELDEIGEDVAPIEHIASMRRNYFTAEVSHCRATEEYIMKGVYINTALLNASCAAMDDFQLIPMISKCRTKEGRRKTNLYGFIIKGRSHLRNDTDVVNFVSMMEFSLTDPRLEPHKWEKYCVLEXXXXXXXXXXXXXXXPMFLYVRTNGTSKIKMKWGMEMRRCLLQSLQQIESMIEAESSVKEKDMTKEFFEXXXETWPIGESPKGVEEGSIGKVCRTLLAKSVFNSLYASPQLEGFSAESRKLLLIVQALRDNLEPGTFDLGGLYEAIEECLINDPWVLLNASWFNSFLTHALRFLWQCYYLL

SEQ ID NO: 418716 - protein, 734 aa, Influenza virus
  MOD_RES (27)..(29): Any amino acid
  MOD_RES (58)..(66): Any amino acid
  MOD_RES (76)..(77): Any amino acid
  MOD_RES (96)..(101): Any amino acid
  MOD_RES (159)..(159): Any amino acid
  MOD_RES (171)..(175): Any amino acid
  MOD_RES (208)..(214): Any amino acid
  MOD_RES (228)..(229): Any amino acid
  MOD_RES (256)..(277): Any amino acid
  MOD_RES (323)..(370): Any amino acid
  MOD_RES (388)..(410): Any amino acid
  MOD_RES (532)..(532): Any amino acid
  MOD_RES (554)..(568): Any amino acid
  MOD_RES (623)..(625): Any amino acid
  MOD_RES (665)..(666): Any amino acid
  MOD_RES (706)..(713): Any amino acid
  MOD_RES (732)..(734): Any amino acid
MENFVRQCFNPMVVELAEKTMKEYGEXXXVETNKFAAICTHMEVCFMYSDFHFINEQXXXXXXXXXDSNALLKHRXXIIEGRDRIMAWTVVNSLCXXXXXXKPRFLPDLYDYKEDRFVEIGVTRREIHIYYLEKASKIKSENTHIHIFSFNGEEMATKXDYTIDEESRARXXXXXLFTIRQELASRSLWDSFRQSERGEDTIEERFEXXXXXXXKLADQSLPPNFSCXXNFRVYVDGFEPNGYIEGKLSQMSREVXXXXXXXXXXXXXXXXXXXXXXCHQRSKFLLMDSLKLSIEDPNHNHEGEGIPLHDAIKCIKTFFGWKXXXXXXXXXXXXXXXXXXXXXXXXXXXXXXXXXXXXXXXXXXXXXXXXLRWALGENMAPEKMDFEXXXXXXXXXXXXXXXXXXXXXXXWIQNEFNKACECELTDSSWLELDEIGEDIAPIEHVASMRRNYFTAEISHCRATEEYMMKGVYVNTALLNASCAAMEDFQLIPMISKCKTKEGRRRTNLYGFIVKGRSHLRNDTDVVNYVSMXEFSLTDPKLELHKWEKYCILEXXXXXXXXXXXXXXXPMFLYIRTNGTSKVKMKWGMELRRCLLQSLQQIESIIEAESSIKEKDMTKDFFEXXXEAWPIGESPRGVEESSIGKVCRALLAKSVFNCLYASPQLXXFSAESRKMLLIVQALRDSLEPGTFDIGGLYESIEECLINXXXXXXXXSWFNSFLAHALKLVVAMLXXX

SEQ ID NO: 418717 - protein, 734 aa, Influenza virus
  MOD_RES (27)..(29): Any amino acid
  MOD_RES (58)..(66): Any amino acid
  MOD_RES (96)..(101): Any amino acid
  MOD_RES (208)..(214): Any amino acid
  MOD_RES (228)..(229): Any amino acid
  MOD_RES (256)..(277): Any amino acid
  MOD_RES (287)..(290): Any amino acid
  MOD_RES (325)..(370): Any amino acid
  MOD_RES (388)..(410): Any amino acid
  MOD_RES (428)..(428): Any amino acid
  MOD_RES (506)..(521): Any amino acid
  MOD_RES (532)..(533): Any amino acid
  MOD_RES (554)..(568): Any amino acid
  MOD_RES (578)..(597): Any amino acid
  MOD_RES (623)..(625): Any amino acid
  MOD_RES (647)..(649): Any amino acid
  MOD_RES (684)..(685): Any amino acid
  MOD_RES (705)..(713): Any amino acid
  MOD_RES (727)..(734): Any amino acid
MEGFVRQCFNPMTVELAEKAMKEHGEXXXIETNKLAAICTHLEICFMYSDFHFINERXXXXXXXXXDPNVLLKHRFEIIEGRDRNMAWTMVNSICXXXXXXKPRYLPDLYDYKESRFLEIGVTRREVHTYYLEKANKIKTEETHIHIFSFTGEEMASKAEYTLDEESSRARIKTRLFTIRQEMANRGLWDPFRQSERGEETVEERFEXXXXXXXRLANQSLPPNFPSXXNFRTYVDGFEPNGCIESKLSQMSKKVXXXXXXXXXXXXXXXXXXXXXXCYQRSKFLLXXXXKLSIEDPDHDHEGEGIPLYDAVRCMKTFFGWREPXXXXXXXXXXXXXXXXXXXXXXXXXXXXXXXXXXXXXXXXXXXXXXLKWVLGENMAPEKIDFEXXXXXXXXXXXXXXXXXXXXXXXWVQNEFNKATAYELTDSXWMELDEIGEDLAPIEYIASMRRDYFTAEVSYCRAATEYIMKGVYMNTALLNASCAAMDEFQLIPMISKSRTKEGRRRXXXXXXXXXXXXXXXXDTDVVNFLSMXXFSLTDPRFEPHKWERYCVLEXXXXXXXXXXXXXXXPIFLYVRTNXXXXXXXXXXXXXXXXXXXXLQQIESMVEAESSVKEKDLTKEFFEXXXEKWPIGESPEGVEDGSIGKVCXXXLAKSVFNNLYASSQLEGFSAESRKLLLVVQALRDXXEPGTFDLEGLYDAIEECLIXXXXXXXXXSWFNSFLVHALKSXXXXXXXX

SEQ ID NO: 418718 - protein, 734 aa, Influenza virus
  MOD_RES (22)..(29): Any amino acid
  MOD_RES (45)..(49): Any amino acid
  MOD_RES (58)..(66): Any amino acid
  MOD_RES (75)..(77): Any amino acid
  MOD_RES (96)..(101): Any amino acid
  MOD_RES (137)..(140): Any amino acid
  MOD_RES (150)..(150): Any amino acid
  MOD_RES (168)..(177): Any amino acid
  MOD_RES (187)..(197): Any amino acid
  MOD_RES (208)..(214): Any amino acid
  MOD_RES (227)..(229): Any amino acid
  MOD_RES (256)..(277): Any amino acid
  MOD_RES (287)..(290): Any amino acid
  MOD_RES (300)..(305): Any amino acid
  MOD_RES (324)..(370): Any amino acid
  MOD_RES (388)..(410): Any amino acid
  MOD_RES (420)..(420): Any amino acid
  MOD_RES (485)..(492): Any amino acid
  MOD_RES (508)..(524): Any amino acid
  MOD_RES (539)..(542): Any amino acid
  MOD_RES (554)..(568): Any amino acid
  MOD_RES (578)..(600): Any amino acid
  MOD_RES (623)..(625): Any amino acid
  MOD_RES (644)..(652): Any amino acid
  MOD_RES (667)..(670): Any amino acid
  MOD_RES (684)..(685): Any amino acid
  MOD_RES (705)..(713): Any amino acid
  MOD_RES (734)..(734): Any amino acid
MEEFVRQCFNPMIIELAEKAMXXXXXXXXIETNKFASICTHLEVXXXXXDFHFIDEQXXXXXXXXXDPNTLLKHXXXIIEGRDRAMAWTVINSICXXXXXXKPKYLPDLYDYKKNRFTEIGVTRREVHVYYLEKANXXXXERTHIHIFSXTGEEMATRADYILDEESXXXXXXXXXXTIRQEMAIRXXXXXXXXXXXGEETIEEKFEXXXXXXXKLANYSLPPNFSXXXSFRAYVDGFKPNGCIEGKLSQMPKEVXXXXXXXXXXXXXXXXXXXXXXCFQRSKFLLXXXXKLSIENPSHXXXXXXIPLYDAVKCMRTFFGWKEXXXXXXXXXXXXXXXXXXXXXXXXXXXXXXXXXXXXXXXXXXXXXXXLKWTLGENMAPEKVDFEXXXXXXXXXXXXXXXXXXXXXXXWVQSEFNKAXACELTDSSWVELDEIGEDVAPIEYVASMRRSYFTAEVSSHCRATEYIMKGVYINTAMLNASCAAXXXXXXXXMISKCRTREGRRKTNXXXXXXXXXXXXXXXXXGSLNFVSMEFSLTDXXXXPYKWEKYCVIEXXXXXXXXXXXXXXXPLFLYVRTNXXXXXXXXXXXXXXXXXXXXXXXVESMIEAESSIKEKDMTREFFEXXXEMWPIGESPKRVEEGSIGXXXXXXXXXSVFNSLYSSPQLEGXXXXSRKLLLIAQALRDXXEPGTFDIEGLYGAIEECLIXXXXXXXXXSWFNSFLIHALRELWQCYYLX

SEQ ID NO: 418719 - protein, 734 aa, Influenza virus
  MOD_RES (1)..(1): Any amino acid
  MOD_RES (22)..(29): Any amino acid
  MOD_RES (38)..(49): Any amino acid
  MOD_RES (58)..(79): Any amino acid
  MOD_RES (96)..(101): Any amino acid
  MOD_RES (113)..(124): Any amino acid
  MOD_RES (137)..(140): Any amino acid
  MOD_RES (150)..(150): Any amino acid
  MOD_RES (159)..(163): Any amino acid
  MOD_RES (172)..(178): Any amino acid
  MOD_RES (194)..(200): Any amino acid
  MOD_RES (209)..(214): Any amino acid
  MOD_RES (223)..(238): Any amino acid
  MOD_RES (247)..(292): Any amino acid
  MOD_RES (302)..(312): Any amino acid
  MOD_RES (323)..(371): Any amino acid
  MOD_RES (380)..(418): Any amino acid
  MOD_RES (427)..(430): Any amino acid
  MOD_RES (472)..(525): Any amino acid
  MOD_RES (551)..(568): Any amino acid
  MOD_RES (577)..(604): Any amino acid
  MOD_RES (620)..(625): Any amino acid
  MOD_RES (645)..(654): Any amino acid
  MOD_RES (665)..(670): Any amino acid
  MOD_RES (684)..(713): Any amino acid
  MOD_RES (723)..(734): Any amino acid
XGDFVRQCFNPMIAELAEKAMXXXXXXXXTETNKFAAXXXXXXXXXXXXDFHFINELXXXXXXXXXXXXXXXXXXXXXXEGRDRTIAWTAVNSICXXXXXXKPKSLPDLYDYXXXXXXXXXXXXREVHMYYLEKANXXXXEDTHIHIFSXIGEEMATKXXXXXASSKSRARXXXXXXXIRQEMASKGLWDSFRXXXXXXXRSIEEKFEXXXXXXRLANYSLPXXXXXXXXXXXXXXXXEPNGSIEGXXXXXXXXXXXXXXXXXXXXXXXXXXXXXXXXXXXXXXXXXXXXXXKASKEPEVHXXXXXXXXXXXKCIRTFFGWKXXXXXXXXXXXXXXXXXXXXXXXXXXXXXXXXXXXXXXXXXXXXXXXXXMWALGENMXXXXXXXXXXXXXXXXXXXXXXXXXXXXXXXXXXXXXXXKTAYELTDXXXXEFDEIGEDIAPIEYIASIRRNYFTTEVSHCRAATEYMMKGVXXXXXXXXXXXXXXXXXXXXXXXXXXXXXXXXXXXXXXXXXXXXXXXXXXXXXXVVNFVSMEFSLVDPRLESHKWEKYCXXXXXXXXXXXXXXXXXXSMFLYVRTXXXXXXXXXXXXXXXXXXXXXXXXXXXXIEAESSVREKDMTKEXXXXXXETWPVGESPKGMEEGSIGKXXXXXXXXXXFNSLYASSQLXXXXXXSRKLLLITQALRDXXXXXXXXXXXXXXXXXXXXXXXXXXXXXXSWFNSFLKHXXXXXXXXXXXX

SEQ ID NO: 418720 - protein, 734 aa, Influenza virus
  MOD_RES (1)..(14): Any amino acid
  MOD_RES (23)..(133): Any amino acid
  MOD_RES (142)..(151): Any amino acid
  MOD_RES (160)..(164): Any amino acid
  MOD_RES (175)..(201): Any amino acid
  MOD_RES (210)..(294): Any amino acid
  MOD_RES (307)..(377): Any amino acid
  MOD_RES (386)..(420): Any amino acid
  MOD_RES (430)..(440): Any amino acid
  MOD_RES (451)..(457): Any amino acid
  MOD_RES (470)..(525): Any amino acid
  MOD_RES (537)..(610): Any amino acid
  MOD_RES (619)..(654): Any amino acid
  MOD_RES (665)..(673): Any amino acid
  MOD_RES (689)..(718): Any amino acid
  MOD_RES (729)..(734): Any amino acid
XXXXXXXXXXXXXXELAERAMKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKSNKIKSEXXXXXXXXXXGEEMAAKAXXXXXDEESRARIKTXXXXXXXXXXXXXXXXXXXXXXXXXXXTIEERFEIXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPSHEGEGIXXXXXXXXXXXXXXXXXXXXXXXXXXXXXXXXXXXXXXXXXXXXXXXXXXXXXXXXXXXXXXXXXXXXXXXNIAPEKVDXXXXXXXXXXXXXXXXXXXXXXXXXXXXXXXXXXXACELTDSIWXXXXXXXXXXXPIEHIASIRRXXXXXXXISKSRATEYMMKXXXXXXXXXXXXXXXXXXXXXXXXXXXXXXXXXXXXXXXXXXXXXXXXXXXXXXXXVVNYVSMEFSLXXXXXXXXXXXXXXXXXXXXXXXXXXXXXXXXXXXXXXXXXXXXXXXXXXXXXXXXXXXXXXXXXXXXXXXXXXVKEKDMTRXXXXXXXXXXXXXXXXXXXXXXXXXXXXXXXXXXXXFNSIYASPQLXXXXXXXXXLLLIVQAFRDNLEPGXXXXXXXXXXXXXXXXXXXXXXXXXXXXXXSLTHALRELWXXXXXX

SEQ ID NO: 418721 - protein, 734 aa, Influenza virus
  MOD_RES (1)..(201): Any amino acid
  MOD_RES (210)..(294): Any amino acid
  MOD_RES (307)..(420): Any amino acid
  MOD_RES (430)..(444): Any amino acid
  MOD_RES (453)..(459): Any amino acid
  MOD_RES (476)..(525): Any amino acid
  MOD_RES (538)..(678): Any amino acid
  MOD_RES (690)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTIEEKFEIXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPNHEGEGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXACELTDSVWXXXXXXXXXXXXXXXIASMRRSYXXXXXXXYCRATEYIIKGVYINTXXXXXXXXXXXXXXXXXXXXXXXXXXXXXXXXXXXXXXXXXXXXXXXXXXVVNFLSMEFSLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQALKDNLEPGTXXXXXXXXXXXXXXXXXXXXXXXXXXXXXXXXXXXXXXXXXXXXX

SEQ ID NO: 418722 - protein, 734 aa, Influenza virus
  MOD_RES (1)..(201): Any amino acid
  MOD_RES (210)..(294): Any amino acid
  MOD_RES (307)..(420): Any amino acid
  MOD_RES (430)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVEERFEIXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPDHEGEGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXACELTDSTWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418723 - protein, 734 aa, Influenza virus
  MOD_RES (1)..(294): Any amino acid
  MOD_RES (306)..(420): Any amino acid
  MOD_RES (429)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIENPSHEGEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXACELTGSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418724 - protein, 734 aa, Influenza virus
  MOD_RES (1)..(294): Any amino acid
  MOD_RES (303)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEEPSHEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418725 - protein, 829 aa, Influenza virus
  MOD_RES (58)..(59): Any amino acid
  MOD_RES (115)..(115): Any amino acid
  MOD_RES (156)..(159): Any amino acid
  MOD_RES (174)..(181): Any amino acid
  MOD_RES (213)..(217): Any amino acid
  MOD_RES (376)..(379): Any amino acid
  MOD_RES (388)..(391): Any amino acid
  MOD_RES (404)..(405): Any amino acid
  MOD_RES (440)..(440): Any amino acid
  MOD_RES (462)..(463): Any amino acid
  MOD_RES (585)..(594): Any amino acid
  MOD_RES (625)..(626): Any amino acid
  MOD_RES (667)..(684): Any amino acid
  MOD_RES (801)..(809): Any amino acid
MDVNPTLLFLFLKVPAQNAISTTFPYTGDPPYSHGTGTGYTMDTVNRTHQYSEKGKWXXNTETGAPQLNPIDGPLPEDNEPSGYAQTDCVLEAMAFLEESHPGIFENSCLETMEXVQQTRVDKLTQGRQTYDWTLNRNQPAATALANTIEVFRSNXXXXNESGRLIDFLKDVMXXXXXXXXEITTHFQRKRRVRDNMTKKMVTQRTIGKKKQXXXXXSYLIRALTLNTMTKDAERGKLKRRAIATPGMQIRGFVYFVETLARSICEKLEQSGLPVGGNEKKAKLANVVRKMMTNSQDTELSFTITGDNTKWNENQNPRMFMFLAMITYITRNQPEWFRNILSMAPIMFSNKMARLGKGYMFESKSMKLRTQIPAEXXXXIDLKYFNEXXXXKIEKIEKIRPLLXXGTASLSPGMMMGMFNMLSTVLGVSILNLGQKRYTXTTYWWDGLQSSDDFALIVNAPXXEGIQAGVDRFYRTCKLVGINMSKKKSYINRTGTFEFTSFFYRYGFVANFSMELPSFGVSGINESADMSIGVTVIKNNMINNDLGPATAQMALQLFIKDYRYTYRCHRGDTQIQTRRSFELKXXXXXXXXXXGLLVSDGGPNLYNIRNLHIPEVCLKWELMDXXYQGRLCNPLNPFVSHVGTRWMKIIRVGCVILLNPFVSHKEXXXXXXXXXXXXXXXXXXMEYDAVATTHSWIPKRNRSILNTSQRTRSGQNHGICAVATTHSWVPILNTSQRGILEDEQMYQKCCNLFEKFFPSSSYRRPVGISSMVEAMVSRARIDARIDFESGRIGKKEEFSEXXXXXXXXXELRRQKSLIWLWLVLREKMP

SEQ ID NO: 418726 - protein, 829 aa, Influenza virus
  MOD_RES (1)..(3): Any amino acid
  MOD_RES (24)..(38): Any amino acid
  MOD_RES (58)..(59): Any amino acid
  MOD_RES (72)..(77): Any amino acid
  MOD_RES (90)..(90): Any amino acid
  MOD_RES (115)..(115): Any amino acid
  MOD_RES (139)..(143): Any amino acid
  MOD_RES (156)..(159): Any amino acid
  MOD_RES (174)..(181): Any amino acid
  MOD_RES (213)..(217): Any amino acid
  MOD_RES (226)..(247): Any amino acid
  MOD_RES (266)..(286): Any amino acid
  MOD_RES (307)..(311): Any amino acid
  MOD_RES (376)..(379): Any amino acid
  MOD_RES (388)..(394): Any amino acid
  MOD_RES (404)..(405): Any amino acid
  MOD_RES (415)..(425): Any amino acid
  MOD_RES (440)..(440): Any amino acid
  MOD_RES (450)..(451): Any amino acid
  MOD_RES (462)..(463): Any amino acid
  MOD_RES (501)..(516): Any amino acid
  MOD_RES (542)..(562): Any amino acid
  MOD_RES (585)..(594): Any amino acid
  MOD_RES (606)..(610): Any amino acid
  MOD_RES (623)..(626): Any amino acid
  MOD_RES (642)..(658): Any amino acid
  MOD_RES (667)..(684): Any amino acid
  MOD_RES (718)..(731): Any amino acid
  MOD_RES (756)..(758): Any amino acid
  MOD_RES (801)..(809): Any amino acid
  MOD_RES (826)..(829): Any amino acid
XXXINPTLLFLKVPAVQNAISTTXXXXXXXXXXXXXXXGYTMDTVSRTHQYSERGRWXXNSETGAPQLNPVXXXXXXDNEPTGYAQTDCXLEAMALLEESHPGLFENSCLETIEXIQQTRVDKLTQGRQTFDWTLNRNXXXXXALANTIEIFRSNXXXXSESGRLIDFLKDVIXXXXXXXXEVTTHFQRKRRIRDNMTKRMVTQRTIGKRKQXXXXXGYLIRALTXXXXXXXXXXXXXXXXXXXXXXMQIRGFVHFVEALARSICXXXXXXXXXXXXXXXXXXXXXVVRKMMTSSQDTELSFTVTGXXXXXNENQNPRVFIFLAMITYITKNQPEWFRNVLSIAPIMFSNKVARLGKGYMFESKRMKIRTQIPAEXXXXIDLKYFNDXXXXXXXKIERIRPLLXXGAASLSPGMXXXXXXXXXXXLGVSVLNLGQKRHTXTIYWWDGLQXXDDFALILNAPXXAGIQAGVDRFYRICKLVGINMSKRKSYINKTGTFEFTXXXXXXXXXXXXXXXXPSFGVSGVNESADMSIGITVIKNNMXXXXXXXXXXXXXXXXXXXXXRYTYRCHKGDTQIQTKRSFELKXXXXXXXXXXGLLISDGGPNLXXXXXLHIPEAGLKWELXXXXYRGRLCNPLNPFVNHXXXXXXXXXXXXXXXXXNPFVNHKGXXXXXXXXXXXXXXXXXXIEYDAVATTHSWVPKRNRSICNSNAITRSGQNHXXXXXXXXXXXXXXLNTSQRGVLEDEQMYQRCCNLFEKXXXSSSYRRPIGISSMVEAMISRARIDARVDFESGRIGKKEFSEIXXXXXXXXXELRRQKWWVWLWLVLRXXXX

SEQ ID NO: 418727 - protein, 829 aa, Influenza virus
  MOD_RES (1)..(4): Any amino acid
  MOD_RES (24)..(48): Any amino acid
  MOD_RES (58)..(59): Any amino acid
  MOD_RES (86)..(91): Any amino acid
  MOD_RES (115)..(115): Any amino acid
  MOD_RES (131)..(146): Any amino acid
  MOD_RES (156)..(159): Any amino acid
  MOD_RES (174)..(181): Any amino acid
  MOD_RES (213)..(217): Any amino acid
  MOD_RES (226)..(251): Any amino acid
  MOD_RES (271)..(292): Any amino acid
  MOD_RES (308)..(311): Any amino acid
  MOD_RES (376)..(379): Any amino acid
  MOD_RES (388)..(394): Any amino acid
  MOD_RES (404)..(405): Any amino acid
  MOD_RES (416)..(428): Any amino acid
  MOD_RES (440)..(440): Any amino acid
  MOD_RES (450)..(453): Any amino acid
  MOD_RES (462)..(463): Any amino acid
  MOD_RES (495)..(530): Any amino acid
  MOD_RES (546)..(565): Any amino acid
  MOD_RES (585)..(595): Any amino acid
  MOD_RES (607)..(613): Any amino acid
  MOD_RES (625)..(626): Any amino acid
  MOD_RES (642)..(658): Any amino acid
  MOD_RES (667)..(684): Any amino acid
  MOD_RES (705)..(743): Any amino acid
  MOD_RES (759)..(764): Any amino acid
  MOD_RES (780)..(784): Any amino acid
  MOD_RES (793)..(829): Any amino acid
XXXXHPTLLFLKIPAAQNAISITXXXXXXXXXXXXXXXXXXXXXXXXXHQYSERGKWXXNTEIGAPQLNPIDGPLPKNNEPSGYAXXXXXXEAMAFLEKSHPGIFESSCLETMEXVQQTRVDRLTQGRQTXXXXXXXXXXXXXXXXNTIEVFRLNXXXXNESGRLMDFLKDVMXXXXXXXXEIVTHFQRKRRVRDNVTKKMITQRTIGKKKHXXXXXNYLIRALTXXXXXXXXXXXXXXXXXXXXXXXXXXGFVYFVEALARRICEKLEQXXXXXXXXXXXXXXXXXXXXXXTNSQDTEISFTITGDXXXXNENQNPRIFVFLAMITYITRKQPGWFRNVLSVAPIMFSNKMARLGRGYMFESKNMKLRTQVPAEXXXXIDLRYFNDXXXXXXXKIMKIRPILXXGTVSLSPGMMXXXXXXXXXXXXXSILNLGQRKYTXTSYWWDGLQXXXXFALIVNASXXEGIQAGVNRFYRTCKLLGINMSKKKSYINKTXXXXXXXXXXXXXXXXXXXXXXXXXXXXXXXXXXXXSIGVTVIRNNMINNDXXXXXXXXXXXXXXXXXXXXYRCHRGDMQIQTRRAFELKXXXXXXXXXXXLLVADGGPNLYXXXXXXXPEVCLKWDLMDXXYKGRLCNPLNPFVTHXXXXXXXXXXXXXXXXXNPFVNHKEXXXXXXXXXXXXXXXXXXVEYDAVATTHSWTPKRNRSIXXXXXXXXXXXXXXXXXXXXXXXXXXXXXXXXXXXXXXXQMYQKCCSLFEKFFPXXXXXXPVGISSMGEAMVSRAXXXXXIDFESGRMXXXXXXXXXXXXXXXXXXXXXXXXXXXXXXXXXXXXX

SEQ ID NO: 418728 - protein, 829 aa, Influenza virus
  MOD_RES (1)..(5): Any amino acid
  MOD_RES (23)..(48): Any amino acid
  MOD_RES (58)..(59): Any amino acid
  MOD_RES (87)..(91): Any amino acid
  MOD_RES (115)..(146): Any amino acid
  MOD_RES (156)..(165): Any amino acid
  MOD_RES (174)..(181): Any amino acid
  MOD_RES (213)..(217): Any amino acid
  MOD_RES (230)..(251): Any amino acid
  MOD_RES (271)..(292): Any amino acid
  MOD_RES (302)..(313): Any amino acid
  MOD_RES (343)..(357): Any amino acid
  MOD_RES (375)..(379): Any amino acid
  MOD_RES (388)..(394): Any amino acid
  MOD_RES (404)..(429): Any amino acid
  MOD_RES (440)..(440): Any amino acid
  MOD_RES (450)..(453): Any amino acid
  MOD_RES (462)..(463): Any amino acid
  MOD_RES (472)..(566): Any amino acid
  MOD_RES (585)..(627): Any amino acid
  MOD_RES (642)..(658): Any amino acid
  MOD_RES (667)..(743): Any amino acid
  MOD_RES (759)..(764): Any amino acid
  MOD_RES (780)..(784): Any amino acid
  MOD_RES (793)..(829): Any amino acid
XXXXXPTLLFLKMPPVQNAISTXXXXXXXXXXXXXXXXXXXXXXXXXXHQYSEKGRWXXNTETKAPQLNPIDGPLPDDNDPSGYAQXXXXXEAMAFLENSHPGIFENSCIETMEXXXXXXXXXXXXXXXXXXXXXXXXXXXXXXXXNTIEVFKSNXXXXXXXXXXIDFLKDVVXXXXXXXXEIITHFQRKRRVRDNITKKMVTQRTVGKKKQXXXXXSYLIRTLTLNTMXXXXXXXXXXXXXXXXXXXXXXGFVYFVEILARCICEKLEQXXXXXXXXXXXXXXXXXXXXXXTNSQDTEVSXXXXXXXXXXXXNQNQNPRMFLAMITYITRSQPKWFRNVLSXXXXXXXXXXXXXXXGYMFESKKMRLRTQIPAXXXXXIDLKYFNKXXXXXXXKIEKVRPLLXXXXXXXXXXXXXXXXXXXXXXXXXXILNLGQKKYTXTVYWWDGLQXXXXFALIVNALXXEGVQAGVDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRCHRGDTHIQTRRSFEIKXXXXXXXXXXXXXXXXXXXXXXXXXXXXXXXXXXXXXXXXXXXQGRLCNPMNPFVSHXXXXXXXXXXXXXXXXXNPFVTHKEXXXXXXXXXXXXXXXXXXXXXXXXXXXXXXXXXXXXXXXXXXXXXXXXXXXXXXXXXXXXXXXXXXXXXXXXXXXXXQMYQKCCTLFEKFFPXXXXXXPVGISSMMEAMVSRAXXXXXVDSESGRIXXXXXXXXXXXXXXXXXXXXXXXXXXXXXXXXXXXXX

SEQ ID NO: 418729 - protein, 829 aa, Influenza virus
  MOD_RES (1)..(6): Any amino acid
  MOD_RES (16)..(59): Any amino acid
  MOD_RES (74)..(77): Any amino acid
  MOD_RES (86)..(92): Any amino acid
  MOD_RES (113)..(165): Any amino acid
  MOD_RES (174)..(181): Any amino acid
  MOD_RES (207)..(217): Any amino acid
  MOD_RES (228)..(256): Any amino acid
  MOD_RES (266)..(292): Any amino acid
  MOD_RES (301)..(315): Any amino acid
  MOD_RES (343)..(365): Any amino acid
  MOD_RES (376)..(379): Any amino acid
  MOD_RES (388)..(394): Any amino acid
  MOD_RES (404)..(429): Any amino acid
  MOD_RES (440)..(440): Any amino acid
  MOD_RES (450)..(463): Any amino acid
  MOD_RES (472)..(566): Any amino acid
  MOD_RES (576)..(576): Any amino acid
  MOD_RES (585)..(633): Any amino acid
  MOD_RES (642)..(658): Any amino acid
  MOD_RES (667)..(771): Any amino acid
  MOD_RES (784)..(784): Any amino acid
  MOD_RES (793)..(829): Any amino acid
XXXXXXTLLFLEVPAXXXXXXXXXXXXXXXXXXXXXXXXXXXXXXXXXXXXXXXXXXXXNTETGALQLNPIDGXXXXDNEPNGYAXXXXXXXAMAFLEDSHPGIFGNSCLETXXXXXXXXXXXXXXXXXXXXXXXXXXXXXXXXXXXXXXXXXXXXXXXXXXXXXIDFLKDVTXXXXXXXXGITTHFQRKRRVRDSMTRKMVTQRTXXXXXXXXXXXSYIIRALTLNXXXXXXXXXXXXXXXXXXXXXXXXXXXXXVETLARRICXXXXXXXXXXXXXXXXXXXXXXXXXXXTSSQDTEIXXXXXXXXXXXXXXXNQNPRVFLAMITYMTRNQPDWFRNVLSXXXXXXXXXXXXXXXXXXXXXXXMKLRTQISAEXXXXIDLRYFNEXXXXXXXKIKKIRPLLXXXXXXXXXXXXXXXXXXXXXXXXXXILNLGQKEYTXTAYWWDGLQXXXXXXXXXXXXXXGGIQAGVDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRCHRGDAQIXTRRSFELRXXXXXXXXXXXXXXXXXXXXXXXXXXXXXXXXXXXXXXXXXXXXXXXXXPLNPFVGHXXXXXXXXXXXXXXXXXNPFVSHREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVEAMMSRARIDAXIDFESGRVXXXXXXXXXXXXXXXXXXXXXXXXXXXXXXXXXXXXX

SEQ ID NO: 418730 - protein, 829 aa, Influenza virus
  MOD_RES (1)..(7): Any amino acid
  MOD_RES (16)..(98): Any amino acid
  MOD_RES (107)..(187): Any amino acid
  MOD_RES (202)..(256): Any amino acid
  MOD_RES (266)..(315): Any amino acid
  MOD_RES (328)..(335): Any amino acid
  MOD_RES (348)..(367): Any amino acid
  MOD_RES (376)..(634): Any amino acid
  MOD_RES (649)..(829): Any amino acid
XXXXXXXLLFLKVPVXXXXXXXXXXXXXXXXXXXXXXXXXXXXXXXXXXXXXXXXXXXXXXXXXXXXXXXXXXXXXXXXXXXXXXXXXXXXXXXXXXXESHPGIFGXXXXXXXXXXXXXXXXXXXXXXXXXXXXXXXXXXXXXXXXXXXXXXXXXXXXXXXXXXXXXXXXXXXXXXXXXXXXXXXXXHRKRRVRDNMTRKMXXXXXXXXXXXXXXXXXXXXXXXXXXXXXXXXXXXXXXXXXXXXXXXXXXXXXXXVETLARCICXXXXXXXXXXXXXXXXXXXXXXXXXXXXXXXXXXXXXXXXXXXXXXXXXXNQNPRIFLAMITXXXXXXXXWFRNILSIAPIMXXXXXXXXXXXXXXXXXXXXLRTQVSAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHPRGLLEVGTRWMKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418731 - protein, 829 aa, Influenza virus
  MOD_RES (1)..(7): Any amino acid
  MOD_RES (16)..(199): Any amino acid
  MOD_RES (208)..(256): Any amino acid
  MOD_RES (271)..(316): Any amino acid
  MOD_RES (332)..(338): Any amino acid
  MOD_RES (348)..(829): Any amino acid
XXXXXXXLLFLKIPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRMITQRTIXXXXXXXXXXXXXXXXXXXXXXXXXXXXXXXXXXXXXXXXXXXXXXXXXVETLARNICEKLEQXXXXXXXXXXXXXXXXXXXXXXXXXXXXXXXXXXXXXXXXXXXXXXQNPRVFLTMITYITRXXXXXXXNALSIAPIMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418732 - protein, 829 aa, Influenza virus
  MOD_RES (1)..(8): Any amino acid
  MOD_RES (22)..(829): Any amino acid
XXXXXXXXYFFLKVPVQNAISXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418733 - protein, 829 aa, Influenza virus
  MOD_RES (1)..(9): Any amino acid
  MOD_RES (23)..(829): Any amino acid
XXXXXXXXXLFLKIPAQNAISIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418734 - protein, 829 aa, Influenza virus
  MOD_RES (1)..(9): Any amino acid
  MOD_RES (18)..(829): Any amino acid
XXXXXXXXXLFLKVPVQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418735 - protein, 829 aa, Influenza virus
  MOD_RES (1)..(9): Any amino acid
  MOD_RES (22)..(829): Any amino acid
XXXXXXXXXLFLKIPVQNAISXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418736 - protein, 829 aa, Influenza virus
  MOD_RES (1)..(9): Any amino acid
  MOD_RES (21)..(829): Any amino acid
XXXXXXXXXLFLEVPAQNAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418737 - protein, 780 aa, Influenza virus
  MOD_RES (74)..(78): Any amino acid
  MOD_RES (91)..(94): Any amino acid
  MOD_RES (117)..(121): Any amino acid
  MOD_RES (134)..(139): Any amino acid
  MOD_RES (197)..(198): Any amino acid
  MOD_RES (207)..(210): Any amino acid
  MOD_RES (305)..(308): Any amino acid
  MOD_RES (351)..(353): Any amino acid
  MOD_RES (368)..(368): Any amino acid
  MOD_RES (408)..(411): Any amino acid
  MOD_RES (459)..(469): Any amino acid
  MOD_RES (483)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (674)..(674): Any amino acid
  MOD_RES (689)..(698): Any amino acid
  MOD_RES (778)..(780): Any amino acid
SKSRSNIFNMERIKELRDLMSQSRTREILTKTTVDHMAIIKKYTSGRSGRQEKNPALRMKWMMAMKYPITADKXXXXXIPERNEQGQTLWXXXXDAGSDRVMVSPLAVTWWNRNGPXXXXXHYPKVYKTYFEKXXXXXXGTFGPVHFRNQVKIRRRVDINPGHADLSSAKEAQDVIMEVVFPNEVGARILTSESQLXXTKEKKEELXXXXIAPLMVAYMLERELVRKTRFLPVAGGTSSVYIEVLHLTQGTCWEQMYTPGGEVRNDDVDQSLIIAARNIVRRAAVSADPLASLLEMCHSTQIGGXXXXDILRQNPTEEQAVDICKAAMGLRISSSFSFGGFTFKRTSGSSXXXEEEVLTGNLQTLKIXVHEGYEEFTMVGRRATAILRKATRRLIQLIVSGRDEQSIXXXXIVAMVFSQEDCMIKAVRGDLNFVNRANQRLNPMHQLLRHFQKDAKVLXXXXXXXXXXXVMGMIGILPDMTPXXXXXXXXXRVSKMGVDEYSSTERXVVSIDRFLRVRDQRGNVLLSPEEVSETQGTEKLTITYSSSMMWEINGPESVLVNTYQWIIRNWEXXKIQWSQDPTXLYNKMEFEPFQSLVPKAXRGQYSGFVRTLFQQMRDVLGTFDTVQIIKLLPFAAAPPEQSRMQFSSLTVNVRGSGMRILVRGNSPVFNYNKXTKRLTVLGKDAGALXXXXXXXXXXAGVESAVLRGFLILGKEDKRYGGPALSINELSNLAKGEKANVLIGQGDVVLVMKRKRDSSILTDSQTATKRIRMAINQCXXX

SEQ ID NO: 418738 - protein, 780 aa, Influenza virus
  MOD_RES (57)..(58): Any amino acid
  MOD_RES (74)..(78): Any amino acid
  MOD_RES (91)..(94): Any amino acid
  MOD_RES (117)..(121): Any amino acid
  MOD_RES (134)..(139): Any amino acid
  MOD_RES (177)..(180): Any amino acid
  MOD_RES (197)..(198): Any amino acid
  MOD_RES (207)..(210): Any amino acid
  MOD_RES (220)..(226): Any amino acid
  MOD_RES (292)..(293): Any amino acid
  MOD_RES (305)..(308): Any amino acid
  MOD_RES (339)..(339): Any amino acid
  MOD_RES (351)..(353): Any amino acid
  MOD_RES (368)..(368): Any amino acid
  MOD_RES (408)..(411): Any amino acid
  MOD_RES (429)..(435): Any amino acid
  MOD_RES (459)..(469): Any amino acid
  MOD_RES (483)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (612)..(612): Any amino acid
  MOD_RES (644)..(644): Any amino acid
  MOD_RES (674)..(674): Any amino acid
  MOD_RES (689)..(698): Any amino acid
SESRSNIFNMERIRELRNLMSQSRTRGILTRTTVDHMAIIKKYTSARSARQEKNPAXXMKWMMAMRYPITADKXXXXXVPERNEQGQILWXXXXDAGSDRLMVSPLAITWWNRKGPXXXXXHYPKIYKTYFEKXXXXXXGIFGPVHFRSQVKIRRRVDTNPGHADLNSSKEAQDVIXXXXFPNEVGAKILTSESQMXXTREKKEELXXXXISPLMVAYMXXXXXXXKTRFLPVSGGTSSIYIEVLHLTQGACWEQLYTPGGEVKNDDVDQSLVIAARNIVRRATVSADPLAXXLEMCHSTRIGGXXXXDILKQNPTEEQAVGICKAAMGLKISSSFSFXGFTFKRTKGSSXXXEEEMLTGNLQTLRIXIHEGYEEFTLVGKRATAILKKATRRLIQLIVSGKDEQSIXXXXVVAMVFSQEECMIKAVRXXXXXXXRANQRLNTMHQLLRHFQKNAKVLXXXXXXXXXXXVMGMVGVLPDMTPXXXXXXXXXRISKMGVDEYSNAERXIVSIDRFLRVKDQQGNVLLSPEEVSEAQGTERLTITYSSPMMWEINGPDSVLVNTYQWVIRNWEXXKIQWSQNPAXLYNKIEFEPFQSLIPKAXRSRYSGFVRTXFQQMRDILGTFDTTQIIKLLPFASAPPEQSRXQFSSLTVSVRGSGLRILVRGNSPAFNYNKXTKRLTILGKDAGTLXXXXXXXXXXSGVESAVLRGFLIIGKEDRRYGGPALSISELSNLTKGEKANVLIGQGDIVLVMKRKRNSSILTDSQTATKRLRMAINWGRIV

SEQ ID NO: 418739 - protein, 780 aa, Influenza virus
  MOD_RES (14)..(17): Any amino acid
  MOD_RES (35)..(40): Any amino acid
  MOD_RES (64)..(64): Any amino acid
  MOD_RES (74)..(78): Any amino acid
  MOD_RES (91)..(94): Any amino acid
  MOD_RES (116)..(121): Any amino acid
  MOD_RES (134)..(140): Any amino acid
  MOD_RES (175)..(183): Any amino acid
  MOD_RES (197)..(198): Any amino acid
  MOD_RES (207)..(210): Any amino acid
  MOD_RES (219)..(226): Any amino acid
  MOD_RES (305)..(308): Any amino acid
  MOD_RES (335)..(339): Any amino acid
  MOD_RES (348)..(353): Any amino acid
  MOD_RES (368)..(368): Any amino acid
  MOD_RES (408)..(416): Any amino acid
  MOD_RES (432)..(448): Any amino acid
  MOD_RES (459)..(469): Any amino acid
  MOD_RES (480)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (611)..(616): Any amino acid
  MOD_RES (674)..(674): Any amino acid
  MOD_RES (689)..(698): Any amino acid
  MOD_RES (721)..(722): Any amino acid
  MOD_RES (741)..(766): Any amino acid
SKSRSIIFNMERIXXXXTLMSQSRTREILTRTTVXXXXXXGHNQEYTSGRQEKNPSLRMKWMMXMKYPITAERXXXXXIPERNEHGQTLWXXXXDAGSDRVIVSPLAVTWWNRKGXXXXXXHYPKVYRTYFEKXXXXXXXTFGPVHFQNQVKIRRRVDVNPGHADLLSAKEAQDXXXXXXXXXEVGARIITSESQLXXTKEKKKELXXXXIAPLMMAYXXXXXXXXKTRFLPVTGGTSSVYVEVLHLTQGTCWEQLYTPGGGVRNDDIDQSLIIAARSIVRRATVSADPLLSLLEMCHGTQIGGXXXXDILKHNPTEEQAVNICKAAMGMRISSXXXXXGFTFKRTNXXXXXXEEELLTGNLQTLKLXVYEGYEEFTIVGQRATAIIRKATRRLVQLIVSGRNEQSIXXXXXXXXXFSQEDCMVKAVRGDLXXXXXXXXXXXXXXXXXRHFQKDARVLXXXXXXXXXXXVMGMIGVLPDXXXXXXXXXXXXRVSKVGVDEYSSAERXVVNIDRFLRVRDQQGNILLSPEEVSETQGIERLTIIYSSSMMWEVNGPESVLINTYQWIIKNWEXXKIQWSQEPTXLYNKVEFEPFQSLVPRAXRSQYSGFVRXXXXXXRDVIGTFDTVQVIKLLPFAAAPPKQSRMQFSSLAVNVRGSGLRILIRGNSPVFNYNRXTKRLTIIGKDAGALXXXXXXXXXXTGVESAVLRGFLILGREDKRYGXXALSINELGNLARGEKANVXXXXXXXXXXXXXXXXXXXXXXXXXXTKRIRMATNECRII

SEQ ID NO: 418740 - protein, 780 aa, Influenza virus
  MOD_RES (1)..(17): Any amino acid
  MOD_RES (35)..(43): Any amino acid
  MOD_RES (53)..(64): Any amino acid
  MOD_RES (73)..(81): Any amino acid
  MOD_RES (91)..(94): Any amino acid
  MOD_RES (105)..(106): Any amino acid
  MOD_RES (115)..(121): Any amino acid
  MOD_RES (134)..(140): Any amino acid
  MOD_RES (175)..(187): Any amino acid
  MOD_RES (196)..(198): Any amino acid
  MOD_RES (207)..(230): Any amino acid
  MOD_RES (246)..(254): Any amino acid
  MOD_RES (272)..(276): Any amino acid
  MOD_RES (292)..(308): Any amino acid
  MOD_RES (317)..(320): Any amino acid
  MOD_RES (336)..(341): Any amino acid
  MOD_RES (351)..(356): Any amino acid
  MOD_RES (368)..(368): Any amino acid
  MOD_RES (408)..(416): Any amino acid
  MOD_RES (431)..(449): Any amino acid
  MOD_RES (459)..(469): Any amino acid
  MOD_RES (483)..(491): Any amino acid
  MOD_RES (507)..(507): Any amino acid
  MOD_RES (529)..(529): Any amino acid
  MOD_RES (556)..(574): Any amino acid
  MOD_RES (583)..(583): Any amino acid
  MOD_RES (595)..(601): Any amino acid
  MOD_RES (612)..(619): Any amino acid
  MOD_RES (648)..(648): Any amino acid
  MOD_RES (674)..(674): Any amino acid
  MOD_RES (689)..(698): Any amino acid
  MOD_RES (707)..(708): Any amino acid
  MOD_RES (721)..(723): Any amino acid
  MOD_RES (740)..(766): Any amino acid
  MOD_RES (775)..(780): Any amino acid
XXXXXXXXXXXXXXXXXDLMLQSRTREILTKITVXXXXXXXXXKKYTSGRQEXXXXXXXXXXXXMKYPITANXXXXXXXXXRNEQGQALWXXXXDAGSNRVMVSXXAVTWWNRSXXXXXXXHYSKVYKTYFDKXXXXXXXAFGPVHFRNQIKIRRRVDMNPGHADLLSSKEAQDXXXXXXXXXXXXXRILASESQXXXTKEKREELXXXXXXXXXXXXXXXXXXXXXXXXLPVAGGTGSVYIEVLXXXXXXXXXQMYTPGGGVKNDDIDQSXXXXXRNIVRRAIVSADPLAXXXXXXXXXXXXXXXXXDILRQNPSXXXXVDICKAAIGLRISSSXXXXXXTFKRTKGFSXXXXXXVLTGNLQALKIXVHEGFEEFTMVGRKATAILRKATKRLIQLIVSGRDDQSIXXXXXXXXXFSQEDCMMKAVRGDXXXXXXXXXXXXXXXXXXXHFQKDAKILXXXXXXXXXXXVMGMVGILPDLTPXXXXXXXXXRVSKTGVDEYSSTEKXAVSIDRFLRVRDQLGNILLSPXEVSETQGMEKLTIIYSSSLMWEINGPXXXXXXXXXXXXXXXXXXXIQWSQNPTXLYNKLEFEPFQXXXXXXXRSLYSGFVRTXXXXXXXXLGTFDTAQIIKLLPFAAAPPVQSRMQFSXLTVNVRGTGMRILVRGNSPIFNYNKXTRRLTVLGKDAGSLXXXXXXXXXXGGVESAVLXXFLILGKENKRYGXXXLSINELSSIAKGEKANXXXXXXXXXXXXXXXXXXXXXXXXXXXTKRIRLAIXXXXXX

SEQ ID NO: 418741 - protein, 780 aa, Influenza virus
  MOD_RES (1)..(17): Any amino acid
  MOD_RES (26)..(43): Any amino acid
  MOD_RES (55)..(65): Any amino acid
  MOD_RES (74)..(81): Any amino acid
  MOD_RES (91)..(96): Any amino acid
  MOD_RES (111)..(121): Any amino acid
  MOD_RES (134)..(158): Any amino acid
  MOD_RES (176)..(198): Any amino acid
  MOD_RES (207)..(236): Any amino acid
  MOD_RES (246)..(254): Any amino acid
  MOD_RES (268)..(283): Any amino acid
  MOD_RES (292)..(320): Any amino acid
  MOD_RES (336)..(341): Any amino acid
  MOD_RES (351)..(359): Any amino acid
  MOD_RES (368)..(368): Any amino acid
  MOD_RES (378)..(382): Any amino acid
  MOD_RES (408)..(419): Any amino acid
  MOD_RES (430)..(449): Any amino acid
  MOD_RES (459)..(469): Any amino acid
  MOD_RES (483)..(491): Any amino acid
  MOD_RES (507)..(507): Any amino acid
  MOD_RES (524)..(529): Any amino acid
  MOD_RES (539)..(540): Any amino acid
  MOD_RES (551)..(574): Any amino acid
  MOD_RES (583)..(601): Any amino acid
  MOD_RES (611)..(619): Any amino acid
  MOD_RES (634)..(635): Any amino acid
  MOD_RES (651)..(654): Any amino acid
  MOD_RES (670)..(674): Any amino acid
  MOD_RES (689)..(709): Any amino acid
  MOD_RES (732)..(769): Any amino acid
  MOD_RES (778)..(780): Any amino acid
XXXXXXXXXXXXXXXXXELMSQSRTXXXXXXXXXXXXXXXXXXKKYTSARQEKNXXXXXXXXXXXKYPITADRXXXXXXXXRNEQGQMLWXXXXXXGSDRVMISPLAVTWXXXXXXXXXXXHYPKVYKPYFEKXXXXXXXXXXXXXXXXXXXXXXXXXTNPGHADISNAKEAQDVXXXXXXXXXXXXXXXXXXXXXXXTKKKKEELXXXXXXXXXXXXXXXXXXXXXXXXXXXXXXTSSMYIEVLXXXXXXXXXQMYTPGGKVRNDDXXXXXXXXXXXXXXXXTVSADPLVXXXXXXXXXXXXXXXXXXXXXXXXXXXXXVDICKAALGLRISSSXXXXXXTFKRTSGTSXXXXXXXXXGNLQTLKVXVHMGYEEFTXXXXXATAIFRKATRRMIQLIVSGRDEQSVXXXXXXXXXXXXEDRMIKAVRGXXXXXXXXXXXXXXXXXXXXHFQKDAKMLXXXXXXXXXXXIMGMIGILSDMTPXXXXXXXXXRVSRMGVDEYSNAEKXTVSIDRFLRVRDQMGNXXXXXXEISETQGTEXXTITYSSSLMWXXXXXXXXXXXXXXXXXXXXXXXXIQWSQNPSXXXXXXXXXXXXXXXXXXXRCQYSGFVRXXXXXXXXXLGTFDTIQIIKLLPXXAAPPVQSKMQFSSLTXXXXGSGMRILIRGNSPIFXXXXXTKRLAVLGKDAGELXXXXXXXXXXXXXXXXXXXXXLILGKEDRKRYGPALSINELSKXXXXXXXXXXXXXXXXXXXXXXXXXXXXXXXXXXXXXXIRMAINYSXXX

SEQ ID NO: 418742 - protein, 780 aa, Influenza virus
  MOD_RES (1)..(65): Any amino acid
  MOD_RES (74)..(159): Any amino acid
  MOD_RES (177)..(257): Any amino acid
  MOD_RES (266)..(389): Any amino acid
  MOD_RES (401)..(518): Any amino acid
  MOD_RES (529)..(534): Any amino acid
  MOD_RES (543)..(638): Any amino acid
  MOD_RES (648)..(684): Any amino acid
  MOD_RES (694)..(712): Any amino acid
  MOD_RES (721)..(769): Any amino acid
  MOD_RES (778)..(780): Any amino acid
XXXXXXXXXXXXXXXXXXXXXXXXXXXXXXXXXXXXXXXXXXXXXXXXXXXXXXXXXXXXXXXXXKYPITAEKXXXXXXXXXXXXXXXXXXXXXXXXXXXXXXXXXXXXXXXXXXXXXXXXXXXXXXXXXXXXXXXXXXXXXXXXXXXXXXXXXXXXXXNPGHSDLSSTKEAQDVIXXXXXXXXXXXXXXXXXXXXXXXXXXXXXXXXXXXXXXXXXXXXXXXXXXXXXXXXXXXXXXXXXXXXXXXXXXXXXXXXXTPGGEVINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXATRKLIQLIVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDQRGNILLSPXXXXXXQGIEKLTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPEQSKMQFSXXXXXXXXXXXXXXXXXXXXXXXXXXXXXXXXXXXXXAGAGALAEDXXXXXXXXXXXXXXXXXXXGKENKKYGXXXXXXXXXXXXXXXXXXXXXXXXXXXXXXXXXXXXXXXXXXXXXXXXXIRMAINWGXXX

SEQ ID NO: 418743 - protein, 780 aa, Influenza virus
  MOD_RES (1)..(165): Any amino acid
  MOD_RES (174)..(259): Any amino acid
  MOD_RES (272)..(394): Any amino acid
  MOD_RES (403)..(713): Any amino acid
  MOD_RES (728)..(769): Any amino acid
  MOD_RES (778)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLSAKEAQXXXXXXXXXXXXXXXXXXXXXXXXXXXXXXXXXXXXXXXXXXXXXXXXXXXXXXXXXXXXXXXXXXXXXXXXXXXXXXXXXXXXXXGGEVKNDEVDQSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVQLIVSGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQKKDKRYGPALSISXXXXXXXXXXXXXXXXXXXXXXXXXXXXXXXXXXXXXXXXXXIRMAINLVXXX

SEQ ID NO: 418744 - protein, 780 aa, Influenza virus
  MOD_RES (1)..(165): Any amino acid
  MOD_RES (174)..(395): Any amino acid
  MOD_RES (406)..(714): Any amino acid
  MOD_RES (724)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLSSKEAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQLVVSGRDEQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEDKRYGPAXXXXXXXXXXXXXXXXXXXXXXXXXXXXXXXXXXXXXXXXXXXXXXXXXXXXXXXXX

SEQ ID NO: 418745 - protein, 780 aa, Influenza virus
  MOD_RES (1)..(165): Any amino acid
  MOD_RES (175)..(714): Any amino acid
  MOD_RES (726)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLNAKEAQDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEDRRYGPALSXXXXXXXXXXXXXXXXXXXXXXXXXXXXXXXXXXXXXXXXXXXXXXXXXXXXXXX

SEQ ID NO: 418746 - protein, 780 aa, Influenza virus
  MOD_RES (1)..(165): Any amino acid
  MOD_RES (175)..(714): Any amino acid
  MOD_RES (723)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDISAKEAQDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXREDKRYGPXXXXXXXXXXXXXXXXXXXXXXXXXXXXXXXXXXXXXXXXXXXXXXXXXXXXXXXXXX

SEQ ID NO: 418747 - protein, 780 aa, Influenza virus
  MOD_RES (1)..(165): Any amino acid
  MOD_RES (175)..(714): Any amino acid
  MOD_RES (725)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLSTKEAQDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKENKRYGPALXXXXXXXXXXXXXXXXXXXXXXXXXXXXXXXXXXXXXXXXXXXXXXXXXXXXXXXX

SEQ ID NO: 418748 - protein, 780 aa, Influenza virus
  MOD_RES (1)..(167): Any amino acid
  MOD_RES (176)..(714): Any amino acid
  MOD_RES (727)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSVKEAQDVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKENKKYGPALSIXXXXXXXXXXXXXXXXXXXXXXXXXXXXXXXXXXXXXXXXXXXXXXXXXXXXXX

SEQ ID NO: 418749 - protein, 742 aa, Influenza virus
  MOD_RES (12)..(14): Any amino acid
  MOD_RES (25)..(31): Any amino acid
  MOD_RES (47)..(74): Any amino acid
  MOD_RES (95)..(154): Any amino acid
  MOD_RES (165)..(223): Any amino acid
  MOD_RES (233)..(233): Any amino acid
  MOD_RES (243)..(280): Any amino acid
  MOD_RES (290)..(298): Any amino acid
  MOD_RES (312)..(341): Any amino acid
  MOD_RES (358)..(369): Any amino acid
  MOD_RES (388)..(393): Any amino acid
  MOD_RES (403)..(422): Any amino acid
  MOD_RES (432)..(432): Any amino acid
  MOD_RES (459)..(459): Any amino acid
  MOD_RES (471)..(477): Any amino acid
  MOD_RES (491)..(496): Any amino acid
  MOD_RES (507)..(641): Any amino acid
  MOD_RES (659)..(681): Any amino acid
  MOD_RES (696)..(718): Any amino acid
KQGKTKATKMKXXXIFIFILLTHWXXXXXXXSQITNGTTGNPIICLXXXXXXXXXXXXXXXXXXXXXXXXXXXXGVIPLTTTPTKSYFANLKGTXXXXXXXXXXXXXXXXXXXXXXXXXXXXXXXXXXXXXXXXXXXXXXXXXXXXXXXXXXXXIMHDRTKIRQXXXXXXXXXXXXXXXXXXXXXXXXXXXXXXXXXXXXXXXXXXXXXXXXXXXXXXXXXXXEKENSYPMIXLTVEVPYVCXXXXXXXXXXXXXXXXXXXXXXXXXXXXXXXXXXXXXXGVTTHYVSQXXXXXXXXXDEGLPQSGRIVVDXXXXXXXXXXXXXXXXXXXXXXXXXXXXXXAPSGIEYNGKSLGIQSXXXXXXXXXXXXPSVKLPMGAIGAIDSSMPXXXXXXGEHAKAIGNXXXXXXXXXXXXXXXXXXXXIPIGERGLFXKKKRGLFGAHKQLTHHMRKKRGLFGAXRETRGLFGAIAXXXXXXXLFGAIAGFIEGGWXXXXXXGRLVRFRHQNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPTFDSLNITAASLNDDXXXXXXXXXXXXXXXXXXXXXXXVTTRQASPSCLVVRXXXXXXXXXXXXXXXXXXXXXXXLCSVEYASKTRISEDFRDMRKNTL

SEQ ID NO: 418750 - protein, 742 aa, Influenza virus
  MOD_RES (1)..(2): Any amino acid
  MOD_RES (12)..(14): Any amino acid
  MOD_RES (25)..(40): Any amino acid
  MOD_RES (50)..(223): Any amino acid
  MOD_RES (233)..(341): Any amino acid
  MOD_RES (355)..(378): Any amino acid
  MOD_RES (388)..(422): Any amino acid
  MOD_RES (447)..(459): Any amino acid
  MOD_RES (479)..(479): Any amino acid
  MOD_RES (491)..(688): Any amino acid
  MOD_RES (704)..(732): Any amino acid
  MOD_RES (742)..(742): Any amino acid
XXSKSRGYKMNXXXIFNFILLTHWXXXXXXXXXXXXXXXXNNNNNTATLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKENSYPKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAPSGVEYNGKSLGXXXXXXXXXXXXXXXXXXXXXXXXYGGLNKSKPXXXXXXXXXXXXXXXXXXXXXXXXXXXXXXXXXXXPAKLLKERGFFGKRRKKRGLFGAIXXXXXXXXXXXXXRMTRGLFGAIGLFGAIAGFXGAIAGFIENGWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPSTGNHGSLVLSLXXXXXXXXXXXXXXXXXXXXXXXXXXXXXRFVNSDCSKX

SEQ ID NO: 418751 - protein, 742 aa, Influenza virus
  MOD_RES (1)..(2): Any amino acid
  MOD_RES (12)..(14): Any amino acid
  MOD_RES (25)..(43): Any amino acid
  MOD_RES (53)..(223): Any amino acid
  MOD_RES (233)..(341): Any amino acid
  MOD_RES (351)..(383): Any amino acid
  MOD_RES (395)..(424): Any amino acid
  MOD_RES (440)..(440): Any amino acid
  MOD_RES (450)..(459): Any amino acid
  MOD_RES (479)..(732): Any amino acid
XXGKTKATKMEXXXIFIFLLLTHWXXXXXXXXXXXXXXXXXXXNNSTATLCLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNNKNATNPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNNNKGAVFKXXXXXXXXXXXXXXXXXXXXXXXXXXXXXXXXXTSLTSLPFQNIXXXXXXXXXXXXXXXXXXXXXXXXXXXXXXREREGGRRRKRGLFGXTHKQLTHHMXXXXXXXXXXRKTRGLFGAIGIFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDQNFRNIRK

SEQ ID NO: 418752 - protein, 742 aa, Influenza virus
  MOD_RES (1)..(2): Any amino acid
  MOD_RES (12)..(17): Any amino acid
  MOD_RES (27)..(43): Any amino acid
  MOD_RES (53)..(430): Any amino acid
  MOD_RES (440)..(440): Any amino acid
  MOD_RES (450)..(459): Any amino acid
  MOD_RES (487)..(742): Any amino acid
XXMKSRGYKMNXXXXXXRFSYVFCLAXXXXXXXXXXXXXXXXXSDNADKICLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRKKRGLFGXIHKQLTHHMXXXXXXXXXXQMTRGLFGARGLFGAIAGIFGAIAGFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418753 - protein, 742 aa, Influenza virus
  MOD_RES (1)..(17): Any amino acid
  MOD_RES (27)..(430): Any amino acid
  MOD_RES (440)..(461): Any amino acid
  MOD_RES (471)..(742): Any amino acid
XXXXXXXXXXXXXXXXXVLSCIFCLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRKRGLFGAXXXXXXXXXXXXXXXXXXXXXXPRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418754 - protein, 742 aa, Influenza virus
  MOD_RES (1)..(430): Any amino acid
  MOD_RES (440)..(461): Any amino acid
  MOD_RES (471)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRKKRGLFGXXXXXXXXXXXXXXXXXXXXXXKRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418755 - protein, 742 aa, Influenza virus
  MOD_RES (1)..(430): Any amino acid
  MOD_RES (440)..(461): Any amino acid
  MOD_RES (471)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRKRRGLFGXXXXXXXXXXXXXXXXXXXXXXARGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418756 - protein, 742 aa, Influenza virus
  MOD_RES (1)..(434): Any amino acid
  MOD_RES (447)..(462): Any amino acid
  MOD_RES (477)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRRQKRGLFGAIXXXXXXXXXXXXXXXXTKPRPRRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418757 - protein, 742 aa, Influenza virus
  MOD_RES (1)..(468): Any amino acid
  MOD_RES (478)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGIFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418758 - protein, 742 aa, Influenza virus
  MOD_RES (1)..(468): Any amino acid
  MOD_RES (478)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418759 - protein, 694 aa, Influenza virus
  MOD_RES (27)..(76): Any amino acid
  MOD_RES (88)..(385): Any amino acid
  MOD_RES (397)..(410): Any amino acid
  MOD_RES (421)..(425): Any amino acid
  MOD_RES (435)..(441): Any amino acid
  MOD_RES (451)..(453): Any amino acid
  MOD_RES (463)..(473): Any amino acid
  MOD_RES (483)..(546): Any amino acid
  MOD_RES (557)..(659): Any amino acid
  MOD_RES (677)..(677): Any amino acid
  MOD_RES (687)..(694): Any amino acid
IGLREQKQEFKMNPNKKIIIAIGSVSXXXXXXXXXXXXXXXXXXXXXXXXXXXXXXXXXXXXXXXXXXXXXXXXXXVPLVPCEPIIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILRTQESECVCXXXXXXXXXXXXXXIREGLILEYYXXXXXGKKGKWLNQXXXXXXXIQHLEECSCXXXSYLNVRCVCXXXXXXXXXXXKLDINMADYXXXXXXXXXXXXXXXXXXXXXXXXXXXXXXXXXXXXXXXXXXXXXXXXXXXXXXXXXXXXXXXXNNYGVKGFGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFLWCKIVTTVGWSWPDXRTSISCLYKXXXXXXXX

SEQ ID NO: 418760 - protein, 694 aa, Influenza virus
  MOD_RES (31)..(385): Any amino acid
  MOD_RES (397)..(410): Any amino acid
  MOD_RES (421)..(425): Any amino acid
  MOD_RES (435)..(441): Any amino acid
  MOD_RES (451)..(453): Any amino acid
  MOD_RES (463)..(546): Any amino acid
  MOD_RES (556)..(684): Any amino acid
LVFREQKQEFKMNPNQKIINRDITIGSICMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILRTQESSCTCXXXXXXXXXXXXXXIRKGLILEYYXXXXXGKRGKWVKSXXXXXXXIKHLEECSCXXXSYPNVRCVCXXXXXXXXXXXXXXXXXXXXXXXXXXXXXXXXXXXXXXXXXXXXXXXXXXXXXXXXXXXXXXXXXXXXXXXXXXXXXXXXXXXXDNYGVKGFGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLHAYISFRNL

SEQ ID NO: 418761 - protein, 694 aa, Influenza virus
  MOD_RES (1)..(1): Any amino acid
  MOD_RES (20)..(385): Any amino acid
  MOD_RES (397)..(411): Any amino acid
  MOD_RES (421)..(425): Any amino acid
  MOD_RES (435)..(441): Any amino acid
  MOD_RES (451)..(694): Any amino acid
XFSGSQKQEFKMNPNQKIMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIMRTQESECACXXXXXXXXXXXXXXXVMGQASYKIXXXXXEKGKVVKSVXXXXXXXVQHLEECSCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418762 - protein, 694 aa, Influenza virus
  MOD_RES (1)..(5): Any amino acid
  MOD_RES (19)..(387): Any amino acid
  MOD_RES (397)..(417): Any amino acid
  MOD_RES (428)..(441): Any amino acid
  MOD_RES (451)..(694): Any amino acid
XXXXXQKQEIKMNPNQKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTQESECQCXXXXXXXXXXXXXXXXXXXXXYKYKIFKNGKXXXXXXXXXXXXXXIRHLEECSCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418763 - protein, 694 aa, Influenza virus
  MOD_RES (1)..(5): Any amino acid
  MOD_RES (19)..(387): Any amino acid
  MOD_RES (397)..(694): Any amino acid
XXXXXAKAGVKMNPNQKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTQESSCVCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418764 - protein, 502 aa, Influenza virus
  MOD_RES (30)..(43): Any amino acid
  MOD_RES (53)..(110): Any amino acid
  MOD_RES (165)..(165): Any amino acid
  MOD_RES (229)..(237): Any amino acid
  MOD_RES (249)..(249): Any amino acid
  MOD_RES (272)..(276): Any amino acid
  MOD_RES (286)..(289): Any amino acid
  MOD_RES (305)..(307): Any amino acid
  MOD_RES (328)..(330): Any amino acid
  MOD_RES (348)..(364): Any amino acid
  MOD_RES (385)..(389): Any amino acid
  MOD_RES (401)..(416): Any amino acid
  MOD_RES (452)..(454): Any amino acid
  MOD_RES (471)..(472): Any amino acid
  MOD_RES (496)..(502): Any amino acid
IGLREQKQEFKMNPNKKIIRDITIGSICMXXXXXXXXXXXXXXDLNMGQPFYXXXXXXXXXXXXXXXXXXXXXXXXXXXXXXXXXXXXXXXXXXXXXXXXXXXXXXXXXXGWAIYSKDNSIRIGSKGDVFVIREPFISCSHLECRTFFLTQGALLNDKHSNGTIXDRSPYRTLMSCPIGEVPSPYNSRFESVAWSASACHDGINWLTIGISGPDNGAVAVLKYNGIITXXXXXXXXXILRTQESECACXNGSCFTVMTDGPSVMGQASYKIXXXXXGKKGKWLNQXXXXAPNYHYEECSCYPDSXXXTCVCRDNWHGSNRPWVSFNQXXXYQIGYICSGVFGDNPRPXXXXXXXXXXXXXXXXXGVKGFSFKYGNGVWIGRTKSXXXXXGFEMIWDPNGWXXXXXXXXXXXXXXXXTDWSGYSGSFVQHPELTGLDCIRPCFWVELIRGRPXXXTTIWTSGSSISFCGVNXXIFLWCKIVTTVGWSWPDGAELPFXXXXXXX

SEQ ID NO: 418765 - protein, 502 aa, Influenza virus
  MOD_RES (20)..(43): Any amino acid
  MOD_RES (53)..(110): Any amino acid
  MOD_RES (165)..(165): Any amino acid
  MOD_RES (190)..(194): Any amino acid
  MOD_RES (229)..(237): Any amino acid
  MOD_RES (248)..(249): Any amino acid
  MOD_RES (263)..(268): Any amino acid
  MOD_RES (286)..(289): Any amino acid
  MOD_RES (305)..(307): Any amino acid
  MOD_RES (328)..(330): Any amino acid
  MOD_RES (348)..(364): Any amino acid
  MOD_RES (385)..(389): Any amino acid
  MOD_RES (401)..(416): Any amino acid
  MOD_RES (452)..(454): Any amino acid
  MOD_RES (471)..(484): Any amino acid
  MOD_RES (496)..(502): Any amino acid
LVFREQKQEFKMNPNQKIIXXXXXXXXXXXXXXXXXXXXXXXXASQYGPSHSXXXXXXXXXXXXXXXXXXXXXXXXXXXXXXXXXXXXXXXXXXXXXXXXXXXXXXXXXXGWAIYTKDNSIRIGSRGDVFVMREPFISCSPLECKTFFLTQGALLNDRHSNGTVXDRSPYRALMSCPLGEAPSPYNSRFXXXXXSASACHDGMSWLTIGISGPDDGAVAVLKYKGIITXXXXXXXXXIMRTQESECAXXNGSCFTIMTDGPSXXXXXXYKYKIFKNGKRGKWVKSXXXXAPNFHYEECSCYPESXXXMCVCRDNWHASNRPWVSFDQXXXYQMGYICSGIFGDNPRPXXXXXXXXXXXXXXXXXGVKGFSYKYDNGVWIGRTKNXXXXXGFEMIWDPDGWXXXXXXXXXXXXXXXXNEWSGYSGSFIQHPELTGLNCIRPCFWVELVRGLPXXXATIWTSGSSISFCGVDXXXXXXXXXXXXXXWSWPDGADLPFXXXXXXX

SEQ ID NO: 418766 - protein, 502 aa, Influenza virus
  MOD_RES (1)..(1): Any amino acid
  MOD_RES (20)..(110): Any amino acid
  MOD_RES (151)..(155): Any amino acid
  MOD_RES (165)..(165): Any amino acid
  MOD_RES (229)..(238): Any amino acid
  MOD_RES (249)..(249): Any amino acid
  MOD_RES (263)..(276): Any amino acid
  MOD_RES (286)..(289): Any amino acid
  MOD_RES (305)..(307): Any amino acid
  MOD_RES (328)..(330): Any amino acid
  MOD_RES (348)..(364): Any amino acid
  MOD_RES (381)..(389): Any amino acid
  MOD_RES (401)..(416): Any amino acid
  MOD_RES (426)..(426): Any amino acid
  MOD_RES (452)..(455): Any amino acid
  MOD_RES (471)..(484): Any amino acid
  MOD_RES (496)..(502): Any amino acid
XFSGSQKQEFKMNPNQKIMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAVYSKDNSVRIGSKGDVFVVREPFISCSQMECRTFFLTXXXXXNDKHSNGTVXDRSPHRTLMSCPVGEAPSPYNSKFESVAWSASACHDGTGWLTIGISGPDSGAVAVLKYNGMITXXXXXXXXXXLRTQESECVCXNGSCFTVLTDGPSXXXXXXXXXXXXXXEKGKVVKSVXXXXAPNFYYEECSCYPDTXXXVCVCRDNWHASNRPWISFDQXXXYKIGYICSGVFGDSPRPXXXXXXXXXXXXXXXXXGVKGFSFRYGNGVWIGXXXXXXXXXGFEMVWDPNGWXXXXXXXXXXXXXXXXNDWSGYSGSXVQHPELTGMNCMRPCFWVELIRGQPXXXXTIWASGSSISFCGVSXXXXXXXXXXXXXXWSWPDGAEVPFXXXXXXX

SEQ ID NO: 418767 - protein, 502 aa, Influenza virus
  MOD_RES (1)..(5): Any amino acid
  MOD_RES (28)..(110): Any amino acid
  MOD_RES (137)..(141): Any amino acid
  MOD_RES (151)..(155): Any amino acid
  MOD_RES (165)..(165): Any amino acid
  MOD_RES (187)..(194): Any amino acid
  MOD_RES (229)..(249): Any amino acid
  MOD_RES (263)..(289): Any amino acid
  MOD_RES (305)..(307): Any amino acid
  MOD_RES (328)..(330): Any amino acid
  MOD_RES (347)..(364): Any amino acid
  MOD_RES (384)..(416): Any amino acid
  MOD_RES (426)..(427): Any amino acid
  MOD_RES (452)..(455): Any amino acid
  MOD_RES (466)..(484): Any amino acid
  MOD_RES (496)..(502): Any amino acid
XXXXXQKQEIKMNPNQKINRDITIGSIXXXXXXXXXXXXXXXXXXXXXXXXXXXXXXXXXXXXXXXXXXXXXXXXXXXXXXXXXXXXXXXXXXXXXXXXXXXXXXXXXXXGWAVHSKDNGIRIGSKGDIFVIREPFXXXXXSECRTFFLTXXXXXNDKHSNGTAXDRSPHRALMSCPIGEAPSPYNXXXXXXXXSASACHDGLGWITIGISGPDNEAVAVLKYNGVITXXXXXXXXXXXXXXXXXXXXXNGFCFTVMTDGPNXXXXXXXXXXXXXXXXXXXXXXXXXXXAPNSHYEECSCYPDAXXXICVCRDNWHGANRPWVSFNHXXXYQVGYICSGVLGDNPRXXXXXXXXXXXXXXXXXXGIKGFSFKYGNGVWMGRTKXXXXXXXXXXXXXXXXXXXXXXXXXXXXXXXXXTNWSGYSGSXXQHPELTGMDCMRPCFWVELVRGRPXXXXTVWTSGSSISXXXXXXXXXXXXXXXXXXXWSWPDDAELPFXXXXXXX

SEQ ID NO: 418768 - protein, 502 aa, Influenza virus
  MOD_RES (1)..(110): Any amino acid
  MOD_RES (137)..(155): Any amino acid
  MOD_RES (165)..(165): Any amino acid
  MOD_RES (187)..(194): Any amino acid
  MOD_RES (204)..(205): Any amino acid
  MOD_RES (229)..(249): Any amino acid
  MOD_RES (259)..(289): Any amino acid
  MOD_RES (302)..(318): Any amino acid
  MOD_RES (328)..(330): Any amino acid
  MOD_RES (348)..(364): Any amino acid
  MOD_RES (384)..(435): Any amino acid
  MOD_RES (448)..(455): Any amino acid
  MOD_RES (471)..(486): Any amino acid
  MOD_RES (496)..(502): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIHSKDNNIRIGSKGDIFVMREPFXXXXXXXXXXXXXXXXXXXNDRHSNGTIXDRSPFRALMSCPVGEVPSPYNXXXXXXXXSASACHDGVXXLTIGVSGPDNGAVAVVKYNGIITXXXXXXXXXXXXXXXXXXXXXNGYCFTVMTXXXXXXXXXXXXXXXXXXXXXXXXXXXXXXXAPNYYYEECSCYXXXXXXXXXXXXXXXXXNRPWISFNQXXXYRIGYICSGVFGDNPRSXXXXXXXXXXXXXXXXXGVKGFSYRYGDGVWIGRTKXXXXXXXXXXXXXXXXXXXXXXXXXXXXXXXXXXXXXXXXXXXXXXXXXXXXNCIKPCFWVELIXXXXXXXXTIWTSGSIISFCGVNXXXXXXXXXXXXXXXXWPDGAKLPFXXXXXXX

SEQ ID NO: 418769 - protein, 502 aa, Influenza virus
  MOD_RES (1)..(129): Any amino acid
  MOD_RES (139)..(250): Any amino acid
  MOD_RES (261)..(338): Any amino acid
  MOD_RES (348)..(371): Any amino acid
  MOD_RES (381)..(455): Any amino acid
  MOD_RES (470)..(502): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFIIREPFISXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSCFTLMTDGXXXXXXXXXXXXXXXXXXXXXXXXXXXXXXXXXXXXXXXXXXXXXXXXXXXXXXXXXXXXXXXXXXXXXXXXXXXXXXGVFGDTPRPXXXXXXXXXXXXXXXXXXXXXXXXKYGDGVWIGXXXXXXXXXXXXXXXXXXXXXXXXXXXXXXXXXXXXXXXXXXXXXXXXXXXXXXXXXXXXXXXXXXXXXXXXXXXTIWTSASSISFCGVXXXXXXXXXXXXXXXXXXXXXXXXXXXXXXXXX

SEQ ID NO: 418770 - protein, 502 aa, Influenza virus
  MOD_RES (1)..(253): Any amino acid
  MOD_RES (263)..(502): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFTIMTDGPNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418771 - protein, 494 aa, Influenza virus
  MOD_RES (22)..(53): Any amino acid
  MOD_RES (63)..(71): Any amino acid
  MOD_RES (81)..(85): Any amino acid
  MOD_RES (96)..(109): Any amino acid
  MOD_RES (127)..(127): Any amino acid
  MOD_RES (140)..(141): Any amino acid
  MOD_RES (155)..(167): Any amino acid
  MOD_RES (211)..(234): Any amino acid
  MOD_RES (250)..(250): Any amino acid
  MOD_RES (263)..(285): Any amino acid
  MOD_RES (301)..(303): Any amino acid
  MOD_RES (329)..(333): Any amino acid
  MOD_RES (347)..(364): Any amino acid
  MOD_RES (375)..(388): Any amino acid
  MOD_RES (398)..(421): Any amino acid
  MOD_RES (432)..(434): Any amino acid
  MOD_RES (449)..(453): Any amino acid
AKAGVKMNPNQKIIIAIGSVSXXXXXXXXXXXXXXXXXXXXXXXXXXXXXXXXKNNQVILCEXXXXXXXXXKTVVHLNSTXXXXXEKEKEICSVVXXXXXXXXXXXXXXGFAPFSKDNSIRLSAGGXIWVTREPYVSCDXXKCYQFALGQGTTLXXXXXXXXXXXXXPYRTLLMNELGVPFHLGTKQVCIAWSSSSCHDGKAWLHVCVTGXXXXXXXXXXXXXXXXXXXXXXXXNILRTQESECVCINGXCTVVMTDGSASGXXXXXXXXXXXXXXXXXXXXXXXGSAQHVEECSCYPRYXXXVRCVCRDNWKGSNRPIKLDINMADYXXXXXYVCSGLVGDTPRKXXXXXXXXXXXXXXXXXXHGVKGWAFDDXXXXXXXXXXXXXXRSGYETFKVXXXXXXXXXXXXXXXXXXXXXXXXSGYSGIFSVEXXXCINRCFYVELIRGRXXXXXVWWTSNSIVVFCGTSGTYGTGSWPDGADIINLHAYISFRNL

SEQ ID NO: 418772 - protein, 494 aa, Influenza virus
  MOD_RES (1)..(53): Any amino acid
  MOD_RES (63)..(109): Any amino acid
  MOD_RES (127)..(127): Any amino acid
  MOD_RES (140)..(141): Any amino acid
  MOD_RES (151)..(167): Any amino acid
  MOD_RES (211)..(234): Any amino acid
  MOD_RES (250)..(250): Any amino acid
  MOD_RES (263)..(285): Any amino acid
  MOD_RES (301)..(303): Any amino acid
  MOD_RES (320)..(333): Any amino acid
  MOD_RES (347)..(364): Any amino acid
  MOD_RES (375)..(388): Any amino acid
  MOD_RES (398)..(421): Any amino acid
  MOD_RES (432)..(434): Any amino acid
  MOD_RES (449)..(453): Any amino acid
  MOD_RES (493)..(494): Any amino acid
XXXXXXXXXXXXXXXXXXXXXXXXXXXXXXXXXXXXXXXXXXXXXXXXXXXXXKNNQVILCGXXXXXXXXXXXXXXXXXXXXXXXXXXXXXXXXXXXXXXXXXXXXXXXGFAPFAKDNSIRLSASGXIWITREPYVSCGXXRCYQFALGQXXXXXXXXXXXXXXXXXPHRTLLMNELGIPFHLGTKQVCMAWSSSSCHDGRAWLHVCITGXXXXXXXXXXXXXXXXXXXXXXXXKILRTQESECICINGXCAVVMTDGSASEXXXXXXXXXXXXXXXXXXXXXXXGSAQHIEECSCYPRFXXXVRCICRDNWKGSNRPVXXXXXXXXXXXXXXYLCSGLVGDTPRNXXXXXXXXXXXXXXXXXXPGVKGWAFDNXXXXXXXXXXXXXXRSGYETFRVXXXXXXXXXXXXXXXXXXXXXXXXSGYSGVFSVEXXXCVNRCFYVELIRGSXXXXXVLWTSNSIVAFCGTSGTYGSGSWPDGANIISCLYKLSQFXX

SEQ ID NO: 418773 - protein, 494 aa, Influenza virus
  MOD_RES (1)..(58): Any amino acid
  MOD_RES (70)..(109): Any amino acid
  MOD_RES (127)..(127): Any amino acid
  MOD_RES (140)..(141): Any amino acid
  MOD_RES (151)..(167): Any amino acid
  MOD_RES (208)..(234): Any amino acid
  MOD_RES (250)..(250): Any amino acid
  MOD_RES (263)..(285): Any amino acid
  MOD_RES (301)..(303): Any amino acid
  MOD_RES (320)..(333): Any amino acid
  MOD_RES (347)..(364): Any amino acid
  MOD_RES (375)..(388): Any amino acid
  MOD_RES (398)..(421): Any amino acid
  MOD_RES (432)..(439): Any amino acid
  MOD_RES (449)..(453): Any amino acid
  MOD_RES (492)..(494): Any amino acid
XXXXXXXXXXXXXXXXXXXXXXXXXXXXXXXXXXXXXXXXXXXXXXXXXXXXXXXXXXVPLVPCEPIIIXXXXXXXXXXXXXXXXXXXXXXXXXXXXXXXXXXXXXXXXGFVPFSKDNSIRLAAGGXIWVTRELYVSCDXXNCYQFALGQXXXXXXXXXXXXXXXXXPHRTLLMSELGVPFHLATKQVCVAWSSSSCHDGNAWLHVCXXXXXXXXXXXXXXXXXXXXXXXXXXXEILRTQESECVCISGXCTVVMTDGNASGXXXXXXXXXXXXXXXXXXXXXXXGNAQHVEECSCYPQYXXXIRCVCRDNWRGSNRPVXXXXXXXXXXXXXXYMCSGLVGDTPRSXXXXXXXXXXXXXXXXXXQGVKGWAFDSXXXXXXXXXXXXXXRLGYETFKVXXXXXXXXXXXXXXXXXXXXXXXXSGYSGIFSIEXXXXXXXXFYVELVRGRXXXXXVWWTSNSIIVFCGTSGTYGAGSWPDGADLIKSHAYISFXXX

SEQ ID NO: 418774 - protein, 494 aa, Influenza virus
  MOD_RES (1)..(109): Any amino acid
  MOD_RES (124)..(127): Any amino acid
  MOD_RES (140)..(167): Any amino acid
  MOD_RES (211)..(234): Any amino acid
  MOD_RES (250)..(250): Any amino acid
  MOD_RES (263)..(290): Any amino acid
  MOD_RES (309)..(310): Any amino acid
  MOD_RES (320)..(337): Any amino acid
  MOD_RES (347)..(365): Any amino acid
  MOD_RES (375)..(388): Any amino acid
  MOD_RES (398)..(453): Any amino acid
  MOD_RES (493)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFAPFTKDNSIRLSXXXXVWVTREPYVSCSXXXXXXXXXXXXXXXXXXXXXXXXXXXXPYRTLLMSELGVPFHLGTRQVCIAWSSSSCYDGKAWLHICVTGXXXXXXXXXXXXXXXXXXXXXXXXDILRTQESECVCIDGXCTVIMTDGSASGXXXXXXXXXXXXXXXXXXXXXXXXXXXXIEECSCYPQSYLNVRCVCXXNWRGSNRPIXXXXXXXXXXXXXXXXXXGLVGDTPRDXXXXXXXXXXXXXXXXXXXGVKGWAFDYXXXXXXXXXXXXXXRAGYETFRVXXXXXXXXXXXXXXXXXXXXXXXXXXXXXXXXXXXXXXXXXXXXXXXXXXXXXXXXVWWTANSIIVFCGTSGTYGTGTWPDGADIINFMPYISFAXX

SEQ ID NO: 418775 - protein, 494 aa, Influenza virus
  MOD_RES (1)..(110): Any amino acid
  MOD_RES (123)..(130): Any amino acid
  MOD_RES (140)..(167): Any amino acid
  MOD_RES (177)..(177): Any amino acid
  MOD_RES (188)..(234): Any amino acid
  MOD_RES (250)..(253): Any amino acid
  MOD_RES (263)..(291): Any amino acid
  MOD_RES (301)..(304): Any amino acid
  MOD_RES (314)..(337): Any amino acid
  MOD_RES (347)..(365): Any amino acid
  MOD_RES (375)..(388): Any amino acid
  MOD_RES (398)..(455): Any amino acid
  MOD_RES (471)..(473): Any amino acid
  MOD_RES (483)..(483): Any amino acid
  MOD_RES (493)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFAPLSKDNSIRLXXXXXXXXTREPYVSCEXXXXXXXXXXXXXXXXXXXXXXXXXXXXSHRTLLMNEXGVPFYLGTKQXXXXXXXXXXXXXXXXXXXXXXXXXXXXXXXXXXXXXXXXXXXXXXXSILRTQESECVCINEXXXXVMTDGSASDXXXXXXXXXXXXXXXXXXXXXXXXXXXXXEECSCYPRHXXXXKCVCRDNWKXXXXXXXXXXXXXXXXXXXXXXXXGLVGDTPREXXXXXXXXXXXXXXXXXXXGVKGWAFDVXXXXXXXXXXXXXXRAGYETFKVXXXXXXXXXXXXXXXXXXXXXXXXXXXXXXXXXXXXXXXXXXXXXXXXXXXXXXXXXXWTSNSIIAFCGTSGTXXXGSWPDGAEIXGLMGRTRISXX

SEQ ID NO: 418776 - protein, 494 aa, Influenza virus
  MOD_RES (1)..(112): Any amino acid
  MOD_RES (127)..(184): Any amino acid
  MOD_RES (195)..(260): Any amino acid
  MOD_RES (271)..(291): Any amino acid
  MOD_RES (301)..(479): Any amino acid
  MOD_RES (491)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFSKDNSVRLSAGGXXXXXXXXXXXXXXXXXXXXXXXXXXXXXXXXXXXXXXXXXXXXXXXXXXXXXXXXXXTRQVCMAWSSXXXXXXXXXXXXXXXXXXXXXXXXXXXXXXXXXXXXXXXXXXXXXXXXXXXXXXXXXXXXXXXXXXIRKGLILEYYXXXXXXXXXXXXXXXXXXXXXEECSCYPSYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTSISCLYKLSXXXX

SEQ ID NO: 418777 - protein, 494 aa, Influenza virus
  MOD_RES (1)..(260): Any amino acid
  MOD_RES (271)..(299): Any amino acid
  MOD_RES (309)..(480): Any amino acid
  MOD_RES (491)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIREGLILEYYXXXXXXXXXXXXXXXXXXXXXXXXXXXXXSYPNVRCVCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXADINLHAYISXXXX

SEQ ID NO: 418778 - protein, 494 aa, Influenza virus
  MOD_RES (1)..(480): Any amino acid
  MOD_RES (491)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXADIKSHAYISXXXX

SEQ ID NO: 418779 - protein, 494 aa, Influenza virus
  MOD_RES (1)..(480): Any amino acid
  MOD_RES (491)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXADINLMPIYSXXXX

SEQ ID NO: 418780 - protein, 494 aa, Influenza virus
  MOD_RES (1)..(480): Any amino acid
  MOD_RES (491)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXANINFMPYISXXXX

SEQ ID NO: 418781 - protein, 515 aa, Influenza virus
  MOD_RES (1)..(20): Any amino acid
  MOD_RES (37)..(88): Any amino acid
  MOD_RES (112)..(114): Any amino acid
  MOD_RES (127)..(127): Any amino acid
  MOD_RES (175)..(175): Any amino acid
  MOD_RES (195)..(266): Any amino acid
  MOD_RES (281)..(288): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (413)..(415): Any amino acid
  MOD_RES (425)..(438): Any amino acid
  MOD_RES (458)..(460): Any amino acid
  MOD_RES (476)..(481): Any amino acid
XXXXXXXXXXXXXXXXXXXXALLIGVGNLVFNTVIHXXXXXXXXXXXXXXXXXXXXXXXXXXXXXXXXXXXXXXXXXXXXXXXXXXXXLPLCPFRGFFPFHKDNAIRLGENXXXIVTREPYVSCDNXNCWSFALAQGALLGTKHSNGTIKDRTPYRSLIRFPIGTAPVLGNYKEXCIAWSSSSCFDGKEWMHVCXXXXXXXXXXXXXXXXXXXXXXXXXXXXXXXXXXXXXXXXXXXXXXXXXXXXXXXXXXXXXXXXXXXXXXXXKDILRTQESECQCIXXXXXXXXTDGPAANSADHRVYWIRXXXXXXXXXXXXXKIQHLEECSCYVDXDVYCICRDNWKGSNRPWMRINNETILETGYVCSKFHSDTPRPADPSXXXXXXXXXXXXGPGVKGFGFKXGNDVWLGRTVSXXXRSGFEIIKVXXXXXXXXXXXXXXTQTLVSNNDWSGYSGSFIVXXXDCFQPCFYVELIRGRXXXXXXVSWTSNSIVTFCGLDNEPGSGNWPDGSNIGFMPK

SEQ ID NO: 418782 - protein, 515 aa, Influenza virus
  MOD_RES (1)..(20): Any amino acid
  MOD_RES (37)..(88): Any amino acid
  MOD_RES (112)..(114): Any amino acid
  MOD_RES (127)..(127): Any amino acid
  MOD_RES (175)..(175): Any amino acid
  MOD_RES (195)..(266): Any amino acid
  MOD_RES (281)..(288): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (412)..(415): Any amino acid
  MOD_RES (425)..(438): Any amino acid
  MOD_RES (458)..(460): Any amino acid
  MOD_RES (476)..(481): Any amino acid
XXXXXXXXXXXXXXXXXXXXALLIGIGNLIFNTVIHXXXXXXXXXXXXXXXXXXXXXXXXXXXXXXXXXXXXXXXXXXXXXXXXXXXXLPLCPFKGFFPFHKDNALRLAENXXXIVTREPYISCDNXDCWSFALAQGTLLGTNHSNGTNKDRTSYRSLIRFPVGVAPVLGNYREXCVAWSSSSCFDGREWMHVCXXXXXXXXXXXXXXXXXXXXXXXXXXXXXXXXXXXXXXXXXXXXXXXXXXXXXXXXXXXXXXXXXXXXXXXXRDILRTQESECQCLXXXXXXXXTDGPAANNADHRIYWIRXXXXXXXXXXXXXKIKHLEECSCYTDXDVYCVCRDNWKGSNRPWVRMNNETILETGYICSKFHSDTPRPDDPSXXXXXXXXXXXXRRGVKGFGFKXGDDVWLGRTVXXXXRSGFEVIKVXXXXXXXXXXXXXXTQTLVSNSDWSGYSGSFVIXXXGCFQPCFYIELIRGRXXXXXXVSWASNSIVTFCGLNNEPGSGDWPDGSDIGFMPK

SEQ ID NO: 418783 - protein, 515 aa, Influenza virus
  MOD_RES (1)..(20): Any amino acid
  MOD_RES (37)..(88): Any amino acid
  MOD_RES (112)..(114): Any amino acid
  MOD_RES (124)..(127): Any amino acid
  MOD_RES (175)..(175): Any amino acid
  MOD_RES (195)..(266): Any amino acid
  MOD_RES (277)..(288): Any amino acid
  MOD_RES (306)..(318): Any amino acid
  MOD_RES (332)..(332): Any amino acid
  MOD_RES (379)..(390): Any amino acid
  MOD_RES (401)..(401): Any amino acid
  MOD_RES (413)..(415): Any amino acid
  MOD_RES (425)..(438): Any amino acid
  MOD_RES (448)..(448): Any amino acid
  MOD_RES (458)..(460): Any amino acid
  MOD_RES (476)..(481): Any amino acid
  MOD_RES (503)..(503): Any amino acid
XXXXXXXXXXXXXXXXXXXXALFIGVGNLAFNAVIHXXXXXXXXXXXXXXXXXXXXXXXXXXXXXXXXXXXXXXXXXXXXXXXXXXXXLPLCPFQGFFPFHKDNAVRLGENXXXLVTREPYISXXXXGCWSFALAQGVLLGTRHSNGTVKDRTPYRSLIQFPIGTAPILGNYKEXCAAWSSSSCFDGKEWLHVCXXXXXXXXXXXXXXXXXXXXXXXXXXXXXXXXXXXXXXXXXXXXXXXXXXXXXXXXXXXXXXXXXXXXXXXXNNILRTQESEXXXXXXXXXXXXTDGPAASSADHRIYWIKXXXXXXXXXXXXXRIQHLEECSCYMDXDIYCICRDNWKGSNRPWIRINNETIIETGYVCSKFHSDTPRPVDPSXXXXXXXXXXXXGLGVKGFGFKXQNDVWLGRTISXXXRSGFEIIRVXXXXXXXXXXXXXXIQTLVSNNDXSGYSGSFIIXXXGCFQPCFYVELTRGVXXXXXXVSWTSNSMVTFCGLDNEPGSEXWPDGANIGFMPK

SEQ ID NO: 418784 - protein, 515 aa, Influenza virus
  MOD_RES (1)..(20): Any amino acid
  MOD_RES (37)..(102): Any amino acid
  MOD_RES (112)..(114): Any amino acid
  MOD_RES (127)..(127): Any amino acid
  MOD_RES (173)..(184): Any amino acid
  MOD_RES (195)..(266): Any amino acid
  MOD_RES (276)..(288): Any amino acid
  MOD_RES (306)..(318): Any amino acid
  MOD_RES (329)..(332): Any amino acid
  MOD_RES (343)..(343): Any amino acid
  MOD_RES (379)..(390): Any amino acid
  MOD_RES (401)..(401): Any amino acid
  MOD_RES (412)..(415): Any amino acid
  MOD_RES (425)..(438): Any amino acid
  MOD_RES (458)..(460): Any amino acid
  MOD_RES (470)..(481): Any amino acid
  MOD_RES (491)..(499): Any amino acid
  MOD_RES (514)..(515): Any amino acid
XXXXXXXXXXXXXXXXXXXXALIIGVGNLIFNAVIHXXXXXXXXXXXXXXXXXXXXXXXXXXXXXXXXXXXXXXXXXXXXXXXXXXXXXXXXXXXXXXXXXXDNAIRLGETXXXIITREPYVSCDYXHCWSFALAQGALVGTKHSNGTIEDRTPYRSLIKFPIGAAPVLGNYXXXXXXXXXXXXFDGKEWMHICXXXXXXXXXXXXXXXXXXXXXXXXXXXXXXXXXXXXXXXXXXXXXXXXXXXXXXXXXXXXXXXXXXXXXXXXKNILRTQESXXXXXXXXXXXXXTDGPADNKADHRIYWVRXXXXXXXXXXXXXKVQHLEECSCXXXXDIYCVCRDNWXGSNRPWVRINNETIVETGYVCSKFHSDTPRPSDPSXXXXXXXXXXXXEPGVKGFGFRXGSDVWLGRTVXXXXRSGFEVIRVXXXXXXXXXXXXXXTQTLVANNDWSGYSGSFSVXXXACFQPCFYVXXXXXXXXXXXXVSWTSNSIIXXXXXXXXXGSGNWPDGANIGLCXX

SEQ ID NO: 418785 - protein, 515 aa, Influenza virus
  MOD_RES (1)..(20): Any amino acid
  MOD_RES (30)..(114): Any amino acid
  MOD_RES (127)..(127): Any amino acid
  MOD_RES (137)..(144): Any amino acid
  MOD_RES (165)..(165): Any amino acid
  MOD_RES (175)..(266): Any amino acid
  MOD_RES (276)..(288): Any amino acid
  MOD_RES (306)..(318): Any amino acid
  MOD_RES (330)..(344): Any amino acid
  MOD_RES (379)..(390): Any amino acid
  MOD_RES (400)..(401): Any amino acid
  MOD_RES (413)..(438): Any amino acid
  MOD_RES (448)..(466): Any amino acid
  MOD_RES (476)..(482): Any amino acid
  MOD_RES (492)..(499): Any amino acid
  MOD_RES (509)..(515): Any amino acid
XXXXXXXXXXXXXXXXXXXXALLVGIGNLXXXXXXXXXXXXXXXXXXXXXXXXXXXXXXXXXXXXXXXXXXXXXXXXXXXXXXXXXXXXXXXXXXXXXXXXXXXXXXXXXXXXXIATREPYVSCDSXVCWSFALAQXXXXXXXXSNGTIRDRTPYRSLIQFPMGXAPVLGNCKEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNILRTQESXXXXXXXXXXXXXTDDPAANSADYRVYWIRXXXXXXXXXXXXXKIRHLEECSCYXXXXXXXXXXXXXXXSNRPWMRISNETILETGYVCGKFHSDTPRPTDPSXXXXXXXXXXXXRPGVKGFGFXXSNDVWLGRTMSXXXXXXXXXXXXXXXXXXXXXXXXXXNQTLVSNNDXXXXXXXXXXXXXXXXXXXFYIELIRGKXXXXXXXFWTSNSIVTXXXXXXXXGSGNWPDGPXXXXXXX

SEQ ID NO: 418786 - protein, 515 aa, Influenza virus
  MOD_RES (1)..(129): Any amino acid
  MOD_RES (142)..(149): Any amino acid
  MOD_RES (162)..(488): Any amino acid
  MOD_RES (498)..(503): Any amino acid
  MOD_RES (513)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSFALSQGALLGXXXXXXXXKDRAPYRSLIRFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVTFCGLDNXXXXXXWPDGYNIGFXXX

SEQ ID NO: 418787 - protein, 515 aa, Influenza virus
  MOD_RES (1)..(504): Any amino acid
  MOD_RES (514)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDGSNIGFVXX

SEQ ID NO: 418788 - protein, 515 aa, Influenza virus; identical to SEQ ID NO: 418336
  MOD_RES (1)..(505): Any amino acid
  MOD_RES (515)..(515): Any amino acid

SEQ ID NO: 418789 - protein, 515 aa, Influenza virus
  MOD_RES (1)..(505): Any amino acid
  MOD_RES (515)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGSKIGFMPX

SEQ ID NO: 418790 - protein, 470 aa, Influenza virus
  MOD_RES (16)..(16): Any amino acid
  MOD_RES (44)..(47): Any amino acid
  MOD_RES (74)..(89): Any amino acid
  MOD_RES (264)..(269): Any amino acid
  MOD_RES (335)..(335): Any amino acid
MNPNQKIITIGSISIXLTTVGLLLQITSLCSIWFSHYNQVTQTXXXXCSNNTTNYYNETFVNVTNVQNNYTTVXXXXXXXXXXXXXXXXLCPIRGWAPLSKDNGIRIGSRGEVFVIREPFISCSISECRTFFLTQGALLNDKHSNGTVKDRSPFRTLMSCPIGVAPSPSNSRFESVAWSATACSDGPGWLTLGITGPDATAVAVLKYNGIITDTLKSWKGNIMRTQESECVCQDEFCYTLITDGPSDAQAFYKILKIRKGKIVXXXXXXATGFHFEECSCYPSGTDIECVCRDNWRGSNRPWIRFNSDLDYQIGYVCSGIFGDNPRPVDGTGSCXSPVNNGKGRYGVKGFSFRYGDGVWIGRTKSLESRSGFEMVWDANGWVSTDKDSNGVQDIIDNDNWSGYSGSFSIRGETTGRNCTVPCFWVEMIRGQPKEKTIWTSGSSIAFCGVNSDTTGWSWPDGALLPFDIDK

SEQ ID NO: 418791 - protein, 470 aa, Influenza virus
  MOD_RES (16)..(16): Any amino acid
  MOD_RES (29)..(31): Any amino acid
  MOD_RES (44)..(47): Any amino acid
  MOD_RES (74)..(89): Any amino acid
  MOD_RES (103)..(111): Any amino acid
  MOD_RES (135)..(153): Any amino acid
  MOD_RES (171)..(178): Any amino acid
  MOD_RES (224)..(232): Any amino acid
  MOD_RES (264)..(269): Any amino acid
  MOD_RES (335)..(335): Any amino acid
  MOD_RES (347)..(356): Any amino acid
  MOD_RES (468)..(470): Any amino acid
MNPNQKIVTIGSVSIXLTTIGLLLQITSXXXIWFSHYNQMTQAXXXXCSNDTINYYNETFVNITNVQNDYTTVXXXXXXXXXXXXXXXXLCPVKGWAPLSKDXXXXXXXXXEVFVIREPCISCSINECRTFFLTXXXXXXXXXXXXXXXXXXXFRTLMSCPMGVAPSPSNXXXXXXXXSATACSDGSGWLTLGITGPDSTAVAVIKYNGIITDTFKSWKGNIMXXXXXXXXXQDEFCYTLMTDGPSDAQAFYKLLKIKKGKIVXXXXXXATGYHFEECSCYPSGENVECVCRDNWRGSNRPWVRFNSDLDYQIGYICSGVFGDNPRPADGTGSCXGPINNGKGRYGXXXXXXXXXXEVWIGRTKSLESRRGFEMVWDANGWVTADKDSNGVQDIIDNNNWSGYSGSFSIRWETTGRNCTIPCFWVEMIRGQPNERTIWTSGSSIAFCGVDSDTTGWPWPDGALLPLTXXX

SEQ ID NO: 418792 - protein, 470 aa, Influenza virus
  MOD_RES (16)..(17): Any amino acid
  MOD_RES (31)..(32): Any amino acid
  MOD_RES (44)..(56): Any amino acid
  MOD_RES (74)..(89): Any amino acid
  MOD_RES (102)..(112): Any amino acid
  MOD_RES (135)..(153): Any amino acid
  MOD_RES (171)..(183): Any amino acid
  MOD_RES (219)..(232): Any amino acid
  MOD_RES (264)..(269): Any amino acid
  MOD_RES (295)..(295): Any amino acid
  MOD_RES (335)..(335): Any amino acid
  MOD_RES (345)..(361): Any amino acid
  MOD_RES (396)..(427): Any amino acid
  MOD_RES (466)..(470): Any amino acid
MNPNQSIITIGSVSIXXTTVGLLLQVTSLCXXWFSHYNQMKQAXXXXXXXXXXXXXNETFVNVTHVQNNYTTVXXXXXXXXXXXXXXXXLCPIKGWAPLSKXXXXXXXXXXXVFVIREPFVSCSIDECRTFFLTXXXXXXXXXXXXXXXXXXXFRTLMSCPVGVAPSPSNXXXXXXXXXXXXXSDGPGWLTIGITGPDATAVVVLKYNGVITDTLKSWXXXXXXXXXXXXXXQDEFCYTLVTDGPSDAQAFYKILKIKKGKIMXXXXXXAPGFHFEECSCYPSGESIECVCRDNXQGSNRPWIRFNSNLDYQIGYVCSGVFGDNPRPMDSTGSCXSPINNGKGRXXXXXXXXXXXXXXXXXRTKNLESRSGFEMIWDANGWVSTDKNSNGVQDIIXXXXXXXXXXXXXXXXXXXXXXXXXXXXXXXXIRGQPKEKAIWTSGSSIAFCGVNFDLTSWSWPDGALFPXXXXX

SEQ ID NO: 418793 - protein, 470 aa, Influenza virus
  MOD_RES (1)..(1): Any amino acid
  MOD_RES (16)..(18): Any amino acid
  MOD_RES (43)..(56): Any amino acid
  MOD_RES (74)..(116): Any amino acid
  MOD_RES (134)..(156): Any amino acid
  MOD_RES (170)..(190): Any amino acid
  MOD_RES (212)..(238): Any amino acid
  MOD_RES (263)..(269): Any amino acid
  MOD_RES (295)..(300): Any amino acid
  MOD_RES (318)..(318): Any amino acid
  MOD_RES (335)..(375): Any amino acid
  MOD_RES (391)..(427): Any amino acid
  MOD_RES (442)..(446): Any amino acid
XNPNQMIITIGSASIXXXTVGLLLQIISLCSIWFSHYNQVAQXXXXXXXXXXXXXXNETFVNMTNVQNNYTTIXXXXXXXXXXXXXXXXXXXXXXXXXXXXXXXXXXXXXXXXXXXREPFISCSVSECRTFFLXXXXXXXXXXXXXXXXXXXXXXXLMSCPIGVVPSPSXXXXXXXXXXXXXXXXXXXXXTLGITGPDTTAVAVLKYNGVIXXXXXXXXXXXXXXXXXXXXXXXXXXXTLITDGPSNAQAFYKILKIKKGKLXXXXXXXAAGFHFEECSCYPSGEDVECVCRDNXXXXXXPWIRFNSDPDYQIGYVCXGIFGDSPRPVDGIGSCXXXXXXXXXXXXXXXXXXXXXXXXXXXXXXXXXXXXXXXXXWDDNGWVSTDKSSNGXXXXXXXXXXXXXXXXXXXXXXXXXXXXXXXXXXXXXIRGQPKERTIWTSGXXXXXCGVDSDTTSWSWPDGALLPFDIDR

SEQ ID NO: 418794 - protein, 470 aa, Influenza virus
  MOD_RES (1)..(3): Any amino acid
  MOD_RES (16)..(18): Any amino acid
  MOD_RES (29)..(34): Any amino acid
  MOD_RES (44)..(60): Any amino acid
  MOD_RES (72)..(120): Any amino acid
  MOD_RES (130)..(157): Any amino acid
  MOD_RES (169)..(197): Any amino acid
  MOD_RES (208)..(247): Any amino acid
  MOD_RES (264)..(269): Any amino acid
  MOD_RES (279)..(285): Any amino acid
  MOD_RES (295)..(302): Any amino acid
  MOD_RES (331)..(446): Any amino acid
  MOD_RES (457)..(470): Any amino acid
XXXRSKIITIGSISVXXXTIGLLLQIISXXXXXXSHYNQVTQPXXXXXXXXXXXXXXXXXVNVTNVQNDYTXXXXXXXXXXXXXXXXXXXXXXXXXXXXXXXXXXXXXXXXXXXXXXXXXISCSIDECRXXXXXXXXXXXXXXXXXXXXXXXXXXXXMSCHIGVAPSPXXXXXXXXXXXXXXXXXXXXXXXXXXXXXDATAVAVIKYXXXXXXXXXXXXXXXXXXXXXXXXXXXXXXXXXXXXXXXXGQAFYKILKIRKGKIMXXXXXXATGFHLEECXXXXXXXNIECVCRDNXXXXXXXXIRFNSDLNYQIGYICSGIFGDNPRSVDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCGVNSDTTSWXXXXXXXXXXXXXX

SEQ ID NO: 418795 - protein, 470 aa, Influenza virus
  MOD_RES (1)..(19): Any amino acid
  MOD_RES (29)..(34): Any amino acid
  MOD_RES (44)..(64): Any amino acid
  MOD_RES (74)..(120): Any amino acid
  MOD_RES (135)..(270): Any amino acid
  MOD_RES (280)..(321): Any amino acid
  MOD_RES (335)..(446): Any amino acid
  MOD_RES (461)..(470): Any amino acid
XXXXXXXXXXXXXXXXXXXIGPLLQITSXXXXXXSHYNQITQTXXXXXXXXXXXXXXXXXXXXXHVQNNYTTIXXXXXXXXXXXXXXXXXXXXXXXXXXXXXXXXXXXXXXXXXXXXXXXISCSIHECRTFFLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGFHFEECSXXXXXXXXXXXXXXXXXXXXXXXXXXXXXXXXXXXXXXXXXXGDNPRPMDGTGSCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCGVNSNTTGWSWPDXXXXXXXXXX

SEQ ID NO: 418796 - protein, 470 aa, Influenza virus
  MOD_RES (1)..(450): Any amino acid
  MOD_RES (463)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDTTCWSWPDGAXXXXXXXX

SEQ ID NO: 418797 - protein, 473 aa, Influenza virus
  MOD_RES (18)..(20): Any amino acid
  MOD_RES (30)..(47): Any amino acid
  MOD_RES (61)..(61): Any amino acid
  MOD_RES (71)..(79): Any amino acid
  MOD_RES (189)..(190): Any amino acid
  MOD_RES (234)..(234): Any amino acid
  MOD_RES (257)..(264): Any amino acid
  MOD_RES (302)..(308): Any amino acid
  MOD_RES (329)..(336): Any amino acid
  MOD_RES (383)..(393): Any amino acid
  MOD_RES (413)..(418): Any amino acid
MNPNQKIITIGSVSLALXXXNILLHIASIXXXXXXXXXXXXXXXXXXTTEVYNETVRLETXTIPINNTVYXXXXXXXXXEFLNNTEPLCNVSGFAIVSKDNGIRIGSRGHVFVIREPFVACGPTECRTFFLTQGALLNDKHSNNTVKDRSPYRALMSVPLGSSPNAYQAKFESVAWSATACHDGKEWLXXGISGADDDAYAVIHYGGMPTDVVRSWRKQILRTQESSCVCMKGXCYWVMTDGPANNQASYKIFKSHXXXXXXXXEVSFQGGHIEECSCYPNLGKVECVCRDNWNGMNRPILXXXXXXXYEVGYLCAGIPTDTPRVQDSXXXXXXXXAVGGSGTNNYGVKGFGFRQGNSVWAGRTVSISSRSGFEILLIEDGWXXXXXXXXXXXEVLNNKNWSGYSGAFTIPIXXXXXXCLVPCFWLEMIRGKPEERTSIWTSSSSTVFCGVSSEVPGWSWDDGAILPFDIDKM

SEQ ID NO: 418798 - protein, 473 aa, Influenza virus
  MOD_RES (1)..(4): Any amino acid
  MOD_RES (18)..(20): Any amino acid
  MOD_RES (30)..(47): Any amino acid
  MOD_RES (60)..(61): Any amino acid
  MOD_RES (71)..(79): Any amino acid
  MOD_RES (149)..(151): Any amino acid
  MOD_RES (189)..(190): Any amino acid
  MOD_RES (234)..(236): Any amino acid
  MOD_RES (257)..(264): Any amino acid
  MOD_RES (291)..(291): Any amino acid
  MOD_RES (302)..(308): Any amino acid
  MOD_RES (329)..(336): Any amino acid
  MOD_RES (347)..(348): Any amino acid
  MOD_RES (383)..(393): Any amino acid
  MOD_RES (413)..(418): Any amino acid
  MOD_RES (473)..(473): Any amino acid
XXXXQKIITIGSISLGLXXXNILLHVASIXXXXXXXXXXXXXXXXXXTTEIYNETVRLEXXIIPVNNTIYXXXXXXXXXDFLNNTEPLCEVSGFAIFSKDNGIRIGSRGHIFVIREPFVSCGPSECRTFFLTPCVLLNDKHSNNTVRDXXXYRALMSVLLGSSPNAYQARFESVGWSATACHDGKKWLXXGVSGADDDAYAVIHYGGVPTDVVRSWKKQILRTQESSCVCVKGXXXWVMTDGPASNQASYKIFKSQXXXXXXXXEISFQGGHIEECSCYPNMGKVECVCRXNWNGMNRPVLXXXXXXXYNVGYLCAGIPTDTPRIQDSXXXXXXXXAIGGSGTNNYXXKGFGFRQGTSVWAGRTISTSSRSGFEVLLIEDGWXXXXXXXXXXXEVLNNMNWSGYSGSFTIPTXXXXXXCIVPCFWLEMIRGRPEERNSIWTSSSSTVFCGVSGEVPGWSWDDGAILPLTSIRX

SEQ ID NO: 418799 - protein, 473 aa, Influenza virus
  MOD_RES (1)..(4): Any amino acid
  MOD_RES (18)..(20): Any amino acid
  MOD_RES (30)..(47): Any amino acid
  MOD_RES (61)..(61): Any amino acid
  MOD_RES (71)..(79): Any amino acid
  MOD_RES (131)..(132): Any amino acid
  MOD_RES (144)..(152): Any amino acid
  MOD_RES (189)..(190): Any amino acid
  MOD_RES (234)..(237): Any amino acid
  MOD_RES (257)..(264): Any amino acid
  MOD_RES (291)..(308): Any amino acid
  MOD_RES (319)..(319): Any amino acid
  MOD_RES (329)..(336): Any amino acid
  MOD_RES (383)..(393): Any amino acid
  MOD_RES (408)..(425): Any amino acid
  MOD_RES (443)..(448): Any amino acid
  MOD_RES (472)..(473): Any amino acid
XXXXQKIITIGSASLGLXXXNILLHIVSIXXXXXXXXXXXXXXXXXXITEIYNETVRVETXTIPVNNTIYXXXXXXXXXEFFNNTEPLCEVSGFVIVSKDNGIRVGSRGHVFVIREPFVACSPSECRTFFXXQGALLNDRHSNXXXXXXXXXRALMSVPMGSSPNAYQAQFESVEWSATACHDGKGWLXXGVSGADNDAYAVIHYGGIPTDVVRSWRRQILRTQESSCVCIKGXXXXVMTDGPANSQASYKIFKSYXXXXXXXXEVLFQGGHIEECSCYPNSGKVECVCRXXXXXXXXXXXXXXXXXXYKVGYLCAGIXTDTPRVQDNXXXXXXXXAVGGSGTDNYGVKGFGFRQGNNVWAGRTVSVSSRSGFEVLFIEDGWXXXXXXXXXXXEILNNKNWSGYSGSXXXXXXXXXXXXXXXXXXLEMIRGKPKERTSIWTSXXXXXXCGVSSEVPEWSWDDGAILPFGIDXX

SEQ ID NO: 418800 - protein, 473 aa, Influenza virus
  MOD_RES (1)..(4): Any amino acid
  MOD_RES (18)..(47): Any amino acid
  MOD_RES (61)..(61): Any amino acid
  MOD_RES (71)..(79): Any amino acid
  MOD_RES (106)..(115): Any amino acid
  MOD_RES (129)..(155): Any amino acid
  MOD_RES (171)..(171): Any amino acid
  MOD_RES (189)..(190): Any amino acid
  MOD_RES (201)..(204): Any amino acid
  MOD_RES (222)..(223): Any amino acid
  MOD_RES (234)..(237): Any amino acid
  MOD_RES (257)..(264): Any amino acid
  MOD_RES (293)..(308): Any amino acid
  MOD_RES (319)..(319): Any amino acid
  MOD_RES (329)..(336): Any amino acid
  MOD_RES (346)..(349): Any amino acid
  MOD_RES (383)..(393): Any amino acid
  MOD_RES (408)..(427): Any amino acid
  MOD_RES (445)..(449): Any amino acid
  MOD_RES (460)..(473): Any amino acid
XXXXQKIITIGSMSLALXXXXXXXXXXXXXXXXXXXXXXXXXXXXXXTTEVYSETVRVETXVIPVNNTIYXXXXXXXXXKFLNNTEPLCDVSGFAIISKDNGIRIXXXXXXXXXXEPFVACGPSECRTXXXXXXXXXXXXXXXXXXXXXXXXXXXMSVPLGSSSNAYQAKXESIAWSATACHDGKEWMXXGVSGTDDDAYXXXXYGGVPTDVIRSWRKQILXXQESSCVCMNGXXXXVMTDGPANKQASYKIFKSRXXXXXXXXEVSFRGGHIEECSCYPNLGQVECVCRDNXXXXXXXXXXXXXXXXYDVGYLCAGIXTDTPRVQDDXXXXXXXXAIGGSGTDNXXXXGFAFKQGNSVWAGRTISISSRNGFEILLIEEGWXXXXXXXXXXXEVLNNRNWSGYSGSXXXXXXXXXXXXXXXXXXXXMIRGKPEEGTSIWTSSSXXXXXGVSSEVPGCTXXXXXXXXXXXXXX

SEQ ID NO: 418801 - protein, 473 aa, Influenza virus
  MOD_RES (1)..(5): Any amino acid
  MOD_RES (18)..(47): Any amino acid
  MOD_RES (61)..(61): Any amino acid
  MOD_RES (71)..(87): Any amino acid
  MOD_RES (105)..(115): Any amino acid
  MOD_RES (133)..(179): Any amino acid
  MOD_RES (189)..(192): Any amino acid
  MOD_RES (204)..(204): Any amino acid
  MOD_RES (228)..(242): Any amino acid
  MOD_RES (257)..(265): Any amino acid
  MOD_RES (290)..(319): Any amino acid
  MOD_RES (329)..(337): Any amino acid
  MOD_RES (347)..(356): Any amino acid
  MOD_RES (367)..(393): Any amino acid
  MOD_RES (413)..(432): Any amino acid
  MOD_RES (444)..(450): Any amino acid
  MOD_RES (464)..(473): Any amino acid
XXXXXKIMTIGSVSLTLXXXXXXXXXXXXXXXXXXXXXXXXXXXXXXVTKVYNETVRVEIXTIPINNTIYXXXXXXXXXXXXXXXXXLCEISGFAIASKDNGIRXXXXXXXXXXXEPFVACGPAECRTFFLTXXXXXXXXXXXXXXXXXXXXXXXXXXXXXXXXXXXXXXXXXXXXXXXACHDGKKWMXXXXSGADDEAYAVIXYGGIPTDVIRSWRKKILRTQESSXXXXXXXXXXXXXXXPANNQASYRIFKSHXXXXXXXXXISFQSGHIEECSCYPNLCQVECVCXXXXXXXXXXXXXXXXXXXXXXXXXXXXXXTDTPRVQDGXXXXXXXXXVGRSGTNNYXXXXXXXXXXNSVWAGRTMSXXXXXXXXXXXXXXXXXXXXXXXXXXXEVLNNKHWSGYSGAFTVPIXXXXXXXXXXXXXXXXXXXXPEERPSIWTSSXXXXXXXVSSEAPGWSWDDGXXXXXXXXXX

SEQ ID NO: 418802 - protein, 473 aa, Influenza virus
  MOD_RES (1)..(49): Any amino acid
  MOD_RES (61)..(91): Any amino acid
  MOD_RES (104)..(206): Any amino acid
  MOD_RES (217)..(276): Any amino acid
  MOD_RES (292)..(356): Any amino acid
  MOD_RES (375)..(394): Any amino acid
  MOD_RES (413)..(433): Any amino acid
  MOD_RES (445)..(452): Any amino acid
  MOD_RES (465)..(473): Any amino acid
XXXXXXXXXXXXXXXXXXXXXXXXXXXXXXXXXXXXXXXXXXXXXXXXXEVYNETVRVKTXXXXXXXXXXXXXXXXXXXXXXXXXXXXXXXSGFAVVSKDNGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVPTDVMRSWXXXXXXXXXXXXXXXXXXXXXXXXXXXXXXXXXXXXXXXXXXXXXXXXXXXXXXXXXXXXSCYPNLGIVECVCRDXXXXXXXXXXXXXXXXXXXXXXXXXXXXXXXXXXXXXXXXXXXXXXXXXXXXXXXXXXXXXXXXXTSVWAGRTVNISSRSGFEXXXXXXXXXXXXXXXXXXXXVLDNKNWSGYSGAFTIPTXXXXXXXXXXXXXXXXXXXXXEEKTSIWTSSSXXXXXXXXSEVPGWSWGDGAXXXXXXXXX

SEQ ID NO: 418803 - protein, 473 aa, Influenza virus
  MOD_RES (1)..(49): Any amino acid
  MOD_RES (59)..(210): Any amino acid
  MOD_RES (222)..(403): Any amino acid
  MOD_RES (413)..(473): Any amino acid
XXXXXXXXXXXXXXXXXXXXXXXXXXXXXXXXXXXXXXXXXXXXXXXXXEMYNETVRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDVVRSWRKKILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYSGAFTIPVXXXXXXXXXXXXXXXXXXXXXXXXXXXXXXXXXXXXXXXXXXXXXXXXXXXXXXXXXXXXX

SEQ ID NO: 418804 - protein, 471 aa, Influenza virus
  MOD_RES (37)..(55): Any amino acid
  MOD_RES (65)..(89): Any amino acid
  MOD_RES (128)..(128): Any amino acid
  MOD_RES (173)..(174): Any amino acid
  MOD_RES (210)..(214): Any amino acid
  MOD_RES (253)..(271): Any amino acid
  MOD_RES (286)..(288): Any amino acid
  MOD_RES (309)..(311): Any amino acid
  MOD_RES (334)..(343): Any amino acid
  MOD_RES (360)..(360): Any amino acid
  MOD_RES (386)..(397): Any amino acid
  MOD_RES (416)..(417): Any amino acid
MNPNQKIICISATGMTLSVVSLLIGLANLGLNIGLHXXXXXXXXXXXXXXXXXXXTTTTIINNNXXXXXXXXXXXXXXXXXXXXXXXXXKPLCEVNSWHILSKDNAIRIGEDAHILVTREPYLSCGPXECRMFALSQGTTLRGRHANGTIHDRSPFRALISWEMGQAPSPYNXXVECVGWSSTSCHDGISRMSICMSGPNNNASAVVWYXXXXXTEIASWAGNILRTQESECVCHNGICPVVMTDGPANNRAXXXXXXXXXXXXXXXXXXXGSAQHIEECSCYGAXXXIKCICRDNWKGANRPVITINXXXMTHTSKYLCSKILTDTSRPNDPXXXXXXXXXXGGSPDPGVKGFAFLDGXNSWLGRTISKDSRSGYEMLKVPNAEXXXXXXXXXXXXIVNNQNWSGYSGAFIDYWXXRECFNPCFYVELIRGRPKESSVLWTSNSIVALCGSKERLGSWSWHDGAEIIYFK

SEQ ID NO: 418805 - protein, 471 aa, Influenza virus
  MOD_RES (37)..(89): Any amino acid
  MOD_RES (128)..(128): Any amino acid
  MOD_RES (173)..(174): Any amino acid
  MOD_RES (210)..(214): Any amino acid
  MOD_RES (227)..(227): Any amino acid
  MOD_RES (253)..(271): Any amino acid
  MOD_RES (286)..(288): Any amino acid
  MOD_RES (309)..(311): Any amino acid
  MOD_RES (334)..(343): Any amino acid
  MOD_RES (360)..(360): Any amino acid
  MOD_RES (386)..(397): Any amino acid
  MOD_RES (416)..(417): Any amino acid
MNPNQKITCISATGVTLSVVSLLVGIANLGLNIGIHXXXXXXXXXXXXXXXXXXXXXXXXXXXXXXXXXXXXXXXXXXXXXXXXXXXXXKPLCEVSSWHILSKDNAVRIGEDAHVLVTREPYLSCDPXGCRMFALSQGTTLKGRHANGTINDRSPFRALVSWEMGQAPSPYTXXVECIGWSSTSCHDGMSRMSICISGPNNNASAVIWYXXXXXTEIPSWAGNILRXQESECVCHKGICPVVMTDGPASNKAXXXXXXXXXXXXXXXXXXXGNAQHIEECSCYGSXXXVKCICRDNWRGANRPVITIDXXXMTHMSKYLCSKVLTDTSRPSDPXXXXXXXXXXGGGPDPGVKGFAFLNGXNSWLGRTTSKDSRSGYEVLKVPNAEXXXXXXXXXXXXIVNNQDWSGYSGAFMDYWXXKECFNPCFYVELIRGMPKESSVFWTSNSIVALCGSRERLGSWSWHDGAEITYFK

SEQ ID NO: 418806 - protein, 471 aa, Influenza virus
  MOD_RES (24)..(24): Any amino acid
  MOD_RES (35)..(89): Any amino acid
  MOD_RES (103)..(103): Any amino acid
  MOD_RES (121)..(128): Any amino acid
  MOD_RES (173)..(174): Any amino acid
  MOD_RES (203)..(214): Any amino acid
  MOD_RES (250)..(271): Any amino acid
  MOD_RES (282)..(288): Any amino acid
  MOD_RES (309)..(311): Any amino acid
  MOD_RES (334)..(343): Any amino acid
  MOD_RES (360)..(363): Any amino acid
  MOD_RES (386)..(397): Any amino acid
  MOD_RES (416)..(418): Any amino acid
MNPNQKIMCISATGMALSVVSLLXGVANLGLNIGXXXXXXXXXXXXXXXXXXXXXXXXXXXXXXXXXXXXXXXXXXXXXXXXXXXXXXXKPLCAVNSWHILSXDNAIRIGENAHILVTREXXXXXXXXECKMFALSQGTTLRGQHANGTIHDRSQFRALISWEMGLAPSPYNXXIECIGWSSTSCHDGVSRMSVCMSGPNNNXXXXXXXXXXXXTEIPSWEGNILRTQESECVCHKGVCPVVMTDGPADXXXXXXXXXXXXXXXXXXXXXXGSAEHIEECSXXXXXXXIKCVCRDNWKGANRPIITINXXXMTHTSRYLCSRILTDTSRPTDPXXXXXXXXXXGGNPDPGVKGFAFLDEXXXXLGRTISKDLRSGYEMLKVPDAEXXXXXXXXXXXXIINNQNWSGYSGSFIDYWXXXKCFNPCFYVELIRGRPRESNVLWTSNSVVALCGSKEQLGSWSWHDGAEIIYFE

SEQ ID NO: 418807 - protein, 471 aa, Influenza virus
  MOD_RES (1)..(3): Any amino acid
  MOD_RES (37)..(89): Any amino acid
  MOD_RES (121)..(141): Any amino acid
  MOD_RES (172)..(174): Any amino acid
  MOD_RES (210)..(214): Any amino acid
  MOD_RES (227)..(229): Any amino acid
  MOD_RES (243)..(243): Any amino acid
  MOD_RES (253)..(271): Any amino acid
  MOD_RES (281)..(297): Any amino acid
  MOD_RES (309)..(311): Any amino acid
  MOD_RES (331)..(343): Any amino acid
  MOD_RES (360)..(363): Any amino acid
  MOD_RES (381)..(397): Any amino acid
  MOD_RES (416)..(426): Any amino acid
  MOD_RES (463)..(471): Any amino acid
XXXNQKIICISTTGMTLSVVNLLIGLANLGLNVGLHXXXXXXXXXXXXXXXXXXXXXXXXXXXXXXXXXXXXXXXXXXXXXXXXXXXXXKSLCEVNSWHIFSKDNAIRIGEEAHILVTREXXXXXXXXXXXXXXXXXXXXXRGRHANGTMHDRSPFRALISWGMGQAPSPYXXXIECVGWSSTSCHDGRSRMSICMSGPNDNASAVVWYXXXXXIEIPSWAGNVLRXXXSECVCHNGVCPVVXTDGPANNKAXXXXXXXXXXXXXXXXXXXGKAQHIEECXXXXXXXXXXXXXXXXXKGANRPVIIIDXXXMTHSSKYLCSRVLTDTSRPXXXXXXXXXXXXXGGTPDPGVKGFAFLDRXXXXLGRTISKDTRSGYEMLKXXXXXXXXXXXXXXXXXIVDNQNWSGYSGAFVDYWXXXXXXXXXXXVELIRGRPGENSVLWTSNSMVALCGSKKRLGSWSWHXXXXXXXXX

SEQ ID NO: 418808 - protein, 471 aa, Influenza virus
  MOD_RES (1)..(8): Any amino acid
  MOD_RES (24)..(24): Any amino acid
  MOD_RES (36)..(104): Any amino acid
  MOD_RES (121)..(147): Any amino acid
  MOD_RES (165)..(180): Any amino acid
  MOD_RES (202)..(215): Any amino acid
  MOD_RES (225)..(233): Any amino acid
  MOD_RES (243)..(243): Any amino acid
  MOD_RES (253)..(272): Any amino acid
  MOD_RES (282)..(299): Any amino acid
  MOD_RES (309)..(311): Any amino acid
  MOD_RES (331)..(349): Any amino acid
  MOD_RES (360)..(369): Any amino acid
  MOD_RES (386)..(398): Any amino acid
  MOD_RES (408)..(428): Any amino acid
  MOD_RES (438)..(445): Any amino acid
  MOD_RES (455)..(471): Any amino acid
XXXXXXXXCISATGMILSVVSLLXGLVNLGLNIGLXXXXXXXXXXXXXXXXXXXXXXXXXXXXXXXXXXXXXXXXXXXXXXXXXXXXXXXXXXXXXXXXXXXXXNAIRIGEGAHILVTREXXXXXXXXXXXXXXXXXXXXXXXXXXXGTIHDRSPYRALISWEMXXXXXXXXXXXXXXXXSSTSCHDGKSRMSICVSGPNNXXXXXXXXXXXXXXEIPTWAGNIXXXXXXXXXCHNGTCPVVXTDGPANDRAXXXXXXXXXXXXXXXXXXXXTAQHIEECSXXXXXXXXXXXXXXXXXXANRPIITIDXXXMTHISKYLCSKTLTDTSRPXXXXXXXXXXXXXXXXXXXGIKGFAFLDGXXXXXXXXXXKDSRSGYEILKVPNAEXXXXXXXXXXXXXVNNPNWSGYXXXXXXXXXXXXXXXXXXXXXLIRGRPKENXXXXXXXXIVALCGSKKXXXXXXXXXXXXXXXXX

SEQ ID NO: 418809 - protein, 471 aa, Influenza virus
  MOD_RES (1)..(240): Any amino acid
  MOD_RES (253)..(374): Any amino acid
  MOD_RES (386)..(401): Any amino acid
  MOD_RES (411)..(428): Any amino acid
  MOD_RES (445)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIMTDGPANSRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYEVLKVPDAEXXXXXXXXXXXXXXXXQKWSGYSGAXXXXXXXXXXXXXXXXXXLVRGRPKESGVLWTSNXXXXXXXXXXXXXXXXXXXXXXXXXXX

SEQ ID NO: 418810 - protein, 471 aa, Influenza virus
  MOD_RES (16)..(19): Any amino acid
  MOD_RES (39)..(61): Any amino acid
  MOD_RES (73)..(82): Any amino acid
  MOD_RES (94)..(94): Any amino acid
  MOD_RES (164)..(168): Any amino acid
  MOD_RES (251)..(267): Any amino acid
  MOD_RES (285)..(285): Any amino acid
  MOD_RES (308)..(311): Any amino acid
  MOD_RES (332)..(333): Any amino acid
  MOD_RES (357)..(357): Any amino acid
  MOD_RES (387)..(400): Any amino acid
  MOD_RES (416)..(416): Any amino acid
MNPNQKLFALSGVAIXXXXLNLLIGISNVGLNVSLHLKXXXXXXXXXXXXXXXXXXXXXXXENTYVNNTTVIXXXXXXXXXXYLMLNKSLCKVXGWVVVAKDNAIRFGESEQIIVTREPYVSCDPLGCKMYALHQGTTIRNKHSNGTIHDRTAFRGLISTPLGXXXXXSNSDFLCVGWSSTSCHDGIGRMTICVQGNNDNATATVYYDRRLTTTIKTWAGNILRTQESECVCHNGTCVVIMTDGSASSQAXXXXXXXXXXXXXXXXXLKGSARHIEECSCYGHNXKVTCVCRDNWQGANRPVIEIDMXXXXHTSQYLCTGVLTDTSRPSDKXXGDCNNPITGSPGAPGVKGFGFLDXGNTWLGRTISPRSRSGFEMLKIPNAGTDPXXXXXXXXXXXXXXNWSGYSGSFIDYWDEXSECYNPCFYVELIRGRPEEAKYVWWTSNSLVALCGSPISVGSGSFPDGAQIQYFS

SEQ ID NO: 418811 - protein, 471 aa, Influenza virus
  MOD_RES (16)..(19): Any amino acid
  MOD_RES (39)..(61): Any amino acid
  MOD_RES (73)..(82): Any amino acid
  MOD_RES (94)..(94): Any amino acid
  MOD_RES (114)..(117): Any amino acid
  MOD_RES (164)..(168): Any amino acid
  MOD_RES (251)..(267): Any amino acid
  MOD_RES (285)..(285): Any amino acid
  MOD_RES (308)..(311): Any amino acid
  MOD_RES (332)..(333): Any amino acid
  MOD_RES (357)..(357): Any amino acid
  MOD_RES (387)..(400): Any amino acid
  MOD_RES (416)..(416): Any amino acid
  MOD_RES (426)..(429): Any amino acid
MNPNQKLFTLSGVAIXXXXLNLIIGISNVGLKVSLHLKXXXXXXXXXXXXXXXXXXXXXXXENKYVNNTTIIXXXXXXXXXXYLLLNKSLCNVXGWVVIAKDNAVRFGESEQIXXXXEPYVSCDPTGCRMYALHQGTTIRNRHSNGTIHDRNAFRGLISTHLGXXXXXSNSDFMCVGWSSTTCHDGIARMTICIQGNNNNATATVYYNRRLTTTIKPWARNILRTQESECVCHNSTCVVVMTDGPANNQAXXXXXXXXXXXXXXXXXLKGSAKHIEECSCYGHSXRVTCVCRDNWQGANRPIIEIDMXXXXHTSRYVCTGILTDTSRPGDKXXGDCSNPITGSPGVPGVKGFGFLNXDNTWLGRTISPKLRSGFEMLKVPNAEKDPXXXXXXXXXXXXXXDWSGYSGSFIDYWNDXNECYNPCFYXXXXRGRPEEVKYVWWTSNSLIALCGSPFPVGSGSFPDGAKIQYFS

SEQ ID NO: 418812 - protein, 471 aa, Influenza virus
  MOD_RES (16)..(19): Any amino acid
  MOD_RES (39)..(61): Any amino acid
  MOD_RES (73)..(82): Any amino acid
  MOD_RES (94)..(94): Any amino acid
  MOD_RES (136)..(137): Any amino acid
  MOD_RES (164)..(168): Any amino acid
  MOD_RES (239)..(240): Any amino acid
  MOD_RES (251)..(267): Any amino acid
  MOD_RES (284)..(285): Any amino acid
  MOD_RES (308)..(311): Any amino acid
  MOD_RES (332)..(333): Any amino acid
  MOD_RES (357)..(357): Any amino acid
  MOD_RES (384)..(400): Any amino acid
  MOD_RES (416)..(416): Any amino acid
  MOD_RES (427)..(431): Any amino acid
MNPSQKLFALSGVAVXXXXINLLIGISNMSLNISLYSKXXXXXXXXXXXXXXXXXXXXXXXKNTYVNNTTIIXXXXXXXXXXYLVLNKSLCKVXGWVAVAKDNAIRFGESEQVIVTREPYVSCDPSSCKMYALHQXXTIRNKHSNSTTHDRTAFRGLMSTPLGXXXXXSNSDFICVGWSSTSCHDGVGRMTICIQGDNENATATVYYNKRLTTTIKTWARNILRTQDSECVSHNGTWAXXMTDGPASSQAXXXXXXXXXXXXXXXXXLRGSARHIEECPCYGHXXKATCVCRDNWQGANRPVIKIDMXXXXHTSRYICTGVLTDTSRPKDKXXGECFNPITGSPGAPGIKGFGFLNXSNTWLGRTISTRSRSGFEMLRIPNAGXXXXXXXXXXXXXXXXXNRSGYSGSFIDYWDDXSVCYNPCFYVXXXXXRPEEAKYVEWTSNSLIALCGSPIPVGPGSFPDGAQIKYFS

SEQ ID NO: 418813 - protein, 471 aa, Influenza virus
  MOD_RES (13)..(19): Any amino acid
  MOD_RES (39)..(61): Any amino acid
  MOD_RES (71)..(82): Any amino acid
  MOD_RES (94)..(94): Any amino acid
  MOD_RES (136)..(139): Any amino acid
  MOD_RES (162)..(168): Any amino acid
  MOD_RES (199)..(200): Any amino acid
  MOD_RES (251)..(267): Any amino acid
  MOD_RES (283)..(285): Any amino acid
  MOD_RES (296)..(297): Any amino acid
  MOD_RES (308)..(311): Any amino acid
  MOD_RES (332)..(336): Any amino acid
  MOD_RES (349)..(357): Any amino acid
  MOD_RES (382)..(416): Any amino acid
  MOD_RES (427)..(433): Any amino acid
  MOD_RES (471)..(471): Any amino acid
MNPKSKLFTLSGXXXXXXXMNLLIGISNVVLNVSLHLKXXXXXXXXXXXXXXXXXXXXXXXENTYVNKTTXXXXXXXXXXXXYLMLSKSLCKVXGWVVIEKDNAVRFGEGEQIIVTREPYVSCDPIGCKMFALHQXXXXRNKHSNGTTHDRTTFRGLLSTPXXXXXXXSNSEFICVGWSSTTCHDGVNRMTICVQGDNXXATATVYYNGRLTTTIKTWAKNILRTQESECVRHNGTCAVVMTDGSASGQAXXXXXXXXXXXXXXXXXLQGSARHIEEWSCYGXXXKITCVCRDNWXXANRPVIEINMXXXXHTSRYMCTGVLTDTSRPGDRXXXXXSNPITGSPSAPGXXXXXXXXXNNTWLGRTISPRLRSGFEMLKIHNXXXXXXXXXXXXXXXXXXXXXXXXXXXXXXXXXXXSACYNPCFYVXXXXXXXEEAKYVWWASNSLIALCGSPVPIGSGFFPDGPQIQYFX

SEQ ID NO: 418814 - protein, 471 aa, Influenza virus
  MOD_RES (1)..(1): Any amino acid
  MOD_RES (16)..(19): Any amino acid
  MOD_RES (36)..(62): Any amino acid
  MOD_RES (73)..(83): Any amino acid
  MOD_RES (94)..(96): Any amino acid
  MOD_RES (114)..(143): Any amino acid
  MOD_RES (164)..(168): Any amino acid
  MOD_RES (181)..(182): Any amino acid
  MOD_RES (206)..(206): Any amino acid
  MOD_RES (251)..(269): Any amino acid
  MOD_RES (285)..(285): Any amino acid
  MOD_RES (297)..(320): Any amino acid
  MOD_RES (330)..(336): Any amino acid
  MOD_RES (346)..(357): Any amino acid
  MOD_RES (387)..(416): Any amino acid
  MOD_RES (426)..(445): Any amino acid
  MOD_RES (455)..(455): Any amino acid
  MOD_RES (468)..(471): Any amino acid
XNPNQKLFASSGIAIXXXXLNLLIGVSNVGLNMSLXXXXXXXXXXXXXXXXXXXXXXXXXXXNTYINNTTIIXXXXXXXXXXXLLLNKSLCSVXXXVVIAKDNAIRFGEGEQIXXXXXXXXXXXXXXXXXXXXXXXXXXXXXXSNGTIHDGTAFRGLISTQLGXXXXXSNSEFLCVGWSSXXCHDGVSRMTICVQGNNENATATVXYNRRPTTTIKTWAGKILRTQESECVCHDGTCVVVMTDGPANSQAXXXXXXXXXXXXXXXXXXXGSARHVEECSCYGHDXKVSCVCRDNWQXXXXXXXXXXXXXXXXXXXXXXXXILTDTSRPSXXXXXXXSNPITGSPCXXXXXXXXXXXXDNTWLGGTISPRSRNGFEMLKIPNAETDPXXXXXXXXXXXXXXXXXXXXXXXXXXXXXXSKCYNPCFYXXXXXXXXXXXXXXXXXXXXLVALCGSPVXVGSGSFPNGAQIXXXX

SEQ ID NO: 418815 - protein, 471 aa, Influenza virus
  MOD_RES (1)..(4): Any amino acid
  MOD_RES (14)..(27): Any amino acid
  MOD_RES (39)..(62): Any amino acid
  MOD_RES (73)..(96): Any amino acid
  MOD_RES (106)..(146): Any amino acid
  MOD_RES (161)..(194): Any amino acid
  MOD_RES (206)..(208): Any amino acid
  MOD_RES (220)..(229): Any amino acid
  MOD_RES (239)..(270): Any amino acid
  MOD_RES (280)..(287): Any amino acid
  MOD_RES (298)..(322): Any amino acid
  MOD_RES (332)..(337): Any amino acid
  MOD_RES (349)..(358): Any amino acid
  MOD_RES (387)..(457): Any amino acid
  MOD_RES (470)..(471): Any amino acid
XXXXQNLFTLSGVXXXXXXXXXXXXXXNIGLNVSLHLRXXXXXXXXXXXXXXXXXXXXXXXXNTYINNATIIXXXXXXXXXXXXXXXXXXXXXXXXVVIAQDNAIXXXXXXXXXXXXXXXXXXXXXXXXXXXXXXXXXXXXXXXXXTIHDRTTFRGLISTXXXXXXXXXXXXXXXXXXXXXXXXXXXXXXXXXXQGNNKNATATVXXXRRLTTTIRTWAXXXXXXXXXXCVCHNGTCAXXXXXXXXXXXXXXXXXXXXXXXXXXXXXXXXSAMHIEECSXXXXXXXXTCICRDNWQGXXXXXXXXXXXXXXXXXXXXXXXXXTDTSKPSDKXXXXXXNPITGSPEAPGXXXXXXXXXXSTWLGRTISPHSRSGFEVLKVPNAGTDPXXXXXXXXXXXXXXXXXXXXXXXXXXXXXXXXXXXXXXXXXXXXXXXXXXXXXXXXXXXXXXXXXXXXXXXSGSLPDGAQIQYXX

SEQ ID NO: 418816 - protein, 471 aa, Influenza virus
  MOD_RES (1)..(28): Any amino acid
  MOD_RES (38)..(98): Any amino acid
  MOD_RES (108)..(146): Any amino acid
  MOD_RES (158)..(234): Any amino acid
  MOD_RES (245)..(289): Any amino acid
  MOD_RES (299)..(359): Any amino acid
  MOD_RES (387)..(461): Any amino acid
XXXXXXXXXXXXXXXXXXXXXXXXXXXXVGLNISLHLXXXXXXXXXXXXXXXXXXXXXXXXXXXXXXXXXXXXXXXXXXXXXXXXXXXXXXXXXXXXXVAKDNAVRFXXXXXXXXXXXXXXXXXXXXXXXXXXXXXXXXXXXXXXXTIHDRAAFRGLXXXXXXXXXXXXXXXXXXXXXXXXXXXXXXXXXXXXXXXXXXXXXXXXXXXXXXXXXXXXXXXXXXXXXXXXXXXXXGTCVAVMTDGXXXXXXXXXXXXXXXXXXXXXXXXXXXXXXXXXXXXXXXXXXXXXGCRDNWQGAXXXXXXXXXXXXXXXXXXXXXXXXXXXXXXXXXXXXXXXXXXXXXXXXXXXXXXXXXXXXXTWLGRTFSPRSRSGFEVLKIPNAGIDPXXXXXXXXXXXXXXXXXXXXXXXXXXXXXXXXXXXXXXXXXXXXXXXXXXXXXXXXXXXXXXXXXXXXXXXXXXXPDGARIQYFS

SEQ ID NO: 418817 - protein, 471 aa, Influenza virus
  MOD_RES (1)..(147): Any amino acid
  MOD_RES (157)..(374): Any amino acid
  MOD_RES (384)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINDRTAFRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEMLKVPNAGXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418818 - protein, 548 aa, Influenza virus
  MOD_RES (1)..(51): Any amino acid
  MOD_RES (61)..(168): Any amino acid
  MOD_RES (201)..(201): Any amino acid
  MOD_RES (267)..(291): Any amino acid
  MOD_RES (326)..(344): Any amino acid
  MOD_RES (408)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
XXXXXXXXXXXXXXXXXXXXXXXXXXXXXXXXXXXXXXXXXXXXXXXXXXXEYNETVRVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGFAPFSKDNGIRIGSRGHVFVIREPFVSCSPXECRTFFLTQGSLLNDKHSNGTVKDRSPYRTLMSVEIGQSPNVYQARFEAVAWSATACHDGKKWMTXXXXXXXXXXXXXXXXXXXXXXXXXSWAGDILRTQESSCTCIQGECYWVMTDGPANRQAXXXXXXXXXXXXXXXXXXXFNGGHIEECSCYPNEGKVECVCRDNWTGTNRPVLVISPDLSYRVGYLCAGLPSDTPRGEDSQFXXXXXXXXXXQGYGVKGFGFRQGNDVWXXXXXXXXXXXXXXXXXXXXXXXXXXXXXXXXXXXXDNLNWSGYSGSFTLPVELXXXNCLVPCFWVEMIRGKPEEXTIWTSSSSIVMCGVDHXXADWSWHDGAILPFDIDKIIT

SEQ ID NO: 418819 - protein, 548 aa, Influenza virus
  MOD_RES (1)..(51): Any amino acid
  MOD_RES (61)..(168): Any amino acid
  MOD_RES (198)..(201): Any amino acid
  MOD_RES (267)..(291): Any amino acid
  MOD_RES (326)..(344): Any amino acid
  MOD_RES (368)..(368): Any amino acid
  MOD_RES (406)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
  MOD_RES (544)..(548): Any amino acid
XXXXXXXXXXXXXXXXXXXXXXXXXXXXXXXXXXXXXXXXXXXXXXXXXXXEYNETVRIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQGFAPFSKDNGIRIGSKGHVFVIREPFISXXXXGCRTFFLTQGSLPNDKHSNGTIKDRSPYRTLMSVKIGQSANVYQARFESVAWSATACHDGRKWMTXXXXXXXXXXXXXXXXXXXXXXXXXSWAGNILRTQESSCTCIKGDCYWVMTDGPANKQAXXXXXXXXXXXXXXXXXXXFSGGHIEECSCYPNDGKVECVCRXNWTGTNRPILVISSDLSYTVGYLCAGIPTDTPRGEDSXXXXXXXXXXXXKGYGVKGFGFRQGTDVWXXXXXXXXXXXXXXXXXXXXXXXXXXXXXXXXXXXXDDPNWSGYSGSFTLPIELXXXDCLVPCFWVEMIRGRPEEXTIWTSSSSVVMCGVDHXXASWSWHDGAILPLTSXXXXX

SEQ ID NO: 418820 - protein, 548 aa, Influenza virus
  MOD_RES (1)..(51): Any amino acid
  MOD_RES (61)..(168): Any amino acid
  MOD_RES (178)..(179): Any amino acid
  MOD_RES (197)..(201): Any amino acid
  MOD_RES (255)..(256): Any amino acid
  MOD_RES (266)..(291): Any amino acid
  MOD_RES (326)..(344): Any amino acid
  MOD_RES (408)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
XXXXXXXXXXXXXXXXXXXXXXXXXXXXXXXXXXXXXXXXXXXXXXXXXXXEYNETIRIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGFAPFSKDXXIRIGSRGHIFVIREPFVXXXXXECRTFFLTHGSLLNDKHFNGTMKDRSPYRTLMSVEVGQSPNVYQSRFEAVAWSXXACHDGKKWTXXXXXXXXXXXXXXXXXXXXXXXXXXSWEGDILRTQESSCTCIRGECFWVMTDGPANSQAXXXXXXXXXXXXXXXXXXXFDGGHIEECSCYPNNGKVECICRDNWTGTNRPVLIISPDLSYKVGYLCAGIPSDTPRGEDAQFXXXXXXXXXXLGYGVKGFGFRQGDDVWXXXXXXXXXXXXXXXXXXXXXXXXXXXXXXXXXXXXDNSNWSGYSGSFTLPVGLXXXGCLVPCFWVEMIRGEPEEXAIWTSSSSIVMCGVNYXXANWSWHDGAILPFDFDKISQ

SEQ ID NO: 418821 - protein, 548 aa, Influenza virus
  MOD_RES (1)..(51): Any amino acid
  MOD_RES (61)..(168): Any amino acid
  MOD_RES (178)..(187): Any amino acid
  MOD_RES (199)..(201): Any amino acid
  MOD_RES (248)..(257): Any amino acid
  MOD_RES (267)..(291): Any amino acid
  MOD_RES (326)..(344): Any amino acid
  MOD_RES (356)..(356): Any amino acid
  MOD_RES (368)..(370): Any amino acid
  MOD_RES (380)..(383): Any amino acid
  MOD_RES (395)..(396): Any amino acid
  MOD_RES (408)..(424): Any amino acid
  MOD_RES (435)..(470): Any amino acid
  MOD_RES (489)..(491): Any amino acid
  MOD_RES (501)..(510): Any amino acid
  MOD_RES (527)..(528): Any amino acid
  MOD_RES (544)..(548): Any amino acid
XXXXXXXXXXXXXXXXXXXXXXXXXXXXXXXXXXXXXXXXXXXXXXXXXXXEYNETVKVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGFAPFSKDXXXXXXXXXXVFIIREPFVSCXXXDCRTFFLTQGSLLNDRHSNGTVKDRSPFRTLMSVEIGLSPNVYQARXXXXXXXXXXCHDGKKWMAXXXXXXXXXXXXXXXXXXXXXXXXXSWAGDIMRTQESSCTCILGNCYWVMTDGPANNQAXXXXXXXXXXXXXXXXXXXFNEGHIEECSCXPNEGKVECICRXXXTGTNRPVVVXXXXLSYQVGYLCAGXXSDTPRGEDNQFXXXXXXXXXXXXXXXXXFGFRQGSDVWXXXXXXXXXXXXXXXXXXXXXXXXXXXXXXXXXXXXDNPNWSGYSGSFTLPVEMXXXSCLVPCFWVXXXXXXXXXXTVWTSSSSIVMCGVDYXXADWSWQDGAVLPFDIXXXXX

SEQ ID NO: 418822 - protein, 548 aa, Influenza virus
  MOD_RES (1)..(51): Any amino acid
  MOD_RES (61)..(206): Any amino acid
  MOD_RES (256)..(257): Any amino acid
  MOD_RES (267)..(291): Any amino acid
  MOD_RES (301)..(344): Any amino acid
  MOD_RES (355)..(371): Any amino acid
  MOD_RES (395)..(396): Any amino acid
  MOD_RES (408)..(491): Any amino acid
  MOD_RES (501)..(517): Any amino acid
  MOD_RES (527)..(529): Any amino acid
  MOD_RES (542)..(548): Any amino acid
XXXXXXXXXXXXXXXXXXXXXXXXXXXXXXXXXXXXXXXXXXXXXXXXXXXEYNETVRTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFITQGSLLNDKHSSGTVKDRSPFRTLMSVKVGQSPNVYQAKFESVAWSAXXCHDGNKWMTXXXXXXXXXXXXXXXXXXXXXXXXXSRAGDILRTXXXXXXXXXXXXXXXXXXXXXXXXXXXXXXXXXXXXXXXXXXXXFTEGHIEECSXXXXXXXXXXXXXXXXXGTNRPVLVVSPDLSYSVGYLCAGXXSDTPRGEDGQFXXXXXXXXXXXXXXXXXXXXXXXXXXXXXXXXXXXXXXXXXXXXXXXXXXXXXXXXXXXXXXXXXXXXXXXXXXXXXXXXXXXXECLVPCFWVXXXXXXXXXXXXXXXXXSIVMCGVEHXXXDWSWHDGAVLPFXXXXXXX

SEQ ID NO: 418823 - protein, 548 aa, Influenza virus
  MOD_RES (1)..(214): Any amino acid
  MOD_RES (228)..(230): Any amino acid
  MOD_RES (240)..(241): Any amino acid
  MOD_RES (256)..(294): Any amino acid
  MOD_RES (304)..(377): Any amino acid
  MOD_RES (387)..(529): Any amino acid
  MOD_RES (539)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNDKHSNGTMKDRSXXXTLMSVGIGQXXNVYQAKFEAVAWSAXXXXXXXXXXXXXXXXXXXXXXXXXXXXXXXXXXXXXXXWDILRTQESXXXXXXXXXXXXXXXXXXXXXXXXXXXXXXXXXXXXXXXXXXXXXXXXXXXXXXXXXXXXXXXXXXXXXXXXXXLVISTDLSYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWSWHDGAVXXXXXXXXXX

SEQ ID NO: 418824 - protein, 548 aa, Influenza virus
  MOD_RES (1)..(294): Any amino acid
  MOD_RES (304)..(534): Any amino acid
  MOD_RES (544)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEDILRTQESXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGAILPFGIXXXXX

SEQ ID NO: 418825 - protein, 470 aa, Influenza virus
  MOD_RES (16)..(26): Any amino acid
  MOD_RES (40)..(53): Any amino acid
  MOD_RES (76)..(84): Any amino acid
  MOD_RES (286)..(288): Any amino acid
  MOD_RES (310)..(310): Any amino acid
  MOD_RES (359)..(359): Any amino acid
  MOD_RES (392)..(392): Any amino acid
MNPNQKILCTSATAIXXXXXXXXXXXANLGLNIGLHLKPXXXXXXXXXXXXXXSQTIINNYYNETNITQISNTNIXXXXXXXXXFNNLTKGLCTINSWHIYGKDNAVRIGEDSDVLVTREPYVSCDPDECRFYALSQGTTIRGKHSNGTIHDRSQYRALISWPLSSPPTVYNSRVECIGWSSTSCHDGRARMSICISGPNNNASAVIWYNRRPVTEINTWARNILRTQESECVCHNGVCPVVFTDGSATGPAETRVYYFKEGKILKWEPLTGTAKHIEECSCYGEXXXITCTCRDNWQGSNRPVIQIDPXAMTHTSQYICSPVLTDNPRPNDPAVGKCNDPYPGNNNNGVKGFSYLDGXNTWLGRTISTASRSGYEMLKVPNALTDDRSKPXQGQTIVLNTDWSGYSGSFMDYWAEGECYRACFYVELIRGRPKEDKVWWTSNSIVSMCSSTEFLGQWNWPDGAKIEYFL

SEQ ID NO: 418826 - protein, 470 aa, Influenza virus
  MOD_RES (16)..(26): Any amino acid
  MOD_RES (40)..(53): Any amino acid
  MOD_RES (66)..(66): Any amino acid
  MOD_RES (76)..(84): Any amino acid
  MOD_RES (135)..(135): Any amino acid
  MOD_RES (224)..(227): Any amino acid
  MOD_RES (283)..(288): Any amino acid
  MOD_RES (310)..(310): Any amino acid
  MOD_RES (320)..(325): Any amino acid
  MOD_RES (359)..(359): Any amino acid
  MOD_RES (392)..(392): Any amino acid
  MOD_RES (425)..(427): Any amino acid
  MOD_RES (469)..(470): Any amino acid
MNPNQKILFASATAIXXXXXXXXXXXVNLGLNIGLHLRPXXXXXXXXXXXXXXSQTVINNYYNETXVTQISNTNIXXXXXXXXXFNNLTRELCTINSWHIFGKDNAIRIGENSDVLVTREPYVSCEPDECRFYAXSQGTTIRGRHSNGTIHDRSQYRSLISWPLSSPPTVYNTRIECIGWSSTSCHDGKSRMSICVSGPNNNASAIVWYNRRPVAEINTWARNXXXXQESECVCHSGICPVVFTDGSATGPADTRIYYFKEGKILKWESLTGTAKHIEECSSXXXXXXVTCTCRDNWQGSNRPVIRIDPXVMTHTSQYIXXXXXXDNPRPNDPTIGKCNDPYPGNSNNGVKGFAYLDGXNTWLGRTTSTASRSGYEVLRVPNALTDDKSKPXQGQTVVLNTDWSGYSGSFIDYWAKGECYRACFXXXLIRGRPKEEKVWWTSNSIISMCSSTEFLGQWDWPDGAKIETXX

SEQ ID NO: 418827 - protein, 470 aa, Influenza virus
  MOD_RES (11)..(26): Any amino acid
  MOD_RES (36)..(53): Any amino acid
  MOD_RES (76)..(84): Any amino acid
  MOD_RES (119)..(119): Any amino acid
  MOD_RES (137)..(151): Any amino acid
  MOD_RES (175)..(181): Any amino acid
  MOD_RES (223)..(227): Any amino acid
  MOD_RES (245)..(247): Any amino acid
  MOD_RES (260)..(261): Any amino acid
  MOD_RES (286)..(288): Any amino acid
  MOD_RES (299)..(299): Any amino acid
  MOD_RES (310)..(310): Any amino acid
  MOD_RES (320)..(325): Any amino acid
  MOD_RES (355)..(359): Any amino acid
  MOD_RES (392)..(392): Any amino acid
  MOD_RES (427)..(428): Any amino acid
  MOD_RES (446)..(456): Any amino acid
MNPNQKIQCTXXXXXXXXXXXXXXXXTNLGLNIGLXXXXXXXXXXXXXXXXXXSQTIINNYHNETNITQISNINIXXXXXXXXXFNNLTRGLCTINSWHIFGKDNAVRIGENSGVLVTXEPYVSCDPNECRFYALSXXXXXXXXXXXXXXXDRSQYRALVSWPLSSPPTVYNNRXXXXXXXSTSCHDGKARMSVCISGPNNNASAVVWYNGRPITEINTWARXXXXXEESECVCHNGICPVVFTXXXATGPAETRIYYFXXGKTLKWEPLAGTAKHIEECSCYGVXXXIICTCRDNWQXSNRPVIQINPXMMTHTSQYIXXXXXXDNPRPNDPNVGKCNEPYPGNNNNGVKGFAXXXXXNTWVGRTISIASRSGYEMLKVPNALIDDRSKPXQGQTIVSNTDWSGYSGSFVDYWAEGDCYRACFYVXXIRGRPKEDRVWWTSNSIXXXXXXXXXXXQWNWPDGAEIEYFL

SEQ ID NO: 418828 - protein, 470 aa, Influenza virus
  MOD_RES (1)..(1): Any amino acid
  MOD_RES (16)..(26): Any amino acid
  MOD_RES (40)..(53): Any amino acid
  MOD_RES (76)..(84): Any amino acid
  MOD_RES (138)..(155): Any amino acid
  MOD_RES (194)..(198): Any amino acid
  MOD_RES (208)..(210): Any amino acid
  MOD_RES (220)..(229): Any amino acid
  MOD_RES (239)..(247): Any amino acid
  MOD_RES (286)..(310): Any amino acid
  MOD_RES (320)..(325): Any amino acid
  MOD_RES (335)..(339): Any amino acid
  MOD_RES (353)..(360): Any amino acid
  MOD_RES (392)..(392): Any amino acid
  MOD_RES (404)..(407): Any amino acid
  MOD_RES (418)..(429): Any amino acid
  MOD_RES (446)..(460): Any amino acid
XNPNQKILCASATAIXXXXXXXXXXXANLGLNVGLHLKPXXXXXXXXXXXXXXNQTIINNYYNKTNLTQISNTNIXXXXXXXXXFNNLTKRLCTINSWHIYGKDNAIRIGEDSDILVTREPYVSCDPDGCRFYALSQXXXXXXXXXXXXXXXXXXYRALISWPQSSPPTVYNSKVECIGWSSTSCHDGKFRMSXXXXXPNNNASAIIXXXKRPVTEINTXXXXXXXXXXSECVCQNGVXXXXXXXXXATGPADTRVYYFREGRILKWEPLNGTAKHIEECSCYGKXXXXXXXXXXXXXXXXXXXXXXXXXTMTHTSQYIXXXXXXDNPRPNDPVXXXXXDPYPGNNNGVKGFXXXXXXXXTWLGRTISIASRYGYEMLKVPNALTDNRSKPXQGQIIVLNTDWXXXXGSFIDYWAEGXXXXXXXXXXXXRGRPKEDEVWWTSNSIXXXXXXXXXXXXXXXPDGAKIKYFL

SEQ ID NO: 418829 - protein, 470 aa, Influenza virus
  MOD_RES (1)..(2): Any amino acid
  MOD_RES (16)..(55): Any amino acid
  MOD_RES (76)..(85): Any amino acid
  MOD_RES (103)..(103): Any amino acid
  MOD_RES (120)..(165): Any amino acid
  MOD_RES (175)..(181): Any amino acid
  MOD_RES (192)..(199): Any amino acid
  MOD_RES (223)..(230): Any amino acid
  MOD_RES (240)..(253): Any amino acid
  MOD_RES (271)..(274): Any amino acid
  MOD_RES (284)..(310): Any amino acid
  MOD_RES (322)..(325): Any amino acid
  MOD_RES (335)..(339): Any amino acid
  MOD_RES (359)..(360): Any amino acid
  MOD_RES (392)..(395): Any amino acid
  MOD_RES (405)..(408): Any amino acid
  MOD_RES (426)..(460): Any amino acid
  MOD_RES (470)..(470): Any amino acid
XXPNQRILCTSATALXXXXXXXXXXXXXXXXXXXXXXXXXXXXXXXXXXXXXXXXTIINNYYNDTNVTQINNTNIXXXXXXXXXXNNLTRGLCKINSWHIFGXDNAVRIGESSDVLVTRXXXXXXXXXXXXXXXXXXXXXXXXXXXXXXXXXXXXXXXXXXXXXXSPPTVYSSRXXXXXXXSTSCHDGKTRXXXXXXXXNNNASPVIWYNGRPTTEINTWARXXXXXXXXECVCHDGVCXXXXXXXXXXXXXXTRVYYFKKGKIIKWEPLXXXXRHIEECSCYXXXXXXXXXXXXXXXXXXXXXXXXXXXAMKHTSQYICSXXXXDNPRPNDPSXXXXXDPYPGSNNNGVKGFSYLNGXXTWLGRTLNTASRSGYEILKVPNALTDERSKPXXXXTIVLTTDWSXXXXSFIDYWAKEECYRACFYXXXXXXXXXXXXXXXXXXXXXXXXXXXXXXXXXXXPDGAKIEYSX

SEQ ID NO: 418830 - protein, 470 aa, Influenza virus
  MOD_RES (1)..(3): Any amino acid
  MOD_RES (16)..(86): Any amino acid
  MOD_RES (97)..(104): Any amino acid
  MOD_RES (120)..(200): Any amino acid
  MOD_RES (210)..(231): Any amino acid
  MOD_RES (245)..(253): Any amino acid
  MOD_RES (263)..(265): Any amino acid
  MOD_RES (275)..(339): Any amino acid
  MOD_RES (355)..(363): Any amino acid
  MOD_RES (375)..(381): Any amino acid
  MOD_RES (391)..(397): Any amino acid
  MOD_RES (408)..(411): Any amino acid
  MOD_RES (425)..(470): Any amino acid
XXXSQKILCTSAIAIXXXXXXXXXXXXXXXXXXXXXXXXXXXXXXXXXXXXXXXXXXXXXXXXXXXXXXXXXXXXXXXXXXXXXXXNLTKELCTINXXXXXXXXNAIRIGGNSDVLVTRXXXXXXXXXXXXXXXXXXXXXXXXXXXXXXXXXXXXXXXXXXXXXXXXXXXXXXXXXXXXXXXXXXXXXXXXXXXXXXXXXNNASTVIWYXXXXXXXXXXXXXXXXXXXXXXCVCHSGVCPVVFTXXXXXXXXXTRVYYFKGGXXXKWESLAGTAXXXXXXXXXXXXXXXXXXXXXXXXXXXXXXXXXXXXXXXXXXXXXXXXXXXXXXXXXXXXXXXXXDPYPGNNBNGVKGFSXXXXXXXXXGRTINTASRSGXXXXXXXNALTNDRSKXXXXXXXVLDTDWSGYSXXXXDYWAKGDCYRACFXXXXXXXXXXXXXXXXXXXXXXXXXXXXXXXXXXXXXXXXXXXXXX

SEQ ID NO: 418831 - protein, 470 aa, Influenza virus
  MOD_RES (1)..(88): Any amino acid
  MOD_RES (102)..(111): Any amino acid
  MOD_RES (121)..(201): Any amino acid
  MOD_RES (211)..(233): Any amino acid
  MOD_RES (244)..(265): Any amino acid
  MOD_RES (275)..(340): Any amino acid
  MOD_RES (351)..(365): Any amino acid
  MOD_RES (376)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXTKGLCIINSWHIYXXXXXXXXXXKSDVLVTREXXXXXXXXXXXXXXXXXXXXXXXXXXXXXXXXXXXXXXXXXXXXXXXXXXXXXXXXXXXXXXXXXXXXXXXXXXXXXXXXXNASAVIWYKXXXXXXXXXXXXXXXXXXXXXXXCHNGICPVAFXXXXXXXXXXXXXXXXXXXXXXKWESLNGTAXXXXXXXXXXXXXXXXXXXXXXXXXXXXXXXXXXXXXXXXXXXXXXXXXXXXXXXXXXXXXXXXXXPYPGNNNKGVXXXXXXXXXXXXXXXTISTASRYGYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418832 - protein, 470 aa, Influenza virus
  MOD_RES (1)..(365): Any amino acid
  MOD_RES (382)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTISTASRAGYEMLKVPXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418833 - protein, 568 aa, Influenza virus
  MOD_RES (1)..(15): Any amino acid
  MOD_RES (38)..(39): Any amino acid
  MOD_RES (53)..(65): Any amino acid
  MOD_RES (77)..(88): Any amino acid
  MOD_RES (98)..(109): Any amino acid
  MOD_RES (126)..(153): Any amino acid
  MOD_RES (163)..(167): Any amino acid
  MOD_RES (184)..(189): Any amino acid
  MOD_RES (199)..(203): Any amino acid
  MOD_RES (245)..(248): Any amino acid
  MOD_RES (268)..(286): Any amino acid
  MOD_RES (337)..(337): Any amino acid
  MOD_RES (485)..(486): Any amino acid
  MOD_RES (541)..(546): Any amino acid
XXXXXXXXXXXXXXXGLDKICLGHHAVSNGTIVKTLTXXKEEVTNATETVESXXXXXXXXXXXXXKDLGNCHPIGMXXXXXXXXXXXXGTWDTLIERXXXXXXXXXXXXVNEEALRQKIMESGGIXXXXXXXXXXXXXXXXXXXXXXXXXXXXSFYAELKWLXXXXXGQNFPQTTNTYRNTDSXXXXXXWGIHHPSSTXXXXXLYGTQSLSISVGSSTYQNNFVPVVGARPQVNGQSGRIDFHWXXXXPGDNITFSHNGGLIAPSRVXXXXXXXXXXXXXXXXXXXCESKCFWKGGSINTKLPFQNLSPRTVGQCPKYVNKKSLLLATGMRNVPEVXQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCXXNCMESIRNNTYDHTQYREEALLNRLNINPVKLSSGYKDVILWFSFGASCFVLLAXXXXXXFFCLKNGNMRCTISLVKTTLFL

SEQ ID NO: 418834 - protein, 568 aa, Influenza virus
  MOD_RES (1)..(15): Any amino acid
  MOD_RES (38)..(39): Any amino acid
  MOD_RES (53)..(65): Any amino acid
  MOD_RES (77)..(88): Any amino acid
  MOD_RES (98)..(109): Any amino acid
  MOD_RES (125)..(153): Any amino acid
  MOD_RES (163)..(167): Any amino acid
  MOD_RES (184)..(189): Any amino acid
  MOD_RES (199)..(203): Any amino acid
  MOD_RES (245)..(248): Any amino acid
  MOD_RES (268)..(286): Any amino acid
  MOD_RES (310)..(311): Any amino acid
  MOD_RES (337)..(337): Any amino acid
  MOD_RES (348)..(349): Any amino acid
  MOD_RES (395)..(402): Any amino acid
  MOD_RES (420)..(426): Any amino acid
  MOD_RES (442)..(442): Any amino acid
  MOD_RES (485)..(486): Any amino acid
  MOD_RES (541)..(546): Any amino acid
  MOD_RES (557)..(568): Any amino acid
XXXXXXXXXXXXXXXGIDKICLGHHAVPNGTVVKTLTXXQEEVTNATETVENXXXXXXXXXXXXXKDLGSCHPIGMXXXXXXXXXXXXGKWDTLIERXXXXXXXXXXXXINEEALRQKVMESGGXXXXXXXXXXXXXXXXXXXXXXXXXXXXXSFYTELKWLXXXXXGQNFPQTANTYRNTDSXXXXXXWGIHHPSSAXXXXXLYGAQSLSISVGSSIYQNSFVPVVGARPKVNGQSGRIEFHWXXXXPGDSITFSHNGGRIAPSRVXXXXXXXXXXXXXXXXXXXCESKCFWRGGSINTRLPFQNLSPXXVGQCPKYVSKRSLLLATGMRNVPEIXQERGLFGAIAXXIENGWEGMIDGWYGFRHQNAQGIGQAADYKSTQTAIVQITGKLNRXXXXXXXXFESIESEFNEIEHQIGNXXXXXXXSITYIWTYQAELLIAXENQHTIDLADSEMLNLYDRVRKQLRQNAEEDGRGCFEIYHACXXSCMESIRNNTYNHTQYREESLLNRLSINPVTLSSGYKDIILWFSFGASSFVLLAXXXXXXFFCLRNGNMRXXXXXXXXXXXX

SEQ ID NO: 418835 - protein, 568 aa, Influenza virus
  MOD_RES (1)..(15): Any amino acid
  MOD_RES (38)..(39): Any amino acid
  MOD_RES (49)..(65): Any amino acid
  MOD_RES (77)..(88): Any amino acid
  MOD_RES (98)..(109): Any amino acid
  MOD_RES (126)..(153): Any amino acid
  MOD_RES (163)..(167): Any amino acid
  MOD_RES (184)..(189): Any amino acid
  MOD_RES (199)..(203): Any amino acid
  MOD_RES (245)..(248): Any amino acid
  MOD_RES (268)..(286): Any amino acid
  MOD_RES (310)..(311): Any amino acid
  MOD_RES (337)..(337): Any amino acid
  MOD_RES (355)..(366): Any amino acid
  MOD_RES (395)..(404): Any amino acid
  MOD_RES (422)..(431): Any amino acid
  MOD_RES (441)..(445): Any amino acid
  MOD_RES (458)..(475): Any amino acid
  MOD_RES (485)..(486): Any amino acid
  MOD_RES (525)..(528): Any amino acid
  MOD_RES (541)..(546): Any amino acid
  MOD_RES (557)..(568): Any amino acid
XXXXXXXXXXXXXXXGLDRICLGHHAVANGTTVKTLTXXHEEVTNATEXXXXXXXXXXXXXXXXXKDLGNCHPVGMXXXXXXXXXXXXGTWNTLIERXXXXXXXXXXXXVNEGALRQKIMESGGVXXXXXXXXXXXXXXXXXXXXXXXXXXXXSFYAELRWLXXXXXGQNFPRTTNTYRNTDTXXXXXXWGIHHPSNTXXXXXLYGTQPLSISVGSSTYHNSFVPVIGARPQVNGQRGRIDFHWXXXXPGDNIIFSHNGGLIAPDRVXXXXXXXXXXXXXXXXXXXCKSKCFWRGGSIITELPFQNLSPXXVGQCPKYVKKKSLMLATGMRNVPETXQGRGLFGAKAGFIENGWXXXXXXXXXXXXQNAQGTGLAADYESTQAAINQITGKLNRXXXXXXXXXXSIESEFSETEHQIGNVIXXXXXXXXXXWTYQEELLVXXXXXHTIDMGDSEMLNXXXXXXXXXXXXXXXXXXGCFEIYHTCXXDCMESIRNNTYDHSQYREEALLNRININPVELSSGYKDXXXXFSFGASCFILLAXXXXXXSFCLKNGNMQXXXXXXXXXXXX

SEQ ID NO: 418836 - protein, 568 aa, Influenza virus
  MOD_RES (1)..(15): Any amino acid
  MOD_RES (38)..(39): Any amino acid
  MOD_RES (49)..(65): Any amino acid
  MOD_RES (77)..(88): Any amino acid
  MOD_RES (98)..(109): Any amino acid
  MOD_RES (126)..(153): Any amino acid
  MOD_RES (163)..(167): Any amino acid
  MOD_RES (184)..(189): Any amino acid
  MOD_RES (199)..(205): Any amino acid
  MOD_RES (245)..(248): Any amino acid
  MOD_RES (266)..(287): Any amino acid
  MOD_RES (308)..(312): Any amino acid
  MOD_RES (331)..(368): Any amino acid
  MOD_RES (383)..(383): Any amino acid
  MOD_RES (394)..(406): Any amino acid
  MOD_RES (421)..(433): Any amino acid
  MOD_RES (444)..(446): Any amino acid
  MOD_RES (460)..(475): Any amino acid
  MOD_RES (485)..(486): Any amino acid
  MOD_RES (525)..(546): Any amino acid
  MOD_RES (556)..(568): Any amino acid
XXXXXXXXXXXXXXXSLDKICLGHHAVTNGTIVTTLTXXREEVTNATEXXXXXXXXXXXXXXXXXKDLDNCHPIGMXXXXXXXXXXXXGTWDTIIERXXXXXXXXXXXXINEGALRQKIMESGEIXXXXXXXXXXXXXXXXXXXXXXXXXXXXSFYGELKWLXXXXXGQSFPQTTNTYRNTDPXXXXXXWGIHHPSSIXXXXXXXGTQSLSISIGSSTYQNNFVPVIGARPLVNGQSGRINFHWXXXXPGDNITFSDNGGLIAPSXXXXXXXXXXXXXXXXXXXXXXESKCFWKSGSIKTKLPFQNLXXXXXGQCPKYVNQRSLMLATGMXXXXXXXXXXXXXXXXXXXXXXXXXXXXXXXXXXXXXXDQGTGQAADYESTQXAVDQITGKLNXXXXXXXXXXXXXESEFNEIEYQIGNVXXXXXXXXXXXXXYNAELLVAMEXXXTIEMTDSEMLNLYXXXXXXXXXXXXXXXXGCFEIYHNCXXSCMERIRNNTYDHAQYREEALLNRLSINSVKLSSGYKNXXXXXXXXXXXXXXXXXXXXXXFFCLKDGNMXXXXXXXXXXXXX

SEQ ID NO: 418837 - protein, 568 aa, Influenza virus
  MOD_RES (1)..(39): Any amino acid
  MOD_RES (49)..(65): Any amino acid
  MOD_RES (77)..(88): Any amino acid
  MOD_RES (98)..(109): Any amino acid
  MOD_RES (120)..(153): Any amino acid
  MOD_RES (163)..(167): Any amino acid
  MOD_RES (177)..(206): Any amino acid
  MOD_RES (241)..(248): Any amino acid
  MOD_RES (268)..(288): Any amino acid
  MOD_RES (301)..(312): Any amino acid
  MOD_RES (331)..(374): Any amino acid
  MOD_RES (397)..(409): Any amino acid
  MOD_RES (424)..(447): Any amino acid
  MOD_RES (459)..(475): Any amino acid
  MOD_RES (485)..(486): Any amino acid
  MOD_RES (528)..(546): Any amino acid
  MOD_RES (556)..(568): Any amino acid
XXXXXXXXXXXXXXXXXXXXXXXXXXXXXXXXXXXXXXXMEEVTNATEXXXXXXXXXXXXXXXXXRDLGNCHPIGIXXXXXXXXXXXXGIWDTLIERXXXXXXXXXXXXVSEEALRQKIXXXXXXXXXXXXXXXXXXXXXXXXXXXXXXXXXXSFYAEVKWLXXXXXEQNFPQTTNXXXXXXXXXXXXXXXXXXXXXXXXXXXXXXTQSLSISVESSTYQNNFVPVMGARPQVNGQSGRVXXXXXXXXPGDHITFSHNGGLIAPNRVXXXXXXXXXXXXXXXXXXXXXSKCFWKGGTINTXXXXXXXXXXXXGQCPKYVSQGSLLLATGMXXXXXXXXXXXXXXXXXXXXXXXXXXXXXXXXXXXXXXXXXXXXAADYKSTQKTIDQVTGKLNRLIXXXXXXXXXXXXXFSEIEHQISNVINWXXXXXXXXXXXXXXXXXXXXXXXXIDMADSTMLNLXXXXXXXXXXXXXXXXXGCFEIYHVCXXNCMESIRDNTYDHSHYREEALLNRLNINSVKLFSGYKDIILXXXXXXXXXXXXXXXXXXXFFCLKNGNTXXXXXXXXXXXXX

SEQ ID NO: 418838 - protein, 568 aa, Influenza virus
  MOD_RES (1)..(168): Any amino acid
  MOD_RES (178)..(212): Any amino acid
  MOD_RES (245)..(249): Any amino acid
  MOD_RES (259)..(290): Any amino acid
  MOD_RES (304)..(376): Any amino acid
  MOD_RES (386)..(492): Any amino acid
  MOD_RES (503)..(503): Any amino acid
  MOD_RES (525)..(547): Any amino acid
  MOD_RES (557)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNFPQTTNTXXXXXXXXXXXXXXXXXXXXXXXXXXXXXXXXXXXLVGSSTYQNSFVPVVRARPQVNGQSGRIVFHWXXXXXGHNITFSHNXXXXXXXXXXXXXXXXXXXXXXXXXXXXXXXXCFWKGGSIKTKLPXXXXXXXXXXXXXXXXXXXXXXXXXXXXXXXXXXXXXXXXXXXXXXXXXXXXXXXXXXXXXXXXXXXXXXXXXDYKSTQAAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNNTYDHSHYXEEAPLNRLNINPVKLSSSYKDXXXXXXXXXXXXXXXXXXXXXXXLCLKNGNMRXXXXXXXXXXXX

SEQ ID NO: 418839 - protein, 568 aa, Influenza virus
  MOD_RES (1)..(214): Any amino acid
  MOD_RES (241)..(250): Any amino acid
  MOD_RES (265)..(294): Any amino acid
  MOD_RES (304)..(505): Any amino acid
  MOD_RES (515)..(547): Any amino acid
  MOD_RES (557)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSSTYQSNFVPVVRARPLVNGQRGRIXXXXXXXXXXDNITFLHNGGLIAPXXXXXXXXXXXXXXXXXXXXXXXXXXXXXXEGSINTRLPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALLSRLNINXXXXXXXXXXXXXXXXXXXXXXXXXXXXXXXXXFWLKNGNMRXXXXXXXXXXXX

SEQ ID NO: 418840 - protein, 568 aa, Influenza virus
  MOD_RES (1)..(219): Any amino acid
  MOD_RES (230)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQNNFVPVVRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418841 - protein, 568 aa, Influenza virus
  MOD_RES (1)..(223): Any amino acid
  MOD_RES (238)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVPVVGDRPLVNGQRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418842 - protein, 561 aa, Influenza virus
  MOD_RES (1)..(15): Any amino acid
  MOD_RES (54)..(64): Any amino acid
  MOD_RES (131)..(131): Any amino acid
  MOD_RES (143)..(150): Any amino acid
  MOD_RES (184)..(184): Any amino acid
  MOD_RES (246)..(246): Any amino acid
  MOD_RES (281)..(283): Any amino acid
  MOD_RES (337)..(337): Any amino acid
XXXXXXXXXXXXXXXGLDKICLGHHAVSNGTIVKTLTNEKEEVTNATETVESKXXXXXXXXXXXYKDLGNCHPIGMVIGTPACDLHLTGTWDTLIERDNSIAYCYPGATVNEEALRQKIMESGGIDKISTXFTYGSSINSAGXXXXXXXXGGNSFYAELKWLVSKSKGQNFPQTTNTYRNTDSXEHLIIWGIHHPSSTQEKNDLYGTQSLSISVGSSTYQNNFVPVVGARPQVNGQSGRIDFHWTXVQPGDNITFSHNGGLIAPSRVSKLKGRGLGIQSGXXXDNDCESKCFWKGGSINTKLPFQNLSPRTVGQCPKYVNKKSLLLATGMRNVPEVXQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDDNCMESIRNNTYDHTQYREEALLNRLNINPVKLSSGYKDVILWFSFGASCFVLLAVIMGLVFFCLKNGNMRCTICI

SEQ ID NO: 418843 - protein, 561 aa, Influenza virus
  MOD_RES (1)..(15): Any amino acid
  MOD_RES (54)..(64): Any amino acid
  MOD_RES (131)..(131): Any amino acid
  MOD_RES (141)..(150): Any amino acid
  MOD_RES (184)..(184): Any amino acid
  MOD_RES (228)..(232): Any amino acid
  MOD_RES (246)..(246): Any amino acid
  MOD_RES (281)..(283): Any amino acid
  MOD_RES (303)..(311): Any amino acid
  MOD_RES (337)..(337): Any amino acid
  MOD_RES (353)..(370): Any amino acid
  MOD_RES (392)..(402): Any amino acid
  MOD_RES (420)..(431): Any amino acid
  MOD_RES (441)..(445): Any amino acid
  MOD_RES (561)..(561): Any amino acid
XXXXXXXXXXXXXXXGIDKICLGHHAVPNGTIVKTLTSEKEEVINATETVESTXXXXXXXXXXXYKDLGSCHPIGMIIGTPVCDPHLTGTWDTLIERENAIAHCYPGATINEEALRQKIMESGGISKISTXFIYGSSINSXXXXXXXXXXGGDSFYAELKWLISKSKEQNFPQTANTYRNTDSXEHLIVWGIHHPSSAQEKNDLYGAQSLSISVESSTYQNNFVPVIXXXXXVNGQSGRINFHWTXVRPGDNITFSDNGGLIAPSRVTKLKGRGLGIQSEXXXDNNCESKCFWRGGSINTKLXXXXXXXXXVGQCPKYVSKRSLLLATGMRNVPEIXQERGLFGAIAGFLENXXXXXXXXXXXXXXXXXXGTGQAADYESTQAAIDQMTGKXXXXXXXXXXXFESIESEFNEIEHQIGNXXXXXXXXXXXXWTYQAELLIXXXXXHTIDLADSEMLNLYDRVRKQLRQNAEEDGRGCFEIYHKCDDSCMESIRNNTYDHAQYREEALLNRLSINPVKLSSGYKDIILWFSFGASCFILLAVIVGLVFFCLKNGNMRCTILX

SEQ ID NO: 418844 - protein, 561 aa, Influenza virus
  MOD_RES (1)..(15): Any amino acid
  MOD_RES (54)..(64): Any amino acid
  MOD_RES (117)..(119): Any amino acid
  MOD_RES (131)..(131): Any amino acid
  MOD_RES (141)..(150): Any amino acid
  MOD_RES (184)..(184): Any amino acid
  MOD_RES (231)..(236): Any amino acid
  MOD_RES (246)..(246): Any amino acid
  MOD_RES (269)..(271): Any amino acid
  MOD_RES (281)..(283): Any amino acid
  MOD_RES (308)..(312): Any amino acid
  MOD_RES (337)..(344): Any amino acid
  MOD_RES (355)..(374): Any amino acid
  MOD_RES (397)..(404): Any amino acid
  MOD_RES (422)..(432): Any amino acid
  MOD_RES (444)..(448): Any amino acid
  MOD_RES (463)..(474): Any amino acid
  MOD_RES (524)..(532): Any amino acid
  MOD_RES (555)..(561): Any amino acid
XXXXXXXXXXXXXXXGLDRICLGHHAVANGTIVKTLTNEQEEVTNATETVENKXXXXXXXXXXXHKDLGNCHPVGMLIGTPACDLYLTGTWDTLIERGSSIAYCYPGTTVNEEALRXXXMESGGISKMSTXFAYGSSINSXXXXXXXXXXGKNSFYAELKWLVSKTKGQNFPRTTNTYRNTDTXEHLITWGIHHPSSTKEKNDLYGTQPLSISVGSSIYQNSFVPVVGARXXXXXXSGRIDFHWAXIQPGDNITFLHNGGLIAPDRVSXXXGRGLGIQSDXXXDNSCESKCFWKGGSIKTKLPFQNLXXXXXGQCPKYVNQKSLMLATGMRNVPETXXXXXXXXAKAGFIENGWXXXXXXXXXXXXXXXXXXXXAADYKSTQKTIDQVTGKLNRLIXXXXXXXXSIESEFSETEHQIGNVIXXXXXXXXXXXTYNAELLVAMEXXXXXDMADSTMLNLYERVXXXXXXXXXXXXKGCFEIYHACDNNCMESIRNNTYDHSQYREEALLNRLNINSVKLSSGYKXXXXXXXXXASCFVLLAAIMGLFFFCLKNGNXXXXXXX

SEQ ID NO: 418845 - protein, 561 aa, Influenza virus
  MOD_RES (1)..(15): Any amino acid
  MOD_RES (54)..(64): Any amino acid
  MOD_RES (117)..(119): Any amino acid
  MOD_RES (131)..(131): Any amino acid
  MOD_RES (143)..(150): Any amino acid
  MOD_RES (184)..(184): Any amino acid
  MOD_RES (223)..(247): Any amino acid
  MOD_RES (281)..(292): Any amino acid
  MOD_RES (310)..(312): Any amino acid
  MOD_RES (331)..(376): Any amino acid
  MOD_RES (394)..(406): Any amino acid
  MOD_RES (424)..(474): Any amino acid
  MOD_RES (500)..(508): Any amino acid
  MOD_RES (526)..(532): Any amino acid
  MOD_RES (560)..(561): Any amino acid
XXXXXXXXXXXXXXXSLDKICLGHHAIPNGTVVKTLTNEHEEVTNATETVESRXXXXXXXXXXXYKDLDNCHPIGMLIGAPACDLHLTGKWDTLIERENSIAYCYPGSTVNEEALRXXXMESGGIDKVSTXFTYESSINPAGXXXXXXXXGRNSFYAELKWLVSKNKGQSFPQTTNTYRNTDPXEHLIMWGIHHPSSTKEKNELYGTQSLSISIGSSTYQNNXXXXXXXXXXXXXXXXXXXXXXXXXQPGDNIIFSHNGGLIAPSRVSKLRGRDLGIQSEXXXXXXXXXXXXWRGGSINTRLPFQNLSPXXXGQCPKYVSQGSLLLATGMXXXXXXXXXXXXXXXXXXXXXXXXXXXXXXXXXXXXXXXXXXXXXXDYKSTQAAVDQITGKLNXXXXXXXXXXXXXESEFNEIEYQIGNVINWXXXXXXXXXXXXXXXXXXXXXXXXXXXXXXXXXXXXXXXXXXXXXXXXXXXKGCFEIYHTCDDPCMESIRDNTYDHXXXXXXXXXNRLNINPVTLSSGYKDIXXXXXXXASCFVLLAIVMGLVFFCLRNGNMRCTIXX

SEQ ID NO: 418846 - protein, 561 aa, Influenza virus
  MOD_RES (1)..(22): Any amino acid
  MOD_RES (51)..(64): Any amino acid
  MOD_RES (131)..(131): Any amino acid
  MOD_RES (143)..(157): Any amino acid
  MOD_RES (178)..(184): Any amino acid
  MOD_RES (227)..(254): Any amino acid
  MOD_RES (281)..(321): Any amino acid
  MOD_RES (331)..(379): Any amino acid
  MOD_RES (393)..(474): Any amino acid
  MOD_RES (499)..(508): Any amino acid
  MOD_RES (526)..(532): Any amino acid
  MOD_RES (542)..(561): Any amino acid
XXXXXXXXXXXXXXXXXXXXXXGHHAVTNGTIIKTLTNEKEKVTNATETVXXXXXXXXXXXXXXYRDLGNCHPIGMVVGAPSCDLHLTGIWDTLIERDNAIANCYPGATVNEGALRQKIMESGGIDKIGTXFTYGSSITSAGXXXXXXXXXXXXXXXELKWLVSKDKGRNFPQTTNTXXXXXXXEHLVMWGIHHPSSTQEKNALYGTQSLSISVESSTYQNSFVPVXXXXXXXXXXXXXXXXXXXXXXXXXXXXFSHNGGLVAPSRVSKLIGKGLGIQSGXXXXXXXXXXXXXXXXXXXXXXXXXXXXXXXXXXXXXXXXXRSLMLATGMXXXXXXXXXXXXXXXXXXXXXXXXXXXXXXXXXXXXXXXXXXXXXXXXXSTQATIDQITGKLXXXXXXXXXXXXXXXXXXXXXXXXXXXXXXXXXXXXXXXXXXXXXXXXXXXXXXXXXXXXXXXXXXXXXXXXXXXXXXXXXXKGCFEIYHNCDDNCMERIRNNTYDXXXXXXXXXXNRLNINPVRLSSGYKDIXXXXXXXASCFVLLADXXXXXXXXXXXXXXXXXXXX

SEQ ID NO: 418847 - protein, 561 aa, Influenza virus
  MOD_RES (1)..(23): Any amino acid
  MOD_RES (48)..(83): Any amino acid
  MOD_RES (99)..(101): Any amino acid
  MOD_RES (111)..(133): Any amino acid
  MOD_RES (143)..(185): Any amino acid
  MOD_RES (195)..(195): Any amino acid
  MOD_RES (210)..(213): Any amino acid
  MOD_RES (224)..(262): Any amino acid
  MOD_RES (273)..(476): Any amino acid
  MOD_RES (496)..(533): Any amino acid
  MOD_RES (543)..(561): Any amino acid
XXXXXXXXXXXXXXXXXXXXXXXHHAVANGTVVKTLTNEREEVTNATXXXXXXXXXXXXXXXXXXXXXXXXXXXXXXXXXXXXDLHLTGMWDTLIERDXXXAYCYPGATMXXXXXXXXXXXXXXXXXXXXXXXYGASINSAGXXXXXXXXXXXXXXXXXXXXXXXXXXXXXXXXXXXXXXXXXXXHIIMWGIHHXSSTQERNDLYGTQSXXXXVGSSTYQNSFXXXXXXXXXXXXXXXXXXXXXXXXXXXXXXXXXXXXXXXAPSRVSKLTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCFEIYHRCDDNCMESIRDNXXXXXXXXXXXXXXXXXXXXXXXXXXXXXXXXXXXXXXSCFVLLAVVXXXXXXXXXXXXXXXXXXX

SEQ ID NO: 418848 - protein, 561 aa, Influenza virus
  MOD_RES (1)..(27): Any amino acid
  MOD_RES (37)..(214): Any amino acid
  MOD_RES (229)..(483): Any amino acid
  MOD_RES (494)..(561): Any amino acid
XXXXXXXXXXXXXXXXXXXXXXXXXXXSNGTIIKTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSSTYHNSFVPVVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCNDNCMESIRXXXXXXXXXXXXXXXXXXXXXXXXXXXXXXXXXXXXXXXXXXXXXXXXXXXXXXXXXXXXXXXXXXXX

SEQ ID NO: 418849 - protein, 561 aa, Influenza virus
  MOD_RES (1)..(31): Any amino acid
  MOD_RES (41)..(561): Any amino acid
XXXXXXXXXXXXXXXXXXXXXXXXXXXXXXXIVKTLTNERXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418850 - protein, 471 aa, Influenza virus
  MOD_RES (19)..(19): Any amino acid
  MOD_RES (48)..(53): Any amino acid
  MOD_RES (75)..(82): Any amino acid
  MOD_RES (308)..(308): Any amino acid
  MOD_RES (332)..(333): Any amino acid
  MOD_RES (389)..(390): Any amino acid
  MOD_RES (416)..(416): Any amino acid
MNPNQKLFALSGVAIALSXLNLLIGISNVGLNVSLHLKEKGTKQEENXXXXXXTQNNTTLIENTYVNNTTVINKXXXXXXXXYLMLNKSLCKVEGWVVVAKDNAIRFGESEQIIVTREPYVSCDPLGCKMYALHQGTTIRNKHSNGTIHDRTAFRGLISTPLGSPPIVSNSDFLCVGWSSTSCHDGIGRMTICVQGNNDNATATVYYDRRLTTTIKTWAGNILRTQESECVCHNGTCVVIMTDGSASSQAYTKVLYFHKGLVIKEEALKGSARHIEECSCYGHNSKVTCVCRDNWQGANRPVIEIDMXAMEHTSQYLCTGVLTDTSRPSDKXXGDCNNPITGSPGAPGVKGFGFLDSGNTWLGRTISPRSRSGFEMLKIPNAGTDPNSXXTERQEIVDNNNWSGYSGSFIDYWDEXSECYNPCFYVELIRGRPEEAKYVWWTSNSLVALCGSPISVGSGSFPDGAQIQYFS

SEQ ID NO: 418851 - protein, 471 aa, Influenza virus
  MOD_RES (19)..(19): Any amino acid
  MOD_RES (48)..(53): Any amino acid
  MOD_RES (75)..(82): Any amino acid
  MOD_RES (114)..(117): Any amino acid
  MOD_RES (229)..(229): Any amino acid
  MOD_RES (308)..(308): Any amino acid
  MOD_RES (332)..(333): Any amino acid
  MOD_RES (346)..(347): Any amino acid
  MOD_RES (388)..(390): Any amino acid
  MOD_RES (416)..(416): Any amino acid
  MOD_RES (426)..(427): Any amino acid
MNPNQKLFTLSGVAIALNXLNLIIGISNVGLKVSLHLKEKGAKQEENXXXXXXTQNNTTVVENTYVNNTTIITKXXXXXXXXYLLLNKSLCNVEGWVVIAKDNAVRFGESEQIXXXXEPYVSCDPTGCKMYALHQGTTIRNRHSNGTIHDRTAFRGLMSTPLGSPPVVSNSDFICVGWSSTSCHDGVGRMTICVQGKNNNATATVYYNRRLTTTIKPWARNILRTQESXCVCHNGTCAVVMTDGSASSQAHTKVLYFHKGIVIKEEPLKGSAKHIEECSCYGHDSKVTCICRDNWQGANRPIIEIDMXTLEHTSRYVCTGILTDTSRPGDKXXGDCSNPITGSPGXXGVKGFGFLNGSNTWLGRTISPHSRSGFEMLKVPNAGTDPNXXXAERQEIVDNSNWSGYSGSFIDYWNDXNECYNPCFYXXLIRGRPEEVKYVWWTSNSLIALCGSPFPVGSGSFPDGAKIQYFS

SEQ ID NO: 418852 - protein, 471 aa, Influenza virus
  MOD_RES (19)..(19): Any amino acid
  MOD_RES (48)..(53): Any amino acid
  MOD_RES (75)..(82): Any amino acid
  MOD_RES (135)..(155): Any amino acid
  MOD_RES (226)..(231): Any amino acid
  MOD_RES (308)..(308): Any amino acid
  MOD_RES (332)..(336): Any amino acid
  MOD_RES (367)..(374): Any amino acid
  MOD_RES (389)..(390): Any amino acid
  MOD_RES (416)..(416): Any amino acid
  MOD_RES (427)..(445): Any amino acid
MNPKSKLFTLSGVAVALSXMNLLIGISNVGLNISLHLKEKGPKQEENXXXXXXNQNNTTVVENKYVNNTTIISKXXXXXXXXYLVLNKSLCKVEEWVVIAKDNAIRFGEGEQIIVTREPYVSCDPSGCKMYALHXXXXXXXXXXXXXXXXXXXXXGLISTPLGTPPTVSNSDFMCVGWSSTTCHDGIGRMTICIQGNNDNATATVYYERRLTTTIKTWARNILRTXXXXXXCHNGTCVVVMTDGSASGQAYTKVMYFHKGLIIKEEVLKGSARHIEECPCYGHNQKITCVCRDNWQGANRPVIKIDMXVMEHTSQYLCTGILTDTSRPSDRXXXXXSNPITGSPSAPGVKGFGFLDGDNTWLGRTIXXXXXXXXEMLKIPNAETDPNSXXTGRQEIVDNNNLSGYSGSFIDYWDDXSVCYNPCFYVXXXXXXXXXXXXXXXXXXXLVALCGSPVSVGSGSFPNGAQIQYFS

SEQ ID NO: 418853 - protein, 471 aa, Influenza virus
  MOD_RES (1)..(2): Any amino acid
  MOD_RES (19)..(19): Any amino acid
  MOD_RES (29)..(38): Any amino acid
  MOD_RES (48)..(53): Any amino acid
  MOD_RES (63)..(64): Any amino acid
  MOD_RES (75)..(82): Any amino acid
  MOD_RES (96)..(104): Any amino acid
  MOD_RES (138)..(156): Any amino acid
  MOD_RES (181)..(185): Any amino acid
  MOD_RES (230)..(236): Any amino acid
  MOD_RES (294)..(297): Any amino acid
  MOD_RES (308)..(308): Any amino acid
  MOD_RES (320)..(322): Any amino acid
  MOD_RES (332)..(336): Any amino acid
  MOD_RES (346)..(348): Any amino acid
  MOD_RES (373)..(375): Any amino acid
  MOD_RES (389)..(390): Any amino acid
  MOD_RES (410)..(416): Any amino acid
  MOD_RES (427)..(446): Any amino acid
  MOD_RES (470)..(471): Any amino acid
XXPNQNLFTLSGVAISLSXFNLLIGISNXXXXXXXXXXERGTKQEENXXXXXXTGTAKQNYLXXYVNNTTIINKXXXXXXXXYLMLSKSLCKVEGXXXXXXXXXIRFGESEQVIVTREPYVSCDPLGCRMYALHQGTXXXXXXXXXXXXXXXXXXXLMSTPLGTPPIVSNSEFLCVGWSSXXXXXGVGRMTICIQGNNNNATATVYYNGRLTTTIKTWAGKILRTQESEXXXXXXXCVVIMTDGPASSQAYTKIMYFHKGLVVKEEALQGSARHIEECSCYGHSQKVTCVCRDXXXXANRPVIEINMXAMDHTSQYLCTXXXTDTSKPSDKXXXXXDNPITGSPGXXXVKGFGFLDNDNTWLGGTISPRSRSXXXMLKIPNAGIDPNSXXTERQEIVGNNKWSGYSGSFXXXXXXXSACYNPCFYVXXXXXXXXXXXXXXXXXXXXVALCGSPVPVGSGSFPDGARIQYXX

SEQ ID NO: 418854 - protein, 471 aa, Influenza virus
  MOD_RES (1)..(6): Any amino acid
  MOD_RES (18)..(55): Any amino acid
  MOD_RES (75)..(83): Any amino acid
  MOD_RES (101)..(121): Any amino acid
  MOD_RES (134)..(158): Any amino acid
  MOD_RES (183)..(189): Any amino acid
  MOD_RES (200)..(202): Any amino acid
  MOD_RES (217)..(238): Any amino acid
  MOD_RES (255)..(255): Any amino acid
  MOD_RES (275)..(276): Any amino acid
  MOD_RES (289)..(297): Any amino acid
  MOD_RES (307)..(308): Any amino acid
  MOD_RES (320)..(359): Any amino acid
  MOD_RES (375)..(378): Any amino acid
  MOD_RES (389)..(390): Any amino acid
  MOD_RES (409)..(416): Any amino acid
  MOD_RES (427)..(446): Any amino acid
  MOD_RES (456)..(471): Any amino acid
XXXXXXLFALSGVAVALXXXXXXXXXXXXXXXXXXXXXXXXXXXXXXXXXXXXXXTNTTLIENTYVNKTTVINKXXXXXXXXXLLLNKSLCSVEGWVVIAXXXXXXXXXXXXXXXXXXXXXSCDPIGCKMYALXXXXXXXXXXXXXXXXXXXXXXXXXSTPLGSPPMVSNSDFICVGWSSTTXXXXXXXMIICIQGNNDXXXATVYYNRRPTTTIKXXXXXXXXXXXXXXXXXXXXXXVIMTDGSANSQAYTKVXYFHKGLLIKEETLKGSARHXXECSCYGHNQKVTXXXXXXXXXANRPAIEIDXXAMKHTSQYLCTXXXXXXXXXXXXXXXXXXXXXXXXXXXXXXXXXXXXXXXXTWLGRTFSPRSRSGFXXXXIPNAETDPSSXXIERQEIVDNRNWSGYSGSXXXXXXXXSKCYNPCFYVXXXXXXXXXXXXXXXXXXXXIALCGSPFSXXXXXXXXXXXXXXXX

SEQ ID NO: 418855 - protein, 471 aa, Influenza virus
  MOD_RES (1)..(7): Any amino acid
  MOD_RES (17)..(64): Any amino acid
  MOD_RES (74)..(86): Any amino acid
  MOD_RES (97)..(125): Any amino acid
  MOD_RES (135)..(163): Any amino acid
  MOD_RES (173)..(190): Any amino acid
  MOD_RES (203)..(240): Any amino acid
  MOD_RES (262)..(280): Any amino acid
  MOD_RES (295)..(298): Any amino acid
  MOD_RES (308)..(398): Any amino acid
  MOD_RES (409)..(471): Any amino acid
XXXXXXXFALSGVAITXXXXXXXXXXXXXXXXXXXXXXXXXXXXXXXXXXXXXXXXXXXXXXXXYVNNTTVISXXXXXXXXXXXXXNKRLCKVEGWXXXXXXXXXXXXXXXXXXXXXXXXXXXXXLGCKTYALHXXXXXXXXXXXXXXXXXXXXXXXXXXXXXSPPIVSNSEXXXXXXXXXXXXXXXXXXTICVQGNNNNATXXXXXXXXXXXXXXXXXXXXXXXXXXXXXXXXXXXXXXMTDGPANSQAYTKILYFHKGLXXXXXXXXXXXXXXXXXXXYGHSQKATCVCRDNXXXXNRPIIEINMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSDWSGYSGSXXXXXXXXXXXXXXXXXXXXXXXXXXXXXXXXXXXXXXXXXXXXXXXXXXXXXXXXXXXXXXX

SEQ ID NO: 418856 - protein, 471 aa, Influenza virus
  MOD_RES (1)..(7): Any amino acid
  MOD_RES (18)..(190): Any amino acid
  MOD_RES (208)..(245): Any amino acid
  MOD_RES (260)..(471): Any amino acid
XXXXXXXFALSGVAISLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTICVQGNNKNATATVYYXXXXXXXXXXXXXXXXXXXXXXXXXXXXXXXXXXXXXXASSQAHTKILYFHKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418857 - protein, 471 aa, Influenza virus
  MOD_RES (1)..(8): Any amino acid
  MOD_RES (19)..(471): Any amino acid
XXXXXXXXALSGMAIALSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418858 - protein, 565 aa, Influenza virus
  MOD_RES (1)..(14): Any amino acid
  MOD_RES (52)..(52): Any amino acid
  MOD_RES (113)..(157): Any amino acid
  MOD_RES (177)..(179): Any amino acid
  MOD_RES (190)..(205): Any amino acid
  MOD_RES (215)..(234): Any amino acid
  MOD_RES (250)..(255): Any amino acid
  MOD_RES (275)..(292): Any amino acid
  MOD_RES (304)..(307): Any amino acid
  MOD_RES (387)..(414): Any amino acid
  MOD_RES (424)..(431): Any amino acid
  MOD_RES (522)..(523): Any amino acid
  MOD_RES (549)..(551): Any amino acid
XXXXXXXXXXXXXXQADEICIGYLSNNSTEKVDTIIESNVTVTSSVELVENXHTGSFCSIDGKAPISLGDCSFAGWILGNPMCDDLIGKTSWSYIVEKPNPTNGICYPGTLEXXXXXXXXXXXXXXXXXXXXXXXXXXXXXXXXXXXXXXXXXXXXXSFFRNMVWLIHQSGTYPVIXXXFNNTKGRDVLXXXXXXXXXXXXXXXXLYKKDSSYVXXXXXXXXXXXXXXXXXXXXVNGQAGRMTFYWTIVXXXXXXTFESNGAFLAPRYAFELVSXXXXXXXXXXXXXXXXXXKCQSEIGGINTXXXXHNVHRNTIGDCPKYVNVKSLKLATGLRNVPAIATRGLFGAIAGFIEGGWPGLINGWYGFQHRNEEGTGIAADKESTQKAXXXXXXXXXXXXXXXXXXXXXXXXXXXXIEERINQLSXXXXXXXXDIWSYNAQLLVLLENEKTLDLHDSNVRNLHEKVRRMLKDNAKDEGNGCFTFYHKCDNECIEKVRNGTYDHKEFEEESKLNRQEIEGVKLDXXGNVYKILSIYSCIASSLVLAAIIMGXXXWACSNGSCRCTICI

SEQ ID NO: 418859 - protein, 565 aa, Influenza virus
  MOD_RES (1)..(14): Any amino acid
  MOD_RES (52)..(52): Any amino acid
  MOD_RES (113)..(157): Any amino acid
  MOD_RES (177)..(179): Any amino acid
  MOD_RES (189)..(205): Any amino acid
  MOD_RES (215)..(234): Any amino acid
  MOD_RES (250)..(255): Any amino acid
  MOD_RES (275)..(292): Any amino acid
  MOD_RES (304)..(307): Any amino acid
  MOD_RES (350)..(362): Any amino acid
  MOD_RES (387)..(414): Any amino acid
  MOD_RES (424)..(431): Any amino acid
  MOD_RES (522)..(523): Any amino acid
  MOD_RES (549)..(551): Any amino acid
  MOD_RES (562)..(565): Any amino acid
XXXXXXXXXXXXXXKADEICIGYMSNNSTEKVDTIIENNVTVTSSVELVETXHTGSFCSINGKQPISLGDCSFTGWILGNPRCDDLIGKNSWSYIVEKTNPANGICYPGSLDXXXXXXXXXXXXXXXXXXXXXXXXXXXXXXXXXXXXXXXXXXXXXSFFRHMVWLIHQSETYPVIXXXFNNTKERDVXXXXXXXXXXXXXXXXXLYKKDSSYIXXXXXXXXXXXXXXXXXXXXINGQAGRMTFYWKIVXXXXXXTFESNGAFIAPRYAFELVFXXXXXXXXXXXXXXXXXXKCQTEIGGINTXXXXHSVHRNTIGDCPKYMNVKSLKLASGLRNVPAITSRGLFGAIAXXXXXXXXXXXXXWYGFQHRNDEGTGIAADRESTQKAXXXXXXXXXXXXXXXXXXXXXXXXXXXXIEERINHLSXXXXXXXXNIWSYNAQLLVWLENEKTLDLHDSNVKNLHEKVRRILRDNAKDEGNGCFPFYHKCDNKCIERVRNGTYDHKEFKEESKINRQEIEGVRLDXXGNIYKILSIYSCVASSLVLAALIMGXXXWTCSNGSCRCXXXX

SEQ ID NO: 418860 - protein, 565 aa, Influenza virus
  MOD_RES (1)..(14): Any amino acid
  MOD_RES (52)..(52): Any amino acid
  MOD_RES (113)..(157): Any amino acid
  MOD_RES (177)..(179): Any amino acid
  MOD_RES (190)..(205): Any amino acid
  MOD_RES (215)..(238): Any amino acid
  MOD_RES (250)..(255): Any amino acid
  MOD_RES (275)..(292): Any amino acid
  MOD_RES (304)..(307): Any amino acid
  MOD_RES (350)..(364): Any amino acid
  MOD_RES (387)..(414): Any amino acid
  MOD_RES (424)..(431): Any amino acid
  MOD_RES (448)..(450): Any amino acid
  MOD_RES (522)..(523): Any amino acid
  MOD_RES (549)..(551): Any amino acid
  MOD_RES (564)..(565): Any amino acid
XXXXXXXXXXXXXXRADEICIGYLSNNSTDKVDTIIENNVTVTSSIELVENXYTGSFCSIDGKEPISLGDCSFAGWLLGNPMCDELIGKTSWSYIVERPNPVNGICYPGILEXXXXXXXXXXXXXXXXXXXXXXXXXXXXXXXXXXXXXXXXXXXXXAFFRNMVWLVHQSGTYPVVXXXFNNTKGRYVLXXXXXXXXXXXXXXXXLYKKDNSYVXXXXXXXXXXXXXXXXXXXXXXXXAGRMTFYWAIVXXXXXXTFESDGAFLAPRYSFELVSXXXXXXXXXXXXXXXXXXKCQTEVGGINTXXXXHNVHRSTIGDCPKYVNIKSLKLATGPRNVPAIAARGLFGAIAXXXXXXXXXXXXXXXGFQHRDEEGTGIAADKESTQTAXXXXXXXXXXXXXXXXXXXXXXXXXXXXIEEGINQLSXXXXXXXXDIWSYNAKLLVLLENEXXXDLHDSNVRSLHEKIRRMLKGNAKDEGNGCFTFYHRCDNECIERVRNGTYDHKEFEKESRLNRQEIEGARLDXXGDVYKILSICSCIASSLILAAIIMGXXXWACNNGSCRCTIXX

SEQ ID NO: 418861 - protein, 565 aa, Influenza virus
  MOD_RES (1)..(15): Any amino acid
  MOD_RES (49)..(52): Any amino acid
  MOD_RES (113)..(157): Any amino acid
  MOD_RES (177)..(179): Any amino acid
  MOD_RES (190)..(205): Any amino acid
  MOD_RES (215)..(238): Any amino acid
  MOD_RES (248)..(255): Any amino acid
  MOD_RES (275)..(292): Any amino acid
  MOD_RES (304)..(307): Any amino acid
  MOD_RES (357)..(370): Any amino acid
  MOD_RES (387)..(414): Any amino acid
  MOD_RES (424)..(431): Any amino acid
  MOD_RES (444)..(453): Any amino acid
  MOD_RES (522)..(524): Any amino acid
  MOD_RES (534)..(536): Any amino acid
  MOD_RES (549)..(551): Any amino acid
  MOD_RES (564)..(565): Any amino acid
XXXXXXXXXXXXXXXADEICIGHLSNNSTERVDTIIESNITVTSSVELXXXXHTGTFCSINGKAPISLGGCSFAGWILGNPRCDNLIGKTSWSYIVEKSNPINGICYPGTLGXXXXXXXXXXXXXXXXXXXXXXXXXXXXXXXXXXXXXXXXXXXXXSFFRNMIWLIYQSGTYPVIXXXFNNIKGRDVLXXXXXXXXXXXXXXXXLYKKDISYVXXXXXXXXXXXXXXXXXXXXXXXXAGRMTFYWIXXXXXXXXTFESNGALLAPRYAFEIVSXXXXXXXXXXXXXXXXXXRCQSEIGGISTXXXXHSVHRNTFGDCPKYVNVRSLKLATGLRNIPAIASRGLFGAKAGFIEGGWXXXXXXXXXXXXXXEEGTGVAADKESTQEAXXXXXXXXXXXXXXXXXXXXXXXXXXXXIGERINQLSXXXXXXXXDIWSYNARLLVLXXXXXXXXXXDSNVTNLHERVRRMLKNNAKDEGNGCFTFYHKCNNECIEKIRNGTYDHKDFEEESRLNRQEIGGVKLDXXXNVYKILSICXXXASSLVLAASIMGXXXWACGNGSCRCTIXX

SEQ ID NO: 418862 - protein, 565 aa, Influenza virus
  MOD_RES (1)..(17): Any amino acid
  MOD_RES (42)..(54): Any amino acid
  MOD_RES (72)..(76): Any amino acid
  MOD_RES (100)..(164): Any amino acid
  MOD_RES (175)..(179): Any amino acid
  MOD_RES (190)..(205): Any amino acid
  MOD_RES (215)..(239): Any amino acid
  MOD_RES (250)..(255): Any amino acid
  MOD_RES (275)..(292): Any amino acid
  MOD_RES (304)..(307): Any amino acid
  MOD_RES (341)..(377): Any amino acid
  MOD_RES (387)..(414): Any amino acid
  MOD_RES (424)..(432): Any amino acid
  MOD_RES (442)..(454): Any amino acid
  MOD_RES (464)..(467): Any amino acid
  MOD_RES (478)..(479): Any amino acid
  MOD_RES (497)..(500): Any amino acid
  MOD_RES (522)..(532): Any amino acid
  MOD_RES (548)..(551): Any amino acid
  MOD_RES (562)..(565): Any amino acid
XXXXXXXXXXXXXXXXXKICIGYLSNNSTERVNTIIENNVTXXXXXXXXXXXXXGSFCSINGRAPISLGDCXXXXXILGNPMCDELIEKTSWSYIVEKLXXXXXXXXXXXXXXXXXXXXXXXXXXXXXXXXXXXXXXXXXXXXXXXXXXXXXXXXXXXXXXXXXWLIDQSGTYPXXXXXFKNTKGRDVLXXXXXXXXXXXXXXXXLYKKDSSHVXXXXXXXXXXXXXXXXXXXXXXXXXGRMTFYWTMVXXXXXXTFESNGVFLAPRYALELVSXXXXXXXXXXXXXXXXXXKCQSEIGWINTXXXXHNVHRNAIGDCPKYVNVKSLKLVTGLRNVPAISXXXXXXXXXXXXXXXXXXXXXXXXXXXXXXXXXXXXXADKESTQKTXXXXXXXXXXXXXXXXXXXXXXXXXXXXIEKRINQLSXXXXXXXXXLWSYNAQLLXXXXXXXXXXXXXSNVRNLHERXXXXLQDNAKDEGNXXFTFYHKCDDECIEKVRNXXXXHKEFEEESRINRQEIEGVKLNXXXXXXXXXXXYSCIASSLILAALIMXXXXWVCSNGSCRCXXXX

SEQ ID NO: 418863 - protein, 565 aa, Influenza virus
  MOD_RES (1)..(24): Any amino acid
  MOD_RES (40)..(54): Any amino acid
  MOD_RES (66)..(76): Any amino acid
  MOD_RES (94)..(165): Any amino acid
  MOD_RES (177)..(180): Any amino acid
  MOD_RES (190)..(240): Any amino acid
  MOD_RES (250)..(258): Any amino acid
  MOD_RES (274)..(308): Any amino acid
  MOD_RES (340)..(459): Any amino acid
  MOD_RES (469)..(472): Any amino acid
  MOD_RES (482)..(482): Any amino acid
  MOD_RES (492)..(500): Any amino acid
  MOD_RES (518)..(537): Any amino acid
  MOD_RES (549)..(565): Any amino acid
XXXXXXXXXXXXXXXXXXXXXXXXSNNSTDKVNTIIENNXXXXXXXXXXXXXXXGSFCSLDGKAPXXXXXXXXXXXILGNPMCDYLIGKTSWSXXXXXXXXXXXXXXXXXXXXXXXXXXXXXXXXXXXXXXXXXXXXXXXXXXXXXXXXXXXXXXXXXXXXXXXXLTHQSGTYPIIXXXXNNTKGGDVLXXXXXXXXXXXXXXXXXXXXXXXXXXXXXXXXXXXXXXXXXXXXXXXXXXXRMTFYWTIIXXXXXXXXXSNGAFLAPGYAFEIVXXXXXXXXXXXXXXXXXXXXXXXXXXXXXXXXXXXNVHRNTIGNCPKYVNVKSLKLAIGPRNVPAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLHEKVRQMLXXXXRDEGNGCFTXYHKCDNGCIXXXXXXXXXHKEFEKESKLNRQEIGGXXXXXXXXXXXXXXXXXXXXSSLVLAALNMGXXXXXXXXXXXXXXXXX

SEQ ID NO: 418864 - protein, 565 aa, Influenza virus
  MOD_RES (1)..(32): Any amino acid
  MOD_RES (46)..(56): Any amino acid
  MOD_RES (70)..(76): Any amino acid
  MOD_RES (90)..(509): Any amino acid
  MOD_RES (519)..(565): Any amino acid
XXXXXXXXXXXXXXXXXXXXXXXXXXXXXXXXNTIIESNVTVTNSXXXXXXXXXXXFCSINGKEPISLGXXXXXXXILGNPMCDNLIGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINRQEVEGVXXXXXXXXXXXXXXXXXXXXXXXXXXXXXXXXXXXXXXXXXXXXXXX

SEQ ID NO: 418865 - protein, 565 aa, Influenza virus
  MOD_RES (1)..(37): Any amino acid
  MOD_RES (47)..(83): Any amino acid
  MOD_RES (93)..(565): Any amino acid
XXXXXXXXXXXXXXXXXXXXXXXXXXXXXXXXXXXXXSNVTVTSSIXXXXXXXXXXXXXXXXXXXXXXXXXXXXXXXXXXXXXDDLIEKTSWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418866 - protein, 564 aa, Influenza virus
  MOD_RES (10)..(14): Any amino acid
  MOD_RES (57)..(60): Any amino acid
  MOD_RES (189)..(189): Any amino acid
  MOD_RES (205)..(219): Any amino acid
  MOD_RES (287)..(291): Any amino acid
  MOD_RES (406)..(410): Any amino acid
  MOD_RES (489)..(492): Any amino acid
MEKFIILSTXXXXXFAYDKICIGYQTNNSTETVNTLIEQNVPVTQVEELVHGGIDPXXXXTELGSPLVLDDCSLEGLILGNPKCDLYLNGREWSYIVERPKEMEGICYPGSIENQEELRSLFSSIKKYERVKMFDFTKWNVTYTGTSKACNNTSNQGSFYRSMRWLTLKSGQFPVQTDEYKNTRDSDIXFTWAIHHPPTSDEQVXXXXXXXXXXXXXXXEINRSFKPNIGPRPLVRGQQGRMDYYWAVLKPGQTVKIQTNGNLIAPEYGHLITGKSHGRILKNNLPXXXXXTECQLNEGVMNTSKPFQNTSKHYIGKCPKYIPSGSLKLAIGLRNVPQAQDRGLFGAIAGFIEGGWPGLVAGWYGFQHQNAEGTGIAADRDSTQKAIDNMQNKLNNVIDKMNKQFXXXXXEFSEVESRINMINSKIDDQITDIWAYNAELLVLLENQKTLDEHDANVRNLHDRVRRVLRENAIDTGDGCFEILHKCDNXXXXTIRNGTYNHKEYEEESKIERQKINGVKLEENSTYKILSIYSSVASSLVLLLMIIGGFIFGCQNGNVRCTFCI

SEQ ID NO: 418867 - protein, 564 aa, Influenza virus
  MOD_RES (10)..(14): Any amino acid
  MOD_RES (57)..(60): Any amino acid
  MOD_RES (189)..(189): Any amino acid
  MOD_RES (205)..(219): Any amino acid
  MOD_RES (287)..(291): Any amino acid
  MOD_RES (406)..(410): Any amino acid
  MOD_RES (450)..(453): Any amino acid
  MOD_RES (489)..(492): Any amino acid
  MOD_RES (525)..(534): Any amino acid
MEKFIVLSIXXXXXLAYDKICIGYQTNNSTDTVNTLIEQNIPVTQVEELVHRGIDPXXXXTELGAPLVLDDCSLKGLILGNPKCDPYLNGREWSYIVERTKEMEGICYPGSVENQEELRSLFSSIKRYERVKMFDFSKWNVTYTGISKACNDTSNRGSFYRSMRWLTLKLGQFPVQTDEYKNTGDSDIXFMWAIHHPPTTDEQMXXXXXXXXXXXXXXXEINRSFRPNIGPRPLIRGQQGRMDYYWAILKPGQTVKIKTNGNLIAPEYGYLITGKSHGRVLKNNLPXXXXXTGCQLNEGVMNTSKPLQNTSKHYIGKCPRYIPSGSLKLAIGPRNVPQAQNRGLFGAIAGFIEGRWPGLVAGWYGFQHQNSEGTGIAADRGSTQKAIDNMQNRLNNVIDKMYKQFXXXXXEFSKVETRINMINSKIEDQITDIWAYNAELIVLLENQKTXXXXDANVRNLHERIRRILKENAIDAGDGCFEILHRCDDXXXXTIKNGTYNHQDYEEESKLERQKISGVKLEENSXXXXXXXXXXVASSLVLLFMIIGGFIFGCQNGNIRCTFCI

SEQ ID NO: 418868 - protein, 564 aa, Influenza virus
  MOD_RES (10)..(14): Any amino acid
  MOD_RES (24)..(28): Any amino acid
  MOD_RES (57)..(60): Any amino acid
  MOD_RES (122)..(128): Any amino acid
  MOD_RES (173)..(178): Any amino acid
  MOD_RES (189)..(189): Any amino acid
  MOD_RES (205)..(219): Any amino acid
  MOD_RES (243)..(251): Any amino acid
  MOD_RES (287)..(291): Any amino acid
  MOD_RES (357)..(365): Any amino acid
  MOD_RES (394)..(394): Any amino acid
  MOD_RES (406)..(410): Any amino acid
  MOD_RES (439)..(455): Any amino acid
  MOD_RES (489)..(492): Any amino acid
  MOD_RES (516)..(564): Any amino acid
MEKFITLSTXXXXXVAYDKICIGXXXXXSTETVNTLSEQNVPVTQVEELVHGQVNPXXXXTKLGSPLVLDDCSLEGIILGNPKCDLYLSGREWSYIVERPKEIEGICYPGSIKNQEELRSLXXXXXXXERVKMFDFIKWNVTYTGTSRACNNTSNQDSFYRSMKWLTLKSGQXXXXXXEYKNTRDSNIXFIWAIHHPPTSNEQVXXXXXXXXXXXXXXXEINRIFRPNIGPRPFVRGQQGRMXXXXXXXXXGQTVKIQTSGNLIAPEYGHLVTGKSHGRILKNDLPXXXXXTKCQLNEGVMNTSKPFQNICKPYIGKCPKYISSGSLKLAIGLRNVPQVQNRGLFGAKAGFIEGGWXXXXXXXXXFQHQNAEGIGIAADRDSTQRAIDNMQNKXNNVIDKMNNQFXXXXXEFSEVETRINTINSKIDDQVTDIWAYNAXXXXXXXXXXXXXXXXXNVRNLHDRIRRVLKENAIDNGDGCFEILHRCNDXXXXTIRTGTYNHREYEDESRIERQKIXXXXXXXXXXXXXXXXXXXXXXXXXXXXXXXXXXXXXXXXXXXXXXXXX

SEQ ID NO: 418869 - protein, 564 aa, Influenza virus
  MOD_RES (10)..(28): Any amino acid
  MOD_RES (57)..(69): Any amino acid
  MOD_RES (87)..(97): Any amino acid
  MOD_RES (128)..(134): Any amino acid
  MOD_RES (180)..(192): Any amino acid
  MOD_RES (205)..(219): Any amino acid
  MOD_RES (245)..(263): Any amino acid
  MOD_RES (281)..(291): Any amino acid
  MOD_RES (348)..(367): Any amino acid
  MOD_RES (394)..(396): Any amino acid
  MOD_RES (406)..(410): Any amino acid
  MOD_RES (436)..(455): Any amino acid
  MOD_RES (489)..(493): Any amino acid
  MOD_RES (503)..(503): Any amino acid
  MOD_RES (524)..(564): Any amino acid
MEKFIVLSVXXXXXXXXXXXXXXXXXXXSTETVNTLTEQNVPVTQVEELVHGGVDPXXXXXXXXXXXXXDDCSLEGLVLGNPKCDLXXXXXXXXXXXERPKEMEGVCYPGSIENQEELKSLFSSIKKXXXXXXXDFTKWNVTHTGTSKACNDISNQGSFYRNMRWLTLKSEQFPVQTDEXXXXXXXXXXXXXAIHHPPTSAEQVXXXXXXXXXXXXXXXEIDRSFRPNIGPRPLVMGQQGRMDYXXXXXXXXXXXXXXXXXXXIAPEYGHLTTGKSHGRIXXXXXXXXXXXTECQLNEGIMNTSKPFQNTSRHYIGKCPKYIPSNSLKLAIGLRNVPQIQNRGLFGAXXXXXXXXXXXXXXXXXXXXHQNAEGTGMAADRDSTQMAIDNMQNKXXXVIDKMNKQLXXXXXEFSEVEIRINMINSKINDQITDIWAXXXXXXXXXXXXXXXXXXXXNVRNLHDRTRRVLRENAVDTGDGCFEILHKCNDXXXXXIRNGTYNHRXYEEESRIERQKVNGVKLEENXXXXXXXXXXXXXXXXXXXXXXXXXXXXXXXXXXXXXXXXX

SEQ ID NO: 418870 - protein, 564 aa, Influenza virus
  MOD_RES (10)..(28): Any amino acid
  MOD_RES (40)..(46): Any amino acid
  MOD_RES (57)..(71): Any amino acid
  MOD_RES (89)..(104): Any amino acid
  MOD_RES (129)..(146): Any amino acid
  MOD_RES (172)..(195): Any amino acid
  MOD_RES (205)..(219): Any amino acid
  MOD_RES (246)..(292): Any amino acid
  MOD_RES (310)..(316): Any amino acid
  MOD_RES (350)..(368): Any amino acid
  MOD_RES (398)..(410): Any amino acid
  MOD_RES (440)..(456): Any amino acid
  MOD_RES (489)..(493): Any amino acid
  MOD_RES (523)..(564): Any amino acid
MKKFIILSTXXXXXXXXXXXXXXXXXXXSTDTVNTLTEQXXXXXXXEELVHGGINPXXXXXXXXXXXXXXXCSLEGLILSNPKCDLYLXXXXXXXXXXXXXXXXGVCYPGSIKNQEELRFLFSSIKKYXXXXXXXXXXXXXXXXXXSKACNSISNQGSFYRSIRWLTLKSGXXXXXXXXXXXXXXXXXXXXXXXXHPPTSDEQIXXXXXXXXXXXXXXXEINRNFKPNIGPRPFVREQQGRMDYYXXXXXXXXXXXXXXXXXXXXXXXXXXXXXXXXXXXXXXXXXXXXXXXECQLNEGVINTSKPFQNXXXXXXXKCPKYIPSRSLKLAIGLRNVPQVQDRGLFGAKAXXXXXXXXXXXXXXXXXXXQNSEGTGIVADRDSTQKAIDIMQNKLNNVXXXXXXXXXXXXXEFSEVGSRINMINSQIDDQIIDIWAYNAEXXXXXXXXXXXXXXXXXVRNLHDRVKRILKENALDTGDGCFEILHKCDDXXXXXIRNGTYNHQEYEEESKLERQRINGVKLEEXXXXXXXXXXXXXXXXXXXXXXXXXXXXXXXXXXXXXXXXXX

SEQ ID NO: 418871 - protein, 564 aa, Influenza virus
  MOD_RES (1)..(111): Any amino acid
  MOD_RES (122)..(228): Any amino acid
  MOD_RES (243)..(330): Any amino acid
  MOD_RES (341)..(414): Any amino acid
  MOD_RES (426)..(496): Any amino acid
  MOD_RES (506)..(506): Any amino acid
  MOD_RES (516)..(564): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIENQEELRFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGPRPLVREQQGRMXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGPRNVPQVQXXXXXXXXXXXXXXXXXXXXXXXXXXXXXXXXXXXXXXXXXXXXXXXXXXXXXXXXXXXXXXXXXXXXXXXXXXVESRINTINSKXXXXXXXXXXXXXXXXXXXXXXXXXXXXXXXXXXXXXXXXXXXXXXXXXXXXXXXXXXXXXXXXXXXXXXXGTYNHKDYEXESKIERQKVXXXXXXXXXXXXXXXXXXXXXXXXXXXXXXXXXXXXXXXXXXXXXXXXX

SEQ ID NO: 418872 - protein, 567 aa, Influenza virus
  MOD_RES (1)..(17): Any amino acid
  MOD_RES (86)..(89): Any amino acid
  MOD_RES (138)..(154): Any amino acid
  MOD_RES (169)..(172): Any amino acid
  MOD_RES (200)..(213): Any amino acid
  MOD_RES (225)..(231): Any amino acid
  MOD_RES (251)..(256): Any amino acid
  MOD_RES (289)..(290): Any amino acid
  MOD_RES (341)..(343): Any amino acid
  MOD_RES (468)..(472): Any amino acid
  MOD_RES (565)..(567): Any amino acid
XXXXXXXXXXXXXXXXXADRICVGYLSTNSSERVDTLLENGVPVTSSVDLVETNHTGTYCSLNGISPVHLGDCSFEGWIVGNPACXXXXGIREWSYLIEDPSAPHGLCYPGELDNNGELRHLFSGIRSFSRTELIAPXXXXXXXXXXXXXXXXXKGTNSFYRNLVWFVXXXXGGYPVIKKTYNNTTGRDVLVLWGIHHPXXXXXXXXXXXXXXPYTLVSTSSWSXXXXXXXGVRPGYNGQRSWMKIYWSLXXXXXXISFESNGGLLAPRYGYIIEEYGKGRIFQSRIRXXKCNTKCQTSVGGINTNKTFQNIERNALGDCPKYIKSGQLKLATGLRNVPAXXXRGLFGAIAGFIEGGWPGLINGWYGFQHQNEQGVGMAADKESTQKAIDQITTKINNIIDKMNGNYDSIRGEFNQVEKRINMLADRIDDAVTDVWSYNAKLLVLLENDKTLDMHDANVRNLHDQVRXXXXXNAIDEGNGCFELLHKCNDSCMETIRNGTYNHTEYAEESKLKRQEIEGIKLKSEDNVYKALSIYSCIASSVVLVGLILAFIMWACSSGNCRFNXXX

SEQ ID NO: 418873 - protein, 567 aa, Influenza virus
  MOD_RES (1)..(17): Any amino acid
  MOD_RES (86)..(89): Any amino acid
  MOD_RES (138)..(154): Any amino acid
  MOD_RES (169)..(179): Any amino acid
  MOD_RES (200)..(213): Any amino acid
  MOD_RES (225)..(231): Any amino acid
  MOD_RES (251)..(256): Any amino acid
  MOD_RES (289)..(290): Any amino acid
  MOD_RES (341)..(343): Any amino acid
  MOD_RES (358)..(367): Any amino acid
  MOD_RES (444)..(444): Any amino acid
  MOD_RES (468)..(472): Any amino acid
  MOD_RES (565)..(567): Any amino acid
XXXXXXXXXXXXXXXXXADRICIGYLSTNSSDKVDTLLENDVPVTSSIDLIETNHTGTYCSLDGVSPVHLGDCRFEGWIVGNPSCXXXXGVREWSYLIEDPGAPHGLCYPGELNNNGELRHLFSGIKSFSRTELIPPXXXXXXXXXXXXXXXXXTGTSSFYRNLIWFVXXXXXXXXXXXGTYNNTTGRDVLVMWGIHHPXXXXXXXXXXXXXXPYTLVSTKSWSXXXXXXXGIRPGYNGQKSWMKIYWYLXXXXXXITFESNGGLLAPKYGYIIEEYGRGRIFQSRIIXXRCNTKCQTSVGGIDTNKTFQNIDKNALGDCPKYIKSDQLKLATGLKNVPAXXXRAVDGTIAGFIEGGXXXXXXXXXXFQHQNEQGTGIAADKESTQKAIDRITTKINNIIEKMNGNYDSIRGEFSQVEQRINMLADRIDDAVTDIWSYNAKLLXLLENDKTLNMHDANVRNLHEQVRXXXXXNAVDEGNGCFELLHKCNNSCMETIRNGTYDHTEYEEESKLKRQEINGIKLKSDDSVYKALSIYSCIASSIVLVGLILSFIMWACSNGSCRFNXXX

SEQ ID NO: 418874 - protein, 567 aa, Influenza virus
  MOD_RES (1)..(17): Any amino acid
  MOD_RES (65)..(65): Any amino acid
  MOD_RES (83)..(89): Any amino acid
  MOD_RES (111)..(124): Any amino acid
  MOD_RES (138)..(154): Any amino acid
  MOD_RES (169)..(179): Any amino acid
  MOD_RES (200)..(213): Any amino acid
  MOD_RES (225)..(231): Any amino acid
  MOD_RES (251)..(256): Any amino acid
  MOD_RES (274)..(277): Any amino acid
  MOD_RES (289)..(290): Any amino acid
  MOD_RES (328)..(329): Any amino acid
  MOD_RES (341)..(343): Any amino acid
  MOD_RES (355)..(367): Any amino acid
  MOD_RES (385)..(410): Any amino acid
  MOD_RES (428)..(432): Any amino acid
  MOD_RES (468)..(472): Any amino acid
  MOD_RES (534)..(535): Any amino acid
  MOD_RES (565)..(567): Any amino acid
XXXXXXXXXXXXXXXXXADKICVGYLSTNSTEKVDTLLENNVPVTSSVDLIETTHTGTYCSLGGXSPVHLGDCNFEGWIVGNXXXXXXXGTREWSYLIEDPAAPHGLCYPXXXXXXXXXXXXXXGIKSFSRTQLIAPXXXXXXXXXXXXXXXXXTGTNSFYRNLAWFVXXXXXXXXXXXRTYNNTTGRDVLVIWGIHHPXXXXXXXXXXXXXXPYTLVSTGSWSXXXXXXXGTRPGYNGQKSWTKIYWYLXXXXXXITFESNGGFLAPRYGYIXXXXGKGRIFQSPIRXXRCNTRCQTSVGGINTNRTFQNIDKNALGECPKYIKSDXXKLATGLRNIPAXXXRGFFGAIAGFIXXXXXXXXXXXXXFQHQNEQGMGMAADKESXXXXXXXXXXXXXXXXXXXXXXXXXXRGEFNQVENRINMLADRXXXXXTDIWSYNARLLVLLENDKTLDLHDANVRNLHDQIRXXXXXNAINEGNGCFELLHKCNNTCMETIRNGTYNHAKYEEESKLKRQEIDGIKLKSDDNVYKALSXXSCIASSIVMVGLILAFIMWTCNSGNCRFNXXX

SEQ ID NO: 418875 - protein, 567 aa, Influenza virus
  MOD_RES (1)..(24): Any amino acid
  MOD_RES (65)..(71): Any amino acid
  MOD_RES (86)..(93): Any amino acid
  MOD_RES (111)..(154): Any amino acid
  MOD_RES (169)..(179): Any amino acid
  MOD_RES (200)..(213): Any amino acid
  MOD_RES (225)..(231): Any amino acid
  MOD_RES (251)..(256): Any amino acid
  MOD_RES (266)..(277): Any amino acid
  MOD_RES (289)..(305): Any amino acid
  MOD_RES (322)..(331): Any amino acid
  MOD_RES (341)..(343): Any amino acid
  MOD_RES (356)..(369): Any amino acid
  MOD_RES (385)..(410): Any amino acid
  MOD_RES (428)..(451): Any amino acid
  MOD_RES (468)..(485): Any amino acid
  MOD_RES (505)..(512): Any amino acid
  MOD_RES (536)..(538): Any amino acid
  MOD_RES (557)..(567): Any amino acid
XXXXXXXXXXXXXXXXXXXXXXXXYLSTNSSEKVDTLLESDVPVTSSIDLVETSHTGTYCSLSGXXXXXXXDCSFEGWIGGNPACXXXXXXXXWSYLIEDPTAPHGLCYPXXXXXXXXXXXXXXXXXXXXXXXXXXXXXXXXXXXXXXXXXXXXRGTNSFYRNLVWLVXXXXXXXXXXXGAYNNTTGRDVLVMWGLHHPXXXXXXXXXXXXXXPYTLVTTSSWSXXXXXXXGVRPRYNGQRSWMKIYWVLXXXXXXVSFESNGGLXXXXXXXXXXXXGKGRIFQSHIRXXXXXXXXXXXXXXXXXNRTFQNIDRNALGDCPXXXXXXXXXXATGLRNVPTXXXRGLLGAIAGFIEXXXXXXXXXXXXXXHQNEQGVGIAADKESXXXXXXXXXXXXXXXXXXXXXXXXXXRGEFSQVERRINMLADRXXXXXXXXXXXXXXXXXXXXXXXXLDMHDANVKNLHEQVRXXXXXXXXXXXXXXXXXXHKCNDSCMDTIRNGTYNHIXXXXXXXXKRQEIEGIRLKSEDGVYKALSIYXXXASSVVLVGPILSFIMWAGXXXXXXXXXXX

SEQ ID NO: 418876 - protein, 567 aa, Influenza virus
  MOD_RES (1)..(26): Any amino acid
  MOD_RES (54)..(97): Any amino acid
  MOD_RES (115)..(154): Any amino acid
  MOD_RES (169)..(179): Any amino acid
  MOD_RES (190)..(213): Any amino acid
  MOD_RES (225)..(232): Any amino acid
  MOD_RES (251)..(310): Any amino acid
  MOD_RES (328)..(331): Any amino acid
  MOD_RES (341)..(372): Any amino acid
  MOD_RES (390)..(410): Any amino acid
  MOD_RES (424)..(457): Any amino acid
  MOD_RES (468)..(495): Any amino acid
  MOD_RES (505)..(514): Any amino acid
  MOD_RES (539)..(542): Any amino acid
  MOD_RES (564)..(567): Any amino acid
XXXXXXXXXXXXXXXXXXXXXXXXXXSTNSSEKVNTLLENDVPVTSTIDLIETXXXXXXXXXXXXXXXXXXXXXXXXXXXXXXXXXXXXXXXXXXXXIEDPSAPHRLCYPGELDXXXXXXXXXXXXXXXXXXXXXXXXXXXXXXXXXXXXXXXXKGFNSFYRNLVWFIXXXXXXXXXXXGVYNNTTGRDXXXXXXXXXXXXXXXXXXXXXXXXPYTLVSTRSWSXXXXXXXXVRPGYNGQKSWMKIYWDLXXXXXXXXXXXXXXXXXXXXXXXXXXXXXXXXXXXXXXXXXXXXXXXXXXXXXXXXXXXXNIERNALGNCPKYIKSGXXXXATGLRNVPSXXXXXXXXXXXXXXXXXXXXXXXXXXXXXXXXEQGTGIAAEKESTQKAIXXXXXXXXXXXXXXXXXXXXXRGEFNQVEQRINMXXXXXXXXXXXXXXXXXXXXXXXXXXXXXXXXXXNVRNLHEQIKXXXXXXXXXXXXXXXXXXXXXXXXXXXXIRNGTYNHSXXXXXXXXXXQEIEGIKLESEDNVYRALSIYSCIXXXXVLVGLILTFIMWACNSGNCRFXXXX

SEQ ID NO: 418877 - protein, 567 aa, Influenza virus
  MOD_RES (1)..(38): Any amino acid
  MOD_RES (48)..(158): Any amino acid
  MOD_RES (168)..(551): Any amino acid
  MOD_RES (565)..(567): Any amino acid
XXXXXXXXXXXXXXXXXXXXXXXXXXXXXXXXXXXXXXENGVPVTSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFYRNLVWFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIMWACSNGNCRFNXXX

SEQ ID NO: 418878 - protein, 567 aa, Influenza virus
  MOD_RES (1)..(555): Any amino acid
  MOD_RES (565)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCSNGNCRFHXXX

SEQ ID NO: 418879 - protein, 568 aa, Influenza virus; identical to SEQ ID NO: 418424

SEQ ID NO: 418880 - protein, 568 aa, Influenza virus
  MOD_RES (1)..(9): Any amino acid
  MOD_RES (21)..(164): Any amino acid
  MOD_RES (182)..(568): Any amino acid
XXXXXXXXXGSEHTAYSQITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSRLNWLTKETNGNYGPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418881 - protein, 570 aa, Influenza virus; identical to SEQ ID NO: 418426

SEQ ID NO: 418882 - protein, 570 aa, Influenza virus
  MOD_RES (1)..(8): Any amino acid
  MOD_RES (66)..(77): Any amino acid
  MOD_RES (98)..(100): Any amino acid
  MOD_RES (118)..(121): Any amino acid
  MOD_RES (148)..(153): Any amino acid
  MOD_RES (189)..(197): Any amino acid
  MOD_RES (237)..(268): Any amino acid
  MOD_RES (286)..(310): Any amino acid
  MOD_RES (332)..(338): Any amino acid
  MOD_RES (356)..(401): Any amino acid
  MOD_RES (419)..(520): Any amino acid
  MOD_RES (538)..(570): Any amino acid
XXXXXXXXLVLGLSMVRSDKICLGHHAVPNGTKVNTLTEKGVEVVNATETVEITGINKVCTKGKKXXXXXXXXXXXXIIGPPQCDSHLKFKADLIIEXXXSSDICYPGKFTNEEALRXXXXESGGIDKEPMGFRYSGIKTDGATSACXXXXXXFYSEMKWLLSSKANQVFPQLNQTYRNNRKEPALIVXXXXXXXXXDEQNKLYGAGNKLITVGSSKYRQSFSPSPGDRPKVNGQAXXXXXXXXXXXXXXXXXXXXXXXXXXXXXXXXLRSNAPSGVEYNGKSLGXXXXXXXXXXXXXXXXXXXXXXXXXLPFQNIDSWAVGRCPRYVKQSXXXXXXXMKNVPEKIHTRGLFGAIXXXXXXXXXXXXXXXXXXXXXXXXXXXXXXXXXXXXXXXXXXXXXXNRLIEKTNTQFELIDNEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMINPVKLSGGYKDVILWXXXXXXXXXXXXXXXXXXXXXXXXXXXXXXXXX

SEQ ID NO: 418883 - protein, 570 aa, Influenza virus
  MOD_RES (1)..(156): Any amino acid
  MOD_RES (174)..(339): Any amino acid
  MOD_RES (364)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEMKWLSSSGNNQVFPQLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKNVPEKIRVKRRPVAKAGFIENGWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418884 - protein, 570 aa, Influenza virus
  MOD_RES (1)..(157): Any amino acid
  MOD_RES (175)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMKWLLSSKDNQVFPQLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418885 - protein, 569 aa, Influenza virus
  MOD_RES (11)..(15): Any amino acid
  MOD_RES (172)..(173): Any amino acid
  MOD_RES (343)..(343): Any amino acid
  MOD_RES (471)..(471): Any amino acid
QPNDGQVLYFXXXXXGRYSKADKICIGYLSNNSSDTVDTLTENGVPVTSSIDLVETNHTGTYCSLNGVSPIHLGDCSFEGWIVGNPSCATNINIREWSYLIEDPNAPNKLCFPGELDNNGELRHLFSGVNSFSRTELISPSKWGNVLDGVTASCLDRGASSFYRNLVWLVKXXIGEYPVVKGEYNNTTGRDVLVLWGIHHPDTEATATNLYVNKNPYTLVSTKEWSKRYELEIGTRIGDGQRSWMKLYWHLMRPGERITFESNGGLLAPRYGYIIEKYGTGRIFQSGVRMAKCNTKCQTSMGGINTNKTFQNIERNALGDCPKYIKSGQLKLATGLRNVPSIXGERGLFGAIAGFIEGGWPGLINGWYGFQHQNEQGTGIAADKASTQKAIDEITTKINNIIEKMNGNYDSIRGEFNQVEKRINMLADRVDDAVTDIWSYNAKLLVLIENDRTLDLHDANVRNLHDQVKRXLKNNAIDEGDGCFNLLHKCNDSCMETIRNGTYNHEDYKEESQLKRQEIEGIKLKTEDNVYKVLSIYSCIASSIVLVGLILAFIMWACSSGNCRFNVCI

SEQ ID NO: 418886 - protein, 569 aa, Influenza virus
  MOD_RES (1)..(15): Any amino acid
  MOD_RES (77)..(81): Any amino acid
  MOD_RES (99)..(99): Any amino acid
  MOD_RES (125)..(130): Any amino acid
  MOD_RES (172)..(173): Any amino acid
  MOD_RES (192)..(194): Any amino acid
  MOD_RES (218)..(218): Any amino acid
  MOD_RES (327)..(332): Any amino acid
  MOD_RES (350)..(376): Any amino acid
  MOD_RES (401)..(417): Any amino acid
  MOD_RES (471)..(471): Any amino acid
XXXXXXXXXXXXXXXVKYSRADKICIGYLSNNATDTVDTLTETGVPVTSSVDLVETNHTGTYCSLNGISPIHLGDCXXXXXIVGNPSCASNINIREWSXLIEDPNAPHKLCFPGEVDNNGELRHXXXXXXSFSRTELINPSKWGDILEGTTASCQNRGANSFYRNLIWLVNXXNGKYPVIKGDYNNTTGRDXXXLWGIHHPDSETTATKLYVNKNPYXLVSTKEWSRRYELEIGTRIGEGQRSWMKIYWHLMHPGERIMFESNGGLIAPRYGYIIEKYGSGRIFQSGVRLAKCNTKCQTSVGGIDTNKTFQNIDRNAIGDCPKYIKXXXXXXATGLRNVPIPIGERGLFXXXXXXXXXXXXXXXXXXXXXXXXXXXGTGIAADKTSTQKAINEITTKINNXXXXXXXXXXXXXXXXXQVEKRINMIADRVDDAVTDVWSYNAKLLVLLENGRTLDLHDANVKNLHEQVKRXLKDNAIDEGDGCFSILHKCNDSCMEAIRNGTYNHEDYREESQLKRQEIEGIKLKSEDNVYKVLAIYSCIASSTVLVGLILAFILWACSSGNCRFSVCI

SEQ ID NO: 418887 - protein, 569 aa, Influenza virus
  MOD_RES (1)..(15): Any amino acid
  MOD_RES (52)..(62): Any amino acid
  MOD_RES (80)..(101): Any amino acid
  MOD_RES (121)..(130): Any amino acid
  MOD_RES (172)..(179): Any amino acid
  MOD_RES (189)..(196): Any amino acid
  MOD_RES (217)..(226): Any amino acid
  MOD_RES (244)..(244): Any amino acid
  MOD_RES (268)..(278): Any amino acid
  MOD_RES (305)..(306): Any amino acid
  MOD_RES (324)..(333): Any amino acid
  MOD_RES (343)..(343): Any amino acid
  MOD_RES (353)..(376): Any amino acid
  MOD_RES (394)..(420): Any amino acid
  MOD_RES (438)..(442): Any amino acid
  MOD_RES (457)..(457): Any amino acid
  MOD_RES (471)..(471): Any amino acid
  MOD_RES (494)..(507): Any amino acid
XXXXXXXXXXXXXXXGRYSIADKICIGYLSNNSTDKVDTLTENGVPVTSSVXXXXXXXXXXXCSLNGVSPVHLGDCSFEXXXXXXXXXXXXXXXXXXXXXXEDPNAPNKFCYPGELDNNGXXXXXXXXXXSFSRTELIPPSKWGDVLDGVTASCRDNGADSFYRNLIWLVKXXXXXXXXVKGDYNNTTXXXXXXXXGIHHPDTETTANKLYVNKNPXXXXXXXXXXKRYELEIGARIGEGQRSXMKLYWHLMHPGERTTFESNGGLIXXXXXXXXXXXGTGRIFQSRIRMGKCNTKCQTSLGGIXXNKTFQNIEKNALGDCPKXXXXXXXXXXTGLRNVPSVXVERGLFGAIXXXXXXXXXXXXXXXXXXXXXXXXGTGIAADKVSTQKAINEXXXXXXXXXXXXXXXXXXXXXXXXXXXKRINMLADWVDDAVTDIXXXXXKLLVLLENDRTLDLXDANVRNLHEQIKRXLKSNAIDEGDGCFSLLHKCNDSXXXXXXXXXXXXXXYREESQLKKQEIEGIKLKTEDNIYKILSIYSCIASSVVLVGLILAFIMWACSNGSCRFNVCI

SEQ ID NO: 418888 - protein, 569 aa, Influenza virus
  MOD_RES (1)..(15): Any amino acid
  MOD_RES (26)..(27): Any amino acid
  MOD_RES (42)..(62): Any amino acid
  MOD_RES (77)..(103): Any amino acid
  MOD_RES (119)..(132): Any amino acid
  MOD_RES (172)..(179): Any amino acid
  MOD_RES (190)..(196): Any amino acid
  MOD_RES (222)..(238): Any amino acid
  MOD_RES (272)..(279): Any amino acid
  MOD_RES (313)..(343): Any amino acid
  MOD_RES (353)..(382): Any amino acid
  MOD_RES (400)..(446): Any amino acid
  MOD_RES (471)..(471): Any amino acid
  MOD_RES (496)..(524): Any amino acid
  MOD_RES (569)..(569): Any amino acid
XXXXXXXXXXXXXXXGRYSRADKICXXYLSNNSTDTVDTLTXXXXXXXXXXXXXXXXXXXXXCSLNGISPVHLGDCXXXXXXXXXXXXXXXXXXXXXXXXXXXPNAPNKLCYPGELDNXXXXXXXXXXXXXXSRTELINPNKWGNVLDGVTASCLDKGAKSFYRNLVWIVKXXXXXXXXVRGDYNNTTGXXXXXXXGIHHPDTEEVAINLYASKNPYTLVSXXXXXXXXXXXXXXXXXDGQRSWMKIYWHLMSPGERITFESSGGLLAPRYXXXXXXXXTGRIFQSGIRMARCNTKCQTSMGGVNTNKTFQNXXXXXXXXXXXXXXXXXXXXXXXXXXXXXXXNERGLFGAIXXXXXXXXXXXXXXXXXXXXXXXXXXXXXXDKVSTQKALNEITTKINXXXXXXXXXXXXXXXXXXXXXXXXXXXXXXXXXXXXXXXXXXXXXXXLLENGRTLGLHDANVRNLHDQIKRXLQNNAIDEGDGCFNFFHKCNDSCMXXXXXXXXXXXXXXXXXXXXXXXXXXXXXKTEDNVYKILSIYSCIASSIVMVGLILAFIMWACSNGNCRFNVCX

SEQ ID NO: 418889 - protein, 569 aa, Influenza virus
  MOD_RES (1)..(15): Any amino acid
  MOD_RES (25)..(28): Any amino acid
  MOD_RES (46)..(103): Any amino acid
  MOD_RES (121)..(132): Any amino acid
  MOD_RES (172)..(197): Any amino acid
  MOD_RES (218)..(244): Any amino acid
  MOD_RES (256)..(258): Any amino acid
  MOD_RES (268)..(281): Any amino acid
  MOD_RES (305)..(343): Any amino acid
  MOD_RES (353)..(383): Any amino acid
  MOD_RES (394)..(457): Any amino acid
  MOD_RES (471)..(537): Any amino acid
  MOD_RES (553)..(569): Any amino acid
XXXXXXXXXXXXXXXSRYSKADKIXXXXLSNNSTDKIDTLTETGVXXXXXXXXXXXXXXXXXXXXXXXXXXXXXXXXXXXXXXXXXXXXXXXXXXXXXXXXXXPNAPHKLCYPGEVDNNGXXXXXXXXXXXXSRTELISPNKWGDILDGVTASCLDRGTSSFYRNLIWLVQXXXXXXXXXXXXXXXXXXXXXXXXXXIHHPDTEAVATRLYVNKNPYXXXXXXXXXXXXXXXXXXXXXXXXXXXMKLYWHLMSPGXXXMFESNGGLLXXXXXXXXXXXXXXRIFQSGVRVARCNTKCQTSLGGVXXXXXXXXXXXXXXXXXXXXXXXXXXXXXXXXXXXXXXXSERGLFGAIXXXXXXXXXXXXXXXXXXXXXXXXXXXXXXXKASTQKAINEXXXXXXXXXXXXXXXXXXXXXXXXXXXXXXXXXXXXXXXXXXXXXXXXXXXXXXXXXXXXXXXXDANVKNLHDQIKRXXXXXXXXXXXXXXXXXXXXXXXXXXXXXXXXXXXXXXXXXXXXXXXXXXXXXXXXXXXXXXXXXXXSCIASSTVMVGLILAXXXXXXXXXXXXXXXXX

SEQ ID NO: 418890 - protein, 569 aa, Influenza virus
  MOD_RES (1)..(34): Any amino acid
  MOD_RES (45)..(249): Any amino acid
  MOD_RES (259)..(343): Any amino acid
  MOD_RES (353)..(569): Any amino acid
XXXXXXXXXXXXXXXXXXXXXXXXXXXXXXXXXXDKVDTLTETGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHLMRPGERTXXXXXXXXXXXXXXXXXXXXXXXXXXXXXXXXXXXXXXXXXXXXXXXXXXXXXXXXXXXXXXXXXXXXXXXXXXXXXXXXXXXXXDERGLFGAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418891 - protein, 627 aa, Influenza virus
  MOD_RES (17)..(26): Any amino acid
  MOD_RES (46)..(304): Any amino acid
  MOD_RES (323)..(342): Any amino acid
  MOD_RES (354)..(385): Any amino acid
  MOD_RES (415)..(479): Any amino acid
  MOD_RES (496)..(519): Any amino acid
  MOD_RES (529)..(573): Any amino acid
  MOD_RES (583)..(603): Any amino acid
KQGKTKATKMKAILVVXXXXXXXXXXTAYSQITNGTTGNPIICLGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSNAPSGIEYNGKSLGIQSXXXXXXXXXXXXXXXXXXXXTSLTSLPFQNIXXXXXXXXXXXXXXXXXXXXXXXXXXXXXXXXRGLFGAIAGFIEGGWTGMVDGWYGYHHQNXXXXXXXXXXXXXXXXXXXXXXXXXXXXXXXXXXXXXXXXXXXXXXXXXXXXXXXXXXXXXXXXXYNAELLVLLENERTLDXXXXXXXXXXXXXXXXXXXXXXXXGNGCFEFYHXXXXXXXXXXXXXXXXXXXXXXXXXXXXXXXXXXXXXXXXXXXXXLAIYSTVASXXXXXXXXXXXXXXXXXXXXXLCSVEYASKTRISEDFRDMRKNTL

SEQ ID NO: 418892 - protein, 627 aa, Influenza virus
  MOD_RES (1)..(2): Any amino acid
  MOD_RES (17)..(304): Any amino acid
  MOD_RES (320)..(389): Any amino acid
  MOD_RES (415)..(479): Any amino acid
  MOD_RES (496)..(519): Any amino acid
  MOD_RES (529)..(573): Any amino acid
  MOD_RES (583)..(611): Any amino acid
  MOD_RES (622)..(627): Any amino acid
XXGKTKATKMEAILVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSNAPSGVEYNGKSLGXXXXXXXXXXXXXXXXXXXXXXXXXXXXXXXXXXXXXXXXXXXXXXXXXXXXXXXXXXXXXXXXXXXXXXGAIAGFIENGWEGMVDGWYGFRHQNXXXXXXXXXXXXXXXXXXXXXXXXXXXXXXXXXXXXXXXXXXXXXXXXXXXXXXXXXXXXXXXXXYQAELLVAMENQHTIDXXXXXXXXXXXXXXXXXXXXXXXXGKGCFEIYHXXXXXXXXXXXXXXXXXXXXXXXXXXXXXXXXXXXXXXXXXXXXXLSIYSCIASXXXXXXXXXXXXXXXXXXXXXXXXXXXXXQCRICIRADGXXXXXX

SEQ ID NO: 418893 - protein, 627 aa, Influenza virus
  MOD_RES (1)..(5): Any amino acid
  MOD_RES (17)..(392): Any amino acid
  MOD_RES (415)..(479): Any amino acid
  MOD_RES (496)..(519): Any amino acid
  MOD_RES (529)..(573): Any amino acid
  MOD_RES (583)..(611): Any amino acid
  MOD_RES (626)..(627): Any amino acid
XXXXXKATKMKAIIVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGFIEGGWPGLINGWYGFQHRNXXXXXXXXXXXXXXXXXXXXXXXXXXXXXXXXXXXXXXXXXXXXXXXXXXXXXXXXXXXXXXXXXYNAELLILLENEKTLDXXXXXXXXXXXXXXXXXXXXXXXXGNGCFTFYHXXXXXXXXXXXXXXXXXXXXXXXXXXXXXXXXXXXXXXXXXXXXXILWFSFGASXXXXXXXXXXXXXXXXXXXXXXXXXXXXXQCRICIDFRDMRKNXX

SEQ ID NO: 418894 - protein, 627 aa, Influenza virus
  MOD_RES (1)..(6): Any amino acid
  MOD_RES (17)..(395): Any amino acid
  MOD_RES (413)..(479): Any amino acid
  MOD_RES (496)..(519): Any amino acid
  MOD_RES (529)..(573): Any amino acid
  MOD_RES (583)..(611): Any amino acid
  MOD_RES (625)..(627): Any amino acid
XXXXXXQPNDGQVLYFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIEGGWTGMIDGWYGYHHXXXXXXXXXXXXXXXXXXXXXXXXXXXXXXXXXXXXXXXXXXXXXXXXXXXXXXXXXXXXXXXXXXXYNAQLLVLLENQKTLDXXXXXXXXXXXXXXXXXXXXXXXXGDGCFEILHXXXXXXXXXXXXXXXXXXXXXXXXXXXXXXXXXXXXXXXXXXXXXLAIYSTAASXXXXXXXXXXXXXXXXXXXXXXXXXXXXXRCTISLVKTTLFLXXX

SEQ ID NO: 418895 - protein, 627 aa, Influenza virus
  MOD_RES (1)..(395): Any amino acid
  MOD_RES (415)..(479): Any amino acid
  MOD_RES (496)..(519): Any amino acid
  MOD_RES (529)..(573): Any amino acid
  MOD_RES (583)..(611): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIEGGWPGLVAGWYGFQHQNXXXXXXXXXXXXXXXXXXXXXXXXXXXXXXXXXXXXXXXXXXXXXXXXXXXXXXXXXXXXXXXXXYNAKLLVLLENDKTLDXXXXXXXXXXXXXXXXXXXXXXXXGNGCFELLHXXXXXXXXXXXXXXXXXXXXXXXXXXXXXXXXXXXXXXXXXXXXXLSIYSSVASXXXXXXXXXXXXXXXXXXXXXXXXXXXXXQCRICILDQNFRNIRK

SEQ ID NO: 418896 - protein, 627 aa, Influenza virus
  MOD_RES (1)..(404): Any amino acid
  MOD_RES (414)..(627): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGWYGFQHQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418897 - protein, 599 aa, Influenza virus
  MOD_RES (18)..(26): Any amino acid
  MOD_RES (62)..(83): Any amino acid
  MOD_RES (95)..(123): Any amino acid
  MOD_RES (147)..(180): Any amino acid
  MOD_RES (191)..(201): Any amino acid
  MOD_RES (212)..(253): Any amino acid
  MOD_RES (263)..(266): Any amino acid
  MOD_RES (281)..(316): Any amino acid
  MOD_RES (402)..(406): Any amino acid
  MOD_RES (431)..(434): Any amino acid
  MOD_RES (473)..(486): Any amino acid
  MOD_RES (506)..(506): Any amino acid
  MOD_RES (528)..(541): Any amino acid
KQGKTKATKMKAILVVLXXXXXXXXXADTLCIGYHANNSTDTVDTVLEKNVTVTHSVNLLEXXXXXXXXXXXXXXXXXXXXXXIAGWILGNPECXXXXXXXXXXXXXXXXXXXXXXXXXXXXXDYEELREQLSSVSSFERFEIFPKXXXXXXXXXXXXXXXXXXXXXXXXXXXXXXXXXXKEKENSYPMIXXXXXXXXXXXVLVLWGIHHPXXXXXXXXXXXXXXXXXXXXXXXXXXXXXXXXXXXXXXXXXXGRMNYYWTLXXXXDKITFEATGNLVVPXXXXXXXXXXXXXXXXXXXXXXXXXXXXXXXXXXXXTSLTSLPFQNIHPITIGKCPKYVKSTKLRLATGLRNVPSIQSRGLFGAIAGFIEGGWTGMVDGWYGYHHQNEQGSGYAADLKSTQXXXXXITNKVNSVIEKMNTQFTAVGKEFNXXXXRIENLNKKVDDGFLDIWTYNAELLVLLENERTLDYHDSXXXXXXXXXXXXXXNNAKEIGNGCFEFYHKCDNXCMESVKNGTYDYPKYSEEAKLXXXXXXXXXXXXXXIYQILAIYSTVASSLVLVVSLGAISFWMCSNGSLQCRICYASKTRISEDFRDMRKNTL

SEQ ID NO: 418898 - protein, 599 aa, Influenza virus
  MOD_RES (1)..(2): Any amino acid
  MOD_RES (18)..(26): Any amino acid
  MOD_RES (61)..(83): Any amino acid
  MOD_RES (95)..(123): Any amino acid
  MOD_RES (147)..(180): Any amino acid
  MOD_RES (191)..(201): Any amino acid
  MOD_RES (212)..(253): Any amino acid
  MOD_RES (263)..(266): Any amino acid
  MOD_RES (281)..(320): Any amino acid
  MOD_RES (362)..(368): Any amino acid
  MOD_RES (402)..(406): Any amino acid
  MOD_RES (431)..(434): Any amino acid
  MOD_RES (473)..(486): Any amino acid
  MOD_RES (506)..(506): Any amino acid
  MOD_RES (528)..(541): Any amino acid
XXGKTKATKMEAILVVLXXXXXXXXXADTICIGYHANNSTDTVDTILEKNVTVTHSVDLLXXXXXXXXXXXXXXXXXXXXXXXVAGWILGNPKCXXXXXXXXXXXXXXXXXXXXXXXXXXXXXNYEELREQLSTVSSFERFEMFPKXXXXXXXXXXXXXXXXXXXXXXXXXXXXXXXXXXKEKENSYPKIXXXXXXXXXXXVLVLWGVHHPXXXXXXXXXXXXXXXXXXXXXXXXXXXXXXXXXXXXXXXXXXGRINYYWTLXXXXDTIIFEANGNLIAPXXXXXXXXXXXXXXXXXXXXXXXXXXXXXXXXXXXXXXXXSLPFQNVHPVTIGECPKYVRSAKLRMVTGLRNIPSIQSRGLXXXXXXXIEGGWTGMIDGWYGYHHQNGQGSGYAADQKSTQXXXXXISNKVNSVIEKMNIQFTSVGKEFNXXXXRMENLNKKVDDGLLDVWTYNAELLILLENERTLDFHDSXXXXXXXXXXXXXXNNAKELGNGCFEFYHKCNDXCMESVRNGTYDYPKYSKESKLXXXXXXXXXXXXXXVYQILAIYSTAASSLVLLVSLGAISFWMCSGHSCRICIEYASKTRISILDQNFRNIRK

SEQ ID NO: 418899 - protein, 599 aa, Influenza virus
  MOD_RES (1)..(5): Any amino acid
  MOD_RES (18)..(26): Any amino acid
  MOD_RES (62)..(83): Any amino acid
  MOD_RES (95)..(123): Any amino acid
  MOD_RES (147)..(201): Any amino acid
  MOD_RES (212)..(253): Any amino acid
  MOD_RES (263)..(266): Any amino acid
  MOD_RES (281)..(320): Any amino acid
  MOD_RES (365)..(382): Any amino acid
  MOD_RES (402)..(406): Any amino acid
  MOD_RES (429)..(434): Any amino acid
  MOD_RES (456)..(463): Any amino acid
  MOD_RES (473)..(486): Any amino acid
  MOD_RES (506)..(506): Any amino acid
  MOD_RES (528)..(541): Any amino acid
  MOD_RES (581)..(583): Any amino acid
  MOD_RES (594)..(599): Any amino acid
XXXXXKATKMKAIIVVLXXXXXXXXXADTICVGYHANNSTDTVDTLLEKNVTVTHSVNILEXXXXXXXXXXXXXXXXXXXXXXIAGWLLGNPECXXXXXXXXXXXXXXXXXXXXXXXXXXXXXDYEELKEQLSTVSSFEKFEIFPKXXXXXXXXXXXXXXXXXXXXXXXXXXXXXXXXXXXXXXXXXXXXXXXXXXXXXXXVLVIWGVHHPXXXXXXXXXXXXXXXXXXXXXXXXXXXXXXXXXXXXXXXXXXGRMNYHWTLXXXXDTITFEATGNLIAPXXXXXXXXXXXXXXXXXXXXXXXXXXXXXXXXXXXXXXXXSLPFHNIHPITIGECPKYVKSTKLRMATGLRNIPSVQSRGLFGAXXXXXXXXXXXXXXXXXXYHHQNAQGSGYAADRKSTQXXXXXITNKVNSIIEKMNTQFTVVGKEXXXXXXRIENLNKKIDDGFLDVWTYNAXXXXXXXXERTLDFHDLXXXXXXXXXXXXXXNNAKEVGNGCFEFYHKCDDXCMESIKNGTYDYPKYSEESKLXXXXXXXXXXXXXXIHQILAIYSTVASSSVLLVSLGAVSFWMCSNGSLRCRICXXXQCRICIRADGXXXXXX

SEQ ID NO: 418900 - protein, 599 aa, Influenza virus
  MOD_RES (1)..(8): Any amino acid
  MOD_RES (18)..(39): Any amino acid
  MOD_RES (53)..(83): Any amino acid
  MOD_RES (93)..(123): Any amino acid
  MOD_RES (143)..(201): Any amino acid
  MOD_RES (212)..(253): Any amino acid
  MOD_RES (263)..(266): Any amino acid
  MOD_RES (277)..(320): Any amino acid
  MOD_RES (355)..(406): Any amino acid
  MOD_RES (429)..(434): Any amino acid
  MOD_RES (450)..(463): Any amino acid
  MOD_RES (473)..(496): Any amino acid
  MOD_RES (506)..(508): Any amino acid
  MOD_RES (528)..(541): Any amino acid
  MOD_RES (568)..(570): Any amino acid
  MOD_RES (581)..(583): Any amino acid
  MOD_RES (598)..(599): Any amino acid
XXXXXXXXEREAKLFVLXXXXXXXXXXXXXXXXXXXXXXTDTVDTVREKNVTXXXXXXXXXXXXXXXXXXXXXXXXXXXXXXXVAGWLLGNPXXXXXXXXXXXXXXXXXXXXXXXXXXXXXXXNYEELREHLSSVSSFEKFEXXXXXXXXXXXXXXXXXXXXXXXXXXXXXXXXXXXXXXXXXXXXXXXXXXXXXXXXXXXVLVLWAIHHPXXXXXXXXXXXXXXXXXXXXXXXXXXXXXXXXXXXXXXXXXXGRMDYYWTLXXXXDTIIFEASGNXXXXXXXXXXXXXXXXXXXXXXXXXXXXXXXXXXXXXXXXXXXXNLPFQNVHPITIGKCSKYVKSTQLRMATGLRNVPXXXXXXXXXXXXXXXXXXXXXXXXXXXXXXXXXXXXXXXXXXXXXXXXXXXXITNKVNSVVEKMNTQFTSVGKEXXXXXXRIENLNRKVDDGFLDXXXXXXXXXXXXXXERTLDFHDFXXXXXXXXXXXXXXXXXXXXXXXXFEFYHKCNNXXXESVKNGTYNYPKYSEESRLXXXXXXXXXXXXXXVHQILAIYSTVASSLILIVSLGAISFXXXSNGSLQCRVCXXXQCRICIDFRDMRKNXX

SEQ ID NO: 418901 - protein, 599 aa, Influenza virus
  MOD_RES (1)..(12): Any amino acid
  MOD_RES (22)..(40): Any amino acid
  MOD_RES (58)..(130): Any amino acid
  MOD_RES (144)..(201): Any amino acid
  MOD_RES (212)..(253): Any amino acid
  MOD_RES (263)..(266): Any amino acid
  MOD_RES (281)..(320): Any amino acid
  MOD_RES (338)..(342): Any amino acid
  MOD_RES (352)..(406): Any amino acid
  MOD_RES (431)..(439): Any amino acid
  MOD_RES (457)..(463): Any amino acid
  MOD_RES (473)..(518): Any amino acid
  MOD_RES (528)..(552): Any amino acid
  MOD_RES (597)..(599): Any amino acid
XXXXXXXXXXXXIIIVVLLYTXXXXXXXXXXXXXXXXXXXDTVDTVLERNVTVTHSVXXXXXXXXXXXXXXXXXXXXXXXXXXXXXXXXXXXXXXXXXXXXXXXXXXXXXXXXXXXXXXXXXXXXXXXXXQLSSVSSFKRFEIXXXXXXXXXXXXXXXXXXXXXXXXXXXXXXXXXXXXXXXXXXXXXXXXXXXXXXXXXXVLVIWGIHHPXXXXXXXXXXXXXXXXXXXXXXXXXXXXXXXXXXXXXXXXXXGRMNYYWTIXXXXDTIIFEATGNLLVPXXXXXXXXXXXXXXXXXXXXXXXXXXXXXXXXXXXXXXXXSLPFQNIHSITIGKCPKXXXXXRLRMATGLRXXXXXXXXXXXXXXXXXXXXXXXXXXXXXXXXXXXXXXXXXXXXXXXXXXXXXXXITNKVNTVIEKMNIQFTAVGKEFSXXXXXXXXXNKKVDDGFIDIWTYNAEXXXXXXXERTLDYHDFXXXXXXXXXXXXXXXXXXXXXXXXXXXXXXXXXXXXXXXXXXXXXXPKYSKEAKLXXXXXXXXXXXXXXXXXXXXXXXXXASSLVLIVSLGAIGFWMCSNGSGSLQCRICIQCRICILDQNFRNXXX

SEQ ID NO: 418902 - protein, 599 aa, Influenza virus
  MOD_RES (1)..(137): Any amino acid
  MOD_RES (147)..(270): Any amino acid
  MOD_RES (281)..(333): Any amino acid
  MOD_RES (343)..(344): Any amino acid
  MOD_RES (355)..(443): Any amino acid
  MOD_RES (457)..(552): Any amino acid
  MOD_RES (568)..(570): Any amino acid
  MOD_RES (581)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFERFEIFPNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFEATGNLVAPXXXXXXXXXXXXXXXXXXXXXXXXXXXXXXXXXXXXXXXXXXXXXXXXXXXXXECPKYVRSTXXRLATGLRNIPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDDGFIDVWTYNAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASTLVLLVSLGAIGFXXXSWSLQCRICIXXXXXXXXXXXXXXXXXXX

SEQ ID NO: 418903 - protein, 599 aa, Influenza virus
  MOD_RES (1)..(574): Any amino acid
  MOD_RES (584)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSLQCRVCIXXXXXXXXXXXXXXXX

SEQ ID NO: 418904 - protein, 599 aa, Influenza virus
  MOD_RES (1)..(574): Any amino acid
  MOD_RES (584)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSLRCRICIXXXXXXXXXXXXXXXX

SEQ ID NO: 418905 - protein, 599 aa, Influenza virus
  MOD_RES (1)..(575): Any amino acid
  MOD_RES (588)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLCSVEYASKTRIXXXXXXXXXXXX

SEQ ID NO: 418906 - protein, 484 aa, Influenza virus
  MOD_RES (20)..(106): Any amino acid
  MOD_RES (231)..(232): Any amino acid
  MOD_RES (268)..(282): Any amino acid
  MOD_RES (298)..(299): Any amino acid
  MOD_RES (323)..(323): Any amino acid
  MOD_RES (341)..(354): Any amino acid
  MOD_RES (379)..(382): Any amino acid
  MOD_RES (395)..(409): Any amino acid
  MOD_RES (445)..(447): Any amino acid
  MOD_RES (465)..(467): Any amino acid
  MOD_RES (482)..(484): Any amino acid
IGLREQKQEFKMNPNQKIIXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWXXNILRTQESECACVNGSCFTVMTDGPSVMGQASYKIXXXXXXXXXXXXXXXAPNYHYEECSCYPDSXXITCVCRDNWHGSNRPWVSFNQNLXYQIGYICSGIFGDNPRPXXXXXXXXXXXXXXGANGVKGFSFKYGNGVWIGRTKSIXXXXGFEMIWDPNGWTXXXXXXXXXXXXXXXNEWSGYSGSFVQHPELTGLDCIRPCFWVELIRGRPXXXTTIWTSGSSISFCGVNSXXXGWSWPDGAELPFTIXXX

SEQ ID NO: 418907 - protein, 484 aa, Influenza virus
  MOD_RES (1)..(106): Any amino acid
  MOD_RES (142)..(145): Any amino acid
  MOD_RES (231)..(232): Any amino acid
  MOD_RES (259)..(282): Any amino acid
  MOD_RES (298)..(299): Any amino acid
  MOD_RES (323)..(323): Any amino acid
  MOD_RES (335)..(354): Any amino acid
  MOD_RES (379)..(382): Any amino acid
  MOD_RES (395)..(409): Any amino acid
  MOD_RES (445)..(447): Any amino acid
  MOD_RES (465)..(467): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIYTKDNSIRIGSKGDIFVIREPFISCSHLECRXXXXTQGALLNDRHSNGTVKDRSPYRALMSCPLGEAPSPYNSKFESVAWSASACHDGMGWLTIGISGPDDGAVAVLKYKGIITGTIKSWXXQILRTQESECVCMNGSCFTIMTDGPSXXXXXXXXXXXXXXXXXXXXXXXXAPNFHYEECSCYPESXXVMCVCRDNWHASNRPWVSFDQNLXYQMGYICSGIFXXXXXXXXXXXXXXXXXXXXGADGVKGFSYKYGNGVWMGRTKSNXXXXGFEMIWDPDGWTXXXXXXXXXXXXXXXTDWSGYSGSFVQHPELTGMNCIRPCFWVELVRGLPXXXATIWTSGSSISFCGVDSXXXNWSWPDGAELPFAIXXX

SEQ ID NO: 418908 - protein, 484 aa, Influenza virus
  MOD_RES (1)..(106): Any amino acid
  MOD_RES (142)..(151): Any amino acid
  MOD_RES (186)..(190): Any amino acid
  MOD_RES (230)..(232): Any amino acid
  MOD_RES (259)..(282): Any amino acid
  MOD_RES (298)..(299): Any amino acid
  MOD_RES (323)..(323): Any amino acid
  MOD_RES (341)..(354): Any amino acid
  MOD_RES (379)..(382): Any amino acid
  MOD_RES (395)..(409): Any amino acid
  MOD_RES (419)..(420): Any amino acid
  MOD_RES (445)..(448): Any amino acid
  MOD_RES (465)..(467): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIHTKDNSIRIGSKGDIFVMREPFISCSQLECRXXXXXXXXXXNDKHSNGTVKNRSPYRALMSCPIGEAPSPYNSRFXXXXXSASACHDGTSWLTIGISGPDNEAVAVLKYNDIITDTIKSXXXRILRTQESECVCVNGSCFTVLTDGPSXXXXXXXXXXXXXXXXXXXXXXXXAPNFYYEECSCYPDTXXVVCVCRDNWHASNRPWISFDQNLXYQVGYICSGVFGDNPRPXXXXXXXXXXXXXXGAYGVKGFSFRYGNGVWIGRTKSNXXXXGFEMVWDPNGWTXXXXXXXXXXXXXXXNDWSGYSGSXXQHPELTGLNCIKPCFWVELIRGQPXXXXTIWASGSSISFCGVNGXXXSWSWPDGADLPFTIXXX

SEQ ID NO: 418909 - protein, 484 aa, Influenza virus
  MOD_RES (1)..(107): Any amino acid
  MOD_RES (142)..(151): Any amino acid
  MOD_RES (183)..(190): Any amino acid
  MOD_RES (211)..(216): Any amino acid
  MOD_RES (227)..(232): Any amino acid
  MOD_RES (259)..(282): Any amino acid
  MOD_RES (298)..(299): Any amino acid
  MOD_RES (309)..(312): Any amino acid
  MOD_RES (323)..(323): Any amino acid
  MOD_RES (341)..(354): Any amino acid
  MOD_RES (379)..(409): Any amino acid
  MOD_RES (419)..(420): Any amino acid
  MOD_RES (432)..(448): Any amino acid
  MOD_RES (465)..(467): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWAIYSKDNGIRIGSKGDVFVMREPFISCSHFECRXXXXXXXXXXNDKHSNGTAKDRSPHRTLMSCPVGEAPSPYNXXXXXXXXSASACHDGLGWITIGISGPDXXXXXXLKYNGIITGTXXXXXXKILRTQESECVCINGSCFTIMTDGPNXXXXXXXXXXXXXXXXXXXXXXXXAPNSHYEECSCYPDAXXIICVCRDNWXXXXRPWVSFNQDLXYRIGYICSGVFGDNPRSXXXXXXXXXXXXXXGTNGVKGFSFKYDNGVWIGRTKSTXXXXXXXXXXXXXXXXXXXXXXXXXXXXXXXTNWSGYSGSXXQHPELTGMDCIXXXXXXXXXXXXXXXXXTIWTSASSISFCGVSSXXXDWSWPDGAELPFIIXXX

SEQ ID NO: 418910 - protein, 484 aa, Influenza virus
  MOD_RES (1)..(110): Any amino acid
  MOD_RES (126)..(132): Any amino acid
  MOD_RES (150)..(152): Any amino acid
  MOD_RES (170)..(190): Any amino acid
  MOD_RES (200)..(216): Any amino acid
  MOD_RES (231)..(236): Any amino acid
  MOD_RES (250)..(282): Any amino acid
  MOD_RES (295)..(312): Any amino acid
  MOD_RES (323)..(325): Any amino acid
  MOD_RES (335)..(355): Any amino acid
  MOD_RES (372)..(422): Any amino acid
  MOD_RES (440)..(448): Any amino acid
  MOD_RES (465)..(467): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYSKDNSVRIGSKGDVXXXXXXXISCSHLECKTFFLTQGAXXXDRHSNGTIKDRSPFRALXXXXXXXXXXXXXXXXXXXXXSASACHDGVXXXXXXXXXXXXXXXXXLKYNGIITETIKSWXXXXXXTQESECACINGSCXXXXXXXXXXXXXXXXXXXXXXXXXXXXXXXXXAPNYYYEECSCYXXXXXXXXXXXXXXXXXXRPWVSFNHNLXXXMGYICSGVFXXXXXXXXXXXXXXXXXXXXXANGVKGFSYRYGNGVWXXXXXXXXXXXXXXXXXXXXXXXXXXXXXXXXXXXXXXXXXXXXXXXXXXXPELTGLDCMRPCFWVELXXXXXXXXXTIWTSGSIISFCGVNSXXXGWSWPDGAKLPFTIXXX

SEQ ID NO: 418911 - protein, 484 aa, Influenza virus
  MOD_RES (1)..(113): Any amino acid
  MOD_RES (123)..(154): Any amino acid
  MOD_RES (165)..(220): Any amino acid
  MOD_RES (231)..(331): Any amino acid
  MOD_RES (341)..(358): Any amino acid
  MOD_RES (372)..(428): Any amino acid
  MOD_RES (438)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNGVRIGSKXXXXXXXXXXXXXXXXXXXXXXXXXXXXXXXXHSNGTVKBRSXXXXXXXXXXXXXXXXXXXXXXXXXXXXXXXXXXXXXXXXXXXXXXXXXXXXXXXXGVITDTIKSWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVLGDNPRPXXXXXXXXXXXXXXXXXXVKGFSYKYDNGVWXXXXXXXXXXXXXXXXXXXXXXXXXXXXXXXXXXXXXXXXXXXXXXXXXXXXXXXXXNCMRPCFWVXXXXXXXXXXXXXXXXXXXXXXXXXXXXXXXXXXXXXXDLPFTQEQK

SEQ ID NO: 418912 - protein, 484 aa, Influenza virus
  MOD_RES (1)..(369): Any amino acid
  MOD_RES (379)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIWIGRTKSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418913 - protein, 566 aa, Influenza virus
  MOD_RES (1)..(17): Any amino acid
  MOD_RES (36)..(38): Any amino acid
  MOD_RES (52)..(73): Any amino acid
  MOD_RES (85)..(114): Any amino acid
  MOD_RES (124)..(307): Any amino acid
  MOD_RES (327)..(328): Any amino acid
  MOD_RES (338)..(339): Any amino acid
  MOD_RES (369)..(371): Any amino acid
  MOD_RES (382)..(421): Any amino acid
  MOD_RES (433)..(433): Any amino acid
  MOD_RES (460)..(471): Any amino acid
  MOD_RES (491)..(491): Any amino acid
  MOD_RES (504)..(550): Any amino acid
XXXXXXXXXXXXXXXXXDTICIGYHANNSTDTVDTXXXKNVTVTHSVNLLEXXXXXXXXXXXXXXXXXXXXXXVAGWILGNPECXXXXXXXXXXXXXXXXXXXXXXXXXXXXXXYEELREQLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNVHPVTIGECPKYVKSXXLRMVTGLRNXXSIQSRGLFGAIAGFIEGGWTGMIDGWYGYXXXNEQGSGYAADXXXXXXXXXXXXXXXXXXXXXXXXXXXXXXXXXXXXXXXXENLNKKVDDGFXDIWTYNAELLVLLENERTLDFHDSNVXXXXXXXXXXXXNNAKEIGNGCFEFYHKCNNXCMESVKNGTYDYXXXXXXXXXXXXXXXXXXXXXXXXXXXXXXXXXXXXXXXXXXXXXXXSFWMCSNGSLQCRICI

SEQ ID NO: 418914 - protein, 566 aa, Influenza virus
  MOD_RES (1)..(17): Any amino acid
  MOD_RES (36)..(38): Any amino acid
  MOD_RES (50)..(73): Any amino acid
  MOD_RES (85)..(114): Any amino acid
  MOD_RES (124)..(307): Any amino acid
  MOD_RES (327)..(328): Any amino acid
  MOD_RES (338)..(339): Any amino acid
  MOD_RES (352)..(353): Any amino acid
  MOD_RES (369)..(371): Any amino acid
  MOD_RES (382)..(421): Any amino acid
  MOD_RES (433)..(433): Any amino acid
  MOD_RES (460)..(471): Any amino acid
  MOD_RES (491)..(491): Any amino acid
  MOD_RES (504)..(550): Any amino acid
XXXXXXXXXXXXXXXXXDTLCIGYHANNSTETVDTXXXKNITVTHSVNLXXXXXXXXXXXXXXXXXXXXXXXXIAGWLLGNPECXXXXXXXXXXXXXXXXXXXXXXXXXXXXXXYEELREHLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNIHPVTIGKCPKYVKSXXLRMATGLRNXXSIQSKGLFGAIAXXIEGGWTGMVDGWYGYXXXNEQGSGFAADXXXXXXXXXXXXXXXXXXXXXXXXXXXXXXXXXXXXXXXXESLNNKVDDGFXDVWTYNAELLILLENERTLDYHDSNVXXXXXXXXXXXXNNAKELGNGCFEFYHRCDDXCMDSVKNGTYNYXXXXXXXXXXXXXXXXXXXXXXXXXXXXXXXXXXXXXXXXXXXXXXXCFWMCSNGSLHGRICI

SEQ ID NO: 418915 - protein, 566 aa, Influenza virus
  MOD_RES (1)..(17): Any amino acid
  MOD_RES (36)..(38): Any amino acid
  MOD_RES (52)..(73): Any amino acid
  MOD_RES (85)..(114): Any amino acid
  MOD_RES (124)..(307): Any amino acid
  MOD_RES (327)..(328): Any amino acid
  MOD_RES (338)..(339): Any amino acid
  MOD_RES (350)..(354): Any amino acid
  MOD_RES (369)..(371): Any amino acid
  MOD_RES (382)..(421): Any amino acid
  MOD_RES (433)..(433): Any amino acid
  MOD_RES (444)..(445): Any amino acid
  MOD_RES (460)..(471): Any amino acid
  MOD_RES (491)..(491): Any amino acid
  MOD_RES (504)..(550): Any amino acid
XXXXXXXXXXXXXXXXXDTICVGYHANNSTDTIDTXXXKNVTVTHSINLLEXXXXXXXXXXXXXXXXXXXXXXIAGWILGNPKCXXXXXXXXXXXXXXXXXXXXXXXXXXXXXXYEELREQLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNVHPITIGECPKYVRSXXLKMATGLRNXXSVQSRGLFGAXXXXXEGGWTGMVNGWYGYXXXNDQGSGYAADXXXXXXXXXXXXXXXXXXXXXXXXXXXXXXXXXXXXXXXXENLNKKIDDGFXDLWTYNAELLXXLENERTLDLHDSNVXXXXXXXXXXXXNNAQEIGNGCFEFYHKCDDXCMESVRNGTYDYXXXXXXXXXXXXXXXXXXXXXXXXXXXXXXXXXXXXXXXXXXXXXXXGFWMCSNGSLQCKICI

SEQ ID NO: 418916 - protein, 566 aa, Influenza virus
  MOD_RES (1)..(17): Any amino acid
  MOD_RES (27)..(38): Any amino acid
  MOD_RES (48)..(73): Any amino acid
  MOD_RES (85)..(114): Any amino acid
  MOD_RES (124)..(307): Any amino acid
  MOD_RES (319)..(328): Any amino acid
  MOD_RES (338)..(339): Any amino acid
  MOD_RES (351)..(372): Any amino acid
  MOD_RES (382)..(421): Any amino acid
  MOD_RES (433)..(433): Any amino acid
  MOD_RES (443)..(448): Any amino acid
  MOD_RES (460)..(471): Any amino acid
  MOD_RES (491)..(491): Any amino acid
  MOD_RES (504)..(550): Any amino acid
  MOD_RES (564)..(566): Any amino acid
XXXXXXXXXXXXXXXXXDPICIGYHAXXXXXXXXXXXXKNVAVTHSVXXXXXXXXXXXXXXXXXXXXXXXXXXVAGWLLGNPACXXXXXXXXXXXXXXXXXXXXXXXXXXXXXXYEELKEQLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNIHPITIGXXXXXXXXXXLRLATGLRNXXSIHSRGLFGAIXXXXXXXXXXXXXXXXXXXXXXEQGSGYAANXXXXXXXXXXXXXXXXXXXXXXXXXXXXXXXXXXXXXXXXENLNRKVDDGFXDVWTYNVELXXXXXXERTLDFHDFNVXXXXXXXXXXXXNKVKEIGNGCFEFYHKCNDXCMESIKNGTYDYXXXXXXXXXXXXXXXXXXXXXXXXXXXXXXXXXXXXXXXXXXXXXXXSFWMCPNGSLQCTXXX

SEQ ID NO: 418917 - protein, 566 aa, Influenza virus
  MOD_RES (1)..(18): Any amino acid
  MOD_RES (28)..(38): Any amino acid
  MOD_RES (48)..(73): Any amino acid
  MOD_RES (83)..(114): Any amino acid
  MOD_RES (124)..(307): Any amino acid
  MOD_RES (324)..(328): Any amino acid
  MOD_RES (338)..(339): Any amino acid
  MOD_RES (352)..(372): Any amino acid
  MOD_RES (382)..(421): Any amino acid
  MOD_RES (432)..(449): Any amino acid
  MOD_RES (459)..(471): Any amino acid
  MOD_RES (491)..(494): Any amino acid
  MOD_RES (504)..(554): Any amino acid
  MOD_RES (564)..(566): Any amino acid
XXXXXXXXXXXXXXXXXXTLCICYHANXXXXXXXXXXXKNVTVTHAVXXXXXXXXXXXXXXXXXXXXXXXXXXVVGWISGNPXXXXXXXXXXXXXXXXXXXXXXXXXXXXXXXXYEELREQMSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNIHPATIGECPKYXXXXXLRMARGLRNXXSIQTRGLFGAIAXXXXXXXXXXXXXXXXXXXXXEQGYGYAADXXXXXXXXXXXXXXXXXXXXXXXXXXXXXXXXXXXXXXXXENLNKRVDDGXXXXXXXXXXXXXXXXXXRTLDYHDSHXXXXXXXXXXXXXNNARELGNGCFEFYHKCDNXXXXSVKNGTYEYXXXXXXXXXXXXXXXXXXXXXXXXXXXXXXXXXXXXXXXXXXXXXXXXXXXCSNGSLQFRXXX

SEQ ID NO: 418918 - protein, 566 aa, Influenza virus
  MOD_RES (1)..(39): Any amino acid
  MOD_RES (49)..(75): Any amino acid
  MOD_RES (85)..(423): Any amino acid
  MOD_RES (433)..(472): Any amino acid
  MOD_RES (483)..(555): Any amino acid
XXXXXXXXXXXXXXXXXXXXXXXXXXXXXXXXXXXXXXXKLTVTHSVNXXXXXXXXXXXXXXXXXXXXXXXXXXXGWLLGNPGCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLNKKVDDGLXXXXXXXXXXXXXXXXXXXXXXXXXXXXXXXXXXXXXXXXNAKETGNGCFXXXXXXXXXXXXXXXXXXXXXXXXXXXXXXXXXXXXXXXXXXXXXXXXXXXXXXXXXXXXXXXXXXXXXXXXXSNGSLQCRVCI

SEQ ID NO: 418919 - protein, 566 aa, Influenza virus
  MOD_RES (1)..(40): Any amino acid
  MOD_RES (51)..(555): Any amino acid
XXXXXXXXXXXXXXXXXXXXXXXXXXXXXXXXXXXXXXXXVKVTHRENLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHGSLQCRICM

SEQ ID NO: 418920 - protein, 475 aa, Influenza virus
  MOD_RES (1)..(46): Any amino acid
  MOD_RES (56)..(84): Any amino acid
  MOD_RES (94)..(94): Any amino acid
  MOD_RES (127)..(128): Any amino acid
  MOD_RES (144)..(151): Any amino acid
  MOD_RES (198)..(221): Any amino acid
  MOD_RES (235)..(236): Any amino acid
  MOD_RES (250)..(270): Any amino acid
  MOD_RES (287)..(287): Any amino acid
  MOD_RES (307)..(314): Any amino acid
  MOD_RES (329)..(345): Any amino acid
  MOD_RES (358)..(371): Any amino acid
  MOD_RES (382)..(403): Any amino acid
  MOD_RES (415)..(416): Any amino acid
  MOD_RES (433)..(436): Any amino acid
XXXXXXXXXXXXXXXXXXXXXXXXXXXXXXXXXXXXXXXXXXXXXXKNNQVILCEXXXXXXXXXXXXXXXXXXXXXXXXXXXXXYRNWSKPQCXITGFAPFSKDNSIRLSAGGDIWVTREPYVSCDXXKCYQFALGQGTTLNNXXXXXXXXDRTPYRTLLMNELGVPFHLGTKQVCIAWSSSSCHDGKAWLHVCVTGXXXXXXXXXXXXXXXXXXXXXXXXNILRTQESECVCIXXTCTVVMTDGSASGXXXXXXXXXXXXXXXXXXXXXGSAQHVEECSCYPRYPXVRCVCRDNWKGSNRPIVDIXXXXXXXXSSYVCSGLVGDTPRXXXXXXXXXXXXXXXXXGGHGVKGWAFDDXXXXXXXXXXXXXXRSGYETFKVIXXXXXXXXXXXXXXXXXXXXXXRSGYSGIFSVEXXSCINRCFYVELIRGRKXXXXVWWTSNSIVVFCGTSGTYGTGSWPDGADIISCLYKLSQF

SEQ ID NO: 418921 - protein, 475 aa, Influenza virus
  MOD_RES (1)..(46): Any amino acid
  MOD_RES (56)..(84): Any amino acid
  MOD_RES (94)..(94): Any amino acid
  MOD_RES (123)..(128): Any amino acid
  MOD_RES (144)..(151): Any amino acid
  MOD_RES (198)..(221): Any amino acid
  MOD_RES (235)..(236): Any amino acid
  MOD_RES (250)..(270): Any amino acid
  MOD_RES (287)..(287): Any amino acid
  MOD_RES (307)..(314): Any amino acid
  MOD_RES (327)..(345): Any amino acid
  MOD_RES (358)..(371): Any amino acid
  MOD_RES (382)..(403): Any amino acid
  MOD_RES (415)..(416): Any amino acid
  MOD_RES (433)..(436): Any amino acid
  MOD_RES (466)..(475): Any amino acid
XXXXXXXXXXXXXXXXXXXXXXXXXXXXXXXXXXXXXXXXXXXXXXKNNQVILCGXXXXXXXXXXXXXXXXXXXXXXXXXXXXXYRNWSMPQCXIKGFAPFSKDNSIRLSASGDIWVTRKPYXXXXXXRCYQFALGQGTTLDNXXXXXXXXDRTPHRTLLMNELGIPFHLGTKQVCMAWSSSSCHDGRAWLHVCITGXXXXXXXXXXXXXXXXXXXXXXXXKILRTQESECICIXXICTVVMTDGSATGXXXXXXXXXXXXXXXXXXXXXGSAQHIEECSCYPRFPXVRCICRDNWKGSNRPVVDIXXXXXXXXSSYMCSGLVGDTXXXXXXXXXXXXXXXXXXXGNHGVKGWAFDNXXXXXXXXXXXXXXRLGYETFKVIXXXXXXXXXXXXXXXXXXXXXXWSGYSGIFSIEXXNCINRCFYVELIRGRRXXXXVLWTSNSIVVFCSTSGTYGTGTWPDGADIXXXXXXXXXX

SEQ ID NO: 418922 - protein, 475 aa, Influenza virus
  MOD_RES (1)..(84): Any amino acid
  MOD_RES (94)..(94): Any amino acid
  MOD_RES (104)..(105): Any amino acid
  MOD_RES (127)..(133): Any amino acid
  MOD_RES (144)..(151): Any amino acid
  MOD_RES (194)..(221): Any amino acid
  MOD_RES (235)..(236): Any amino acid
  MOD_RES (250)..(270): Any amino acid
  MOD_RES (287)..(288): Any amino acid
  MOD_RES (306)..(314): Any amino acid
  MOD_RES (327)..(345): Any amino acid
  MOD_RES (358)..(371): Any amino acid
  MOD_RES (382)..(403): Any amino acid
  MOD_RES (415)..(416): Any amino acid
  MOD_RES (433)..(436): Any amino acid
  MOD_RES (466)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXYRDWSKPQCXVTGFAPFSKXXSIRLSAGGAIWVTREPYVSCEXXXXXXXALGQGTTLKNXXXXXXXXDRIPHRTLLMSELGVPFYLGTRQVCIAWSSSSCYDGKAWLHVXXXXXXXXXXXXXXXXXXXXXXXXXXXXRILRTQESECVCVXXTCTVIMTDGSASGXXXXXXXXXXXXXXXXXXXXXGGAQHVEECSCYPRSPXXRCVCRDNWRGSNRPIVDXXXXXXXXXSSYICSGLVGDTXXXXXXXXXXXXXXXXXXXGNPGVKGWAFDYXXXXXXXXXXXXXXRSGYETFRVIXXXXXXXXXXXXXXXXXXXXXXRSGYSGVFSVEXXRCINRCFYVELIRGRNXXXXVGWTSNSIVVFCGTPGTYGSGSWPDGANIXXXXXXXXXX

SEQ ID NO: 418923 - protein, 475 aa, Influenza virus
  MOD_RES (1)..(84): Any amino acid
  MOD_RES (94)..(94): Any amino acid
  MOD_RES (105)..(106): Any amino acid
  MOD_RES (127)..(133): Any amino acid
  MOD_RES (144)..(151): Any amino acid
  MOD_RES (177)..(180): Any amino acid
  MOD_RES (198)..(221): Any amino acid
  MOD_RES (235)..(236): Any amino acid
  MOD_RES (250)..(270): Any amino acid
  MOD_RES (287)..(295): Any amino acid
  MOD_RES (307)..(345): Any amino acid
  MOD_RES (358)..(372): Any amino acid
  MOD_RES (382)..(403): Any amino acid
  MOD_RES (413)..(416): Any amino acid
  MOD_RES (433)..(437): Any amino acid
  MOD_RES (474)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXYRSWSKPQCXITGFASFSKDXXIRLSASGDVWVTREPYVSCSXXXXXXXALGQGTTLSNXXXXXXXXDRTSYRTLLMNELGVPFYLGTKQVCXXXXSSSCHDGKSWLHVCVTGXXXXXXXXXXXXXXXXXXXXXXXXKILRTHESECVCIXXTCAVVMTDGSALGXXXXXXXXXXXXXXXXXXXXXGNAQHVEECSCYPQYPXXXXXXXXXWKGSNRPIIDIXXXXXXXXXXXXXXXXXXXXXXXXXXXXXXXXXXXXXXXGDHGVKGWAFDSXXXXXXXXXXXXXXXLGYETFKVVXXXXXXXXXXXXXXXXXXXXXXMSGYSGIFSXXXXSCVNRCFYVELIRGRPXXXXXWWTSNSVVVFCGTSGIYGTGSWPDVRTSISCLYKLSXX

SEQ ID NO: 418924 - protein, 475 aa, Influenza virus
  MOD_RES (1)..(84): Any amino acid
  MOD_RES (94)..(94): Any amino acid
  MOD_RES (105)..(107): Any amino acid
  MOD_RES (127)..(151): Any amino acid
  MOD_RES (162)..(164): Any amino acid
  MOD_RES (182)..(184): Any amino acid
  MOD_RES (198)..(236): Any amino acid
  MOD_RES (249)..(295): Any amino acid
  MOD_RES (307)..(345): Any amino acid
  MOD_RES (358)..(372): Any amino acid
  MOD_RES (382)..(403): Any amino acid
  MOD_RES (413)..(423): Any amino acid
  MOD_RES (433)..(440): Any amino acid
  MOD_RES (464)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXYRNWAKPQCXINGFAPFSKDXXXRVSAGGDIWVTREPYVSCGXXXXXXXXXXXXXXXXXXXXXXXXXDRSPYRTLLMXXXGVPFHLGTRQVCMAWSSXXXYDGKAWLHICVTGXXXXXXXXXXXXXXXXXXXXXXXXXXXXXXXXXXXXXXXICAVVMTDGSVSXXXXXXXXXXXXXXXXXXXXXXXXXXXXXXXXXXXXXXXXXXXXXXXWKGSNRPVIDIXXXXXXXXXXXXXXXXXXXXXXXXXXXXXXXXXXXXXXXGSHGVKGWAFDEXXXXXXXXXXXXXXXSGYETFRVTXXXXXXXXXXXXXXXXXXXXXXWSGYSGVFSXXXXXXXXXXXYVELIRGREXXXXXXXXSNSIVAFCGTSGTYGTGAWPDGAXXXXXXXXXXXX

SEQ ID NO: 418925 - protein, 475 aa, Influenza virus
  MOD_RES (1)..(108): Any amino acid
  MOD_RES (127)..(164): Any amino acid
  MOD_RES (174)..(240): Any amino acid
  MOD_RES (250)..(404): Any amino acid
  MOD_RES (415)..(440): Any amino acid
  MOD_RES (464)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSAGGDIWITREPYVSCKXXXXXXXXXXXXXXXXXXXXXXXXXXXXXXXXXXXXXXGIPFHLGTRXXXXXXXXXXXXXXXXXXXXXXXXXXXXXXXXXXXXXXXXXXXXXXXXXXXXXXXXXXXXXXXXXXXIMIDGSASGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGYFGVFSVEXXXXXXXXXXXXXXXXXXXXXXXXXXSTSIVVFCGASGTYGKGSWPDGAXXXXXXXXXXXX

SEQ ID NO: 418926 - protein, 475 aa, Influenza virus
  MOD_RES (1)..(108): Any amino acid
  MOD_RES (122)..(441): Any amino acid
  MOD_RES (466)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSAGGAVWVTREPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSIVEFCGTSGTCGTGSWPDGRTSXXXXXXXXXX

SEQ ID NO: 418927 - protein, 475 aa, Influenza virus
  MOD_RES (1)..(110): Any amino acid
  MOD_RES (121)..(445): Any amino acid
  MOD_RES (455)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGGDIWATREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFCGTSGTCXXXXXXXXXXXXXXXXXXXXX

SEQ ID NO: 418928 - protein, 475 aa, Influenza virus
  MOD_RES (1)..(452): Any amino acid
  MOD_RES (462)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYGAGSWPDXXXXXXXXXXXXXX

SEQ ID NO: 418929 - protein, 569 aa, Influenza virus
  MOD_RES (16)..(21): Any amino acid
  MOD_RES (94)..(94): Any amino acid
  MOD_RES (106)..(161): Any amino acid
  MOD_RES (173)..(182): Any amino acid
  MOD_RES (195)..(245): Any amino acid
  MOD_RES (255)..(259): Any amino acid
  MOD_RES (289)..(294): Any amino acid
  MOD_RES (330)..(331): Any amino acid
  MOD_RES (341)..(341): Any amino acid
  MOD_RES (392)..(399): Any amino acid
  MOD_RES (409)..(412): Any amino acid
  MOD_RES (436)..(437): Any amino acid
  MOD_RES (523)..(527): Any amino acid
MDNQTKTMTITFLILXXXXXXGDQICIGYHANNSTEKVDTILERNVTVTHAKDILEKTHNGKLCKLNGIPPLELGDCSIAGWLLGNPECDRLLXVPEWSYIVEKEXXXXXXXXXXXXXXXXXXXXXXXXXXXXXXXXXXXXXXXXXXXXXXXXXXXXXXXXPSFFRNMVWLTXXXXXXXXXXRSYNNTSGEQMLXXXXXXXXXXXXXXXXXXXXXXXXXXXXXXXXXXXXXXXXXXXXXXXXXXXRMEFSWTLLXXXXXINFESTGNLIAPEYGFKISKRGSSGIMKTXXXXXXCETKCQTPLGAINTTLPFHNIHPLTIGECPKYVKSXXLVLATGLRNXPQIESRGLFGAIAGFIEGGWQGMVDGWYGYHHSNDQGSGYAADKESTQKAXXXXXXXXNSVIEKMNTXXXXVGKEFNNLERRLENLNKKMEDGFXXVWTYNAELLVLMENERTLDFHDSNVKNLYDKVRMQLRDNAKEIGNGCFEFYHKCDDECMNSVKNGTYDYPKYEEESKLNRNEIKGXXXXXMGVYQILAIYATVAGSLSLAIMIAGISFWMCSNGSLQCRICI

SEQ ID NO: 418930 - protein, 569 aa, Influenza virus
  MOD_RES (16)..(21): Any amino acid
  MOD_RES (65)..(65): Any amino acid
  MOD_RES (94)..(94): Any amino acid
  MOD_RES (106)..(161): Any amino acid
  MOD_RES (171)..(182): Any amino acid
  MOD_RES (195)..(245): Any amino acid
  MOD_RES (255)..(259): Any amino acid
  MOD_RES (289)..(294): Any amino acid
  MOD_RES (330)..(331): Any amino acid
  MOD_RES (341)..(341): Any amino acid
  MOD_RES (353)..(356): Any amino acid
  MOD_RES (392)..(399): Any amino acid
  MOD_RES (409)..(412): Any amino acid
  MOD_RES (436)..(437): Any amino acid
  MOD_RES (523)..(527): Any amino acid
  MOD_RES (539)..(541): Any amino acid
  MOD_RES (564)..(569): Any amino acid
MDNQTKKMTITFLILXXXXXXGDQICVGYHSNNSTEKIDTILEQNVTVTHAKNILEKTHNGRLCXLSGIPPLELRDCSIAGWLLGNPKCDRLLXVPEWSYIMEKEXXXXXXXXXXXXXXXXXXXXXXXXXXXXXXXXXXXXXXXXXXXXXXXXXXXXXXXXSSFFRNMVWXXXXXXXXXXXXGSYNNTSGEQILXXXXXXXXXXXXXXXXXXXXXXXXXXXXXXXXXXXXXXXXXXXXXXXXXXXRMEFSWTILXXXXXISFESTGNLIAPEYGFRISKRGSSGVMKTXXXXXXCETRCQTPLGAINTTLPFHNVHPLTIGECPKYIKSXXLVLATGPRNXPQMESRGLFGAXXXXIEGGWQGMIDGWYGYHHSNDQGAGYAADKESTQRAXXXXXXXXNFVIEKMNTXXXXVGKEFSNLEKRLENLNKKVEDGFXXVWTYNVELLVLMENEMTLDFHDSNVRNLYDRVRMQLRDNVKELGNGCFEFYHKCNDECMNSVRNGTYDYSKYEEESKLKRNEIKGXXXXXMGIYQILAIYAXXXGSLSLAIMMAGISLWMCSNGSLXXXXXX

SEQ ID NO: 418931 - protein, 569 aa, Influenza virus
  MOD_RES (13)..(21): Any amino acid
  MOD_RES (82)..(82): Any amino acid
  MOD_RES (94)..(94): Any amino acid
  MOD_RES (106)..(161): Any amino acid
  MOD_RES (173)..(182): Any amino acid
  MOD_RES (195)..(245): Any amino acid
  MOD_RES (255)..(259): Any amino acid
  MOD_RES (289)..(294): Any amino acid
  MOD_RES (307)..(310): Any amino acid
  MOD_RES (330)..(331): Any amino acid
  MOD_RES (341)..(341): Any amino acid
  MOD_RES (355)..(377): Any amino acid
  MOD_RES (392)..(399): Any amino acid
  MOD_RES (409)..(412): Any amino acid
  MOD_RES (436)..(437): Any amino acid
  MOD_RES (523)..(527): Any amino acid
  MOD_RES (539)..(541): Any amino acid
  MOD_RES (564)..(569): Any amino acid
MDNKTKKMTITFXXXXXXXXXGDRICIGYHANNSTETVDTILEKNVTVTHAQDILEKVHNGKLCRLSGIPPLVLGDCSIAGXLLGNPECDILLXVPEWSYIIEKEXXXXXXXXXXXXXXXXXXXXXXXXXXXXXXXXXXXXXXXXXXXXXXXXXXXXXXXXPSFFRNMIWLTXXXXXXXXXXGSYNNTNGEQILXXXXXXXXXXXXXXXXXXXXXXXXXXXXXXXXXXXXXXXXXXXXXXXXXXXRMEFFWTLLXXXXXINFESNGNLIAPEYGFKISKRGGSGIMKTXXXXXXCETQCQTPLGAIXXXXPFHNIHPLAIGECPKYVRSXXLVLAAGLRNXPQIEPRGLFGAIAXXXXXXXXXXXXXXXXXXXXXXXGSGYAADKASTQKAXXXXXXXXNSVIEKINTXXXXVGKEFNSLERRLENLNKRMEDGFXXVWTYNAEVLVLMENERILDFHDSNVKSLYDKVRMQLKDNAKEVGNGCFEFYHKCDNECMDSVRNGTYNYPKYEEESRLNRNEIKGXXXXXMGVYQILVIYAXXXGSLSLAIMVAGISIWMCSNGSLXXXXXX

SEQ ID NO: 418932 - protein, 569 aa, Influenza virus
  MOD_RES (12)..(22): Any amino acid
  MOD_RES (41)..(43): Any amino acid
  MOD_RES (78)..(82): Any amino acid
  MOD_RES (94)..(95): Any amino acid
  MOD_RES (106)..(182): Any amino acid
  MOD_RES (195)..(260): Any amino acid
  MOD_RES (289)..(294): Any amino acid
  MOD_RES (310)..(331): Any amino acid
  MOD_RES (341)..(341): Any amino acid
  MOD_RES (353)..(399): Any amino acid
  MOD_RES (409)..(412): Any amino acid
  MOD_RES (434)..(437): Any amino acid
  MOD_RES (447)..(448): Any amino acid
  MOD_RES (486)..(488): Any amino acid
  MOD_RES (523)..(528): Any amino acid
  MOD_RES (538)..(545): Any amino acid
  MOD_RES (563)..(569): Any amino acid
MDKQTKTMTITXXXXXXXXXXXDQICIGYHSNNSTKKVDTXXXRNVTVTHAQNILERTHNGKLCRLRGIPPLELGNCXXXXXLLGNPECDLLLXXPEWSYIVEREXXXXXXXXXXXXXXXXXXXXXXXXXXXXXXXXXXXXXXXXXXXXXXXXXXXXXXXXXXXXXXXXXXXXXXXXXXXXXRSYNNTSGKQMLXXXXXXXXXXXXXXXXXXXXXXXXXXXXXXXXXXXXXXXXXXXXXXXXXXXXXXXXXXXXXXXXXXNFESTGNLVAPEYGFKISKRGNSGIMKTXXXXXXCETKCQSPLGAINTTXXXXXXXXXXXXXXXXXXXXXXLILATGLRNXPQTESRGLFGAXXXXXXXXXXXXXXXXXXXXXXXXXXXXXXXXXXXXXXXXXXXXXXXNSIIEKMNTXXXXVGKEFGNLEKRLGNLNKKMEDXXXXVWTYNTELLXXMENERTLDYHDSNVKNLYNKVRMQLRDNAKELGNGCFXXXHKCDDECMDSIRNGTYDYPKYEKESKLNRTEIKGXXXXXXGVYQVLAIYXXXXXXXXLAIMIAGIFLWMCSNGSXXXXXXX

SEQ ID NO: 418933 - protein, 569 aa, Influenza virus
  MOD_RES (1)..(22): Any amino acid
  MOD_RES (41)..(45): Any amino acid
  MOD_RES (78)..(83): Any amino acid
  MOD_RES (94)..(96): Any amino acid
  MOD_RES (106)..(182): Any amino acid
  MOD_RES (192)..(260): Any amino acid
  MOD_RES (270)..(277): Any amino acid
  MOD_RES (289)..(294): Any amino acid
  MOD_RES (315)..(331): Any amino acid
  MOD_RES (341)..(341): Any amino acid
  MOD_RES (355)..(399): Any amino acid
  MOD_RES (409)..(423): Any amino acid
  MOD_RES (436)..(449): Any amino acid
  MOD_RES (520)..(545): Any amino acid
  MOD_RES (563)..(569): Any amino acid
XXXXXXXXXXXXXXXXXXXXXXDQICVGYHANNSTERVDTXXXXXVTVTHAEDILEKAHNGKLCRLNGVPPLELGDCXXXXXXLGNPECDLFLXXXEWSYIMEKKXXXXXXXXXXXXXXXXXXXXXXXXXXXXXXXXXXXXXXXXXXXXXXXXXXXXXXXXXXXXXXXXXXXXXXXXXXXXXRSYNNTSGGXXXXXXXXXXXXXXXXXXXXXXXXXXXXXXXXXXXXXXXXXXXXXXXXXXXXXXXXXXXXXXXXXXXXXSFESTGNLVXXXXXXXXSKRGSSGIVKTXXXXXXCDTKCQTPLGALNTTLPFHNXXXXXXXXXXXXXXXXXLILATGVRNXPQIEARGLFGAIAXXXXXXXXXXXXXXXXXXXXXXXXXXXXXXXXXXXXXXXXXXXXXNSVIEKMNIXXXXXXXXXXXXXXXLENLSKRMEDGFXXXXXXXXXXXXXXENERTLGFHDSNVKNLYEKVRMQLRDNAKETGNGCFEFYHKCDDECMSSVKNGTYYYPKYEEESKLNRTEXXXXXXXXXXXXXXXXXXXXXXXXXXLAIMMAGIFFWMCSNGSXXXXXXX

SEQ ID NO: 418934 - protein, 569 aa, Influenza virus
  MOD_RES (1)..(48): Any amino acid
  MOD_RES (77)..(184): Any amino acid
  MOD_RES (195)..(424): Any amino acid
  MOD_RES (434)..(452): Any amino acid
  MOD_RES (463)..(469): Any amino acid
  MOD_RES (479)..(500): Any amino acid
  MOD_RES (523)..(569): Any amino acid
XXXXXXXXXXXXXXXXXXXXXXXXXXXXXXXXXXXXXXXXXXXXXXXXTHAQDILERTHNGKLCKLSGISPLELGDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYNNTSGEQVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXENLDKKMEDXXXXXXXXXXXXXXXXXXXRTLDFHDSSVXXXXXXXKMQLRDNAKXXXXXXXXXXXXXXXXXXXXXXNGTYNYSKYEEESKLNRSEIKGXXXXXXXXXXXXXXXXXXXXXXXXXXXXXXXXXXXXXXXXXXXXXXX

SEQ ID NO: 418935 - protein, 569 aa, Influenza virus
  MOD_RES (1)..(453): Any amino acid
  MOD_RES (465)..(569): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLEFHDSNVKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418936 - protein, 562 aa, Influenza virus
  MOD_RES (1)..(12): Any amino acid
  MOD_RES (101)..(102): Any amino acid
  MOD_RES (120)..(122): Any amino acid
  MOD_RES (136)..(154): Any amino acid
  MOD_RES (166)..(172): Any amino acid
  MOD_RES (199)..(203): Any amino acid
  MOD_RES (214)..(238): Any amino acid
  MOD_RES (248)..(249): Any amino acid
  MOD_RES (286)..(286): Any amino acid
  MOD_RES (386)..(391): Any amino acid
XXXXXXXXXXXXVRGDQICIGYHANNSTEKVDTILERNVTVTHAKDILEKTHNGKLCKLNGIPPLELGDCSIAGWLLGNPECDRLLSVPEWSYIMEKENPXXGLCYPGSFNDYEELKHLXXXVKHFEKVKILPKDXXXXXXXXXXXXXXXXXXXPSFFRNMVWLTXXXXXXXVAKGSYNNTSGEQMLIIWGVHHPNDEXXXXXLYQNVGTYVSXXXXXXXXXXXXXXXXXXXXXXXXXRMEFSWTLLXXWDTINFESTGNLIAPEYGFKISKRGSSGIMKTEGTLXNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFXXXXXXVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 418937 - protein, 562 aa, Influenza virus
  MOD_RES (1)..(12): Any amino acid
  MOD_RES (78)..(78): Any amino acid
  MOD_RES (101)..(102): Any amino acid
  MOD_RES (120)..(122): Any amino acid
  MOD_RES (136)..(154): Any amino acid
  MOD_RES (164)..(172): Any amino acid
  MOD_RES (199)..(203): Any amino acid
  MOD_RES (214)..(238): Any amino acid
  MOD_RES (248)..(249): Any amino acid
  MOD_RES (286)..(286): Any amino acid
  MOD_RES (346)..(349): Any amino acid
  MOD_RES (386)..(391): Any amino acid
  MOD_RES (561)..(562): Any amino acid
XXXXXXXXXXXXVKGDQICIGYHSNNSTEKIDTILERNVTVTHAQDILEKTHNGRLCKLSGIPPLELGDCSITGWLLXNPECDRLLRVPEWSYIVERENPXXSLCYPGSFNNYEELKHLXXXVTHFEKVKILARNXXXXXXXXXXXXXXXXXXXSSFFRNMVWXXXXXXXXXIAKRSYNNTSGEQVLVIWGIHHPNDDXXXXXLYQKVGTYVSXXXXXXXXXXXXXXXXXXXXXXXXXRMEFSWTILXXWDVINFESTGNLVAPEYGFKISRRGNSGIMKTEKTLXNCETKCQSPLGAINTTLPFHNIHPLTIGECPRYVKSEKLVLATGPRNVPQIEARGLFGAXXXXIEGGWQGMIDGWYGYHHSNDQGAGYAADKESTQRAFXXXXXXVNSIIEKMNTQFGAVGKEFNNLERRLENLSKRMEDGFIDVWTYNAELLVLMENEMTLDFHDSNVRNLYDKVRMQLKDNAKEIGNGCFEFYHKCNDECMNSVRNGTYDYPKYEKESKLNRNEIKGVELSSMGVYQILVIYATVAGSLSLAIMIAGISLWMCSNGSLQFRIXX

SEQ ID NO: 418938 - protein, 562 aa, Influenza virus
  MOD_RES (1)..(12): Any amino acid
  MOD_RES (67)..(67): Any amino acid
  MOD_RES (77)..(78): Any amino acid
  MOD_RES (101)..(102): Any amino acid
  MOD_RES (120)..(122): Any amino acid
  MOD_RES (136)..(154): Any amino acid
  MOD_RES (166)..(172): Any amino acid
  MOD_RES (199)..(203): Any amino acid
  MOD_RES (214)..(238): Any amino acid
  MOD_RES (248)..(249): Any amino acid
  MOD_RES (286)..(286): Any amino acid
  MOD_RES (343)..(370): Any amino acid
  MOD_RES (386)..(391): Any amino acid
  MOD_RES (437)..(440): Any amino acid
  MOD_RES (476)..(477): Any amino acid
  MOD_RES (529)..(534): Any amino acid
  MOD_RES (548)..(552): Any amino acid
XXXXXXXXXXXXVRGDQICVGYHSNNSTKKVDTNLERNVTVTHAKNILEKTHNGKLCRLSGIPPLEXGNCSIAGWLXXNPECDRLLTVPEWSYIIEKENPXXSLCYPGSLNDYEELKHFXXXVKHFEKVRILPKDXXXXXXXXXXXXXXXXXXXPSFFRNMIWLTXXXXXXXVAKRSYNNTNGEQILIIWGIHHPNDEXXXXXLYQEVGTYVSXXXXXXXXXXXXXXXXXXXXXXXXXRMEFFWTLLXXWDVISFESTGNLIAPEYGFRISKRGSSGVMKTEGTLXDCETKCQTPLGALNTTLPFHNVHPLAIGECPKYVRSEKLVLATGLRNIPQIESRGLXXXXXXXXXXXXXXXXXXXXXXXXXXXXGSGYAADKASTQKAIXXXXXXVNFVIEKMNTQSEAVGKEFGNLERRLENLNKRMEDGFLGVWTYNAXXXXLMENERILDFHDSNVKSLYDKVRMQLRDNAKEIGNXXFEFYHKCDNECMDSVKNGTYYYPKYEEESRLNRNEIKGVKLSNMGVYQILAXXXXXXGSLSLAIMVAGISXXXXXNGSLQCRVCI

SEQ ID NO: 418939 - protein, 562 aa, Influenza virus
  MOD_RES (1)..(12): Any amino acid
  MOD_RES (39)..(41): Any amino acid
  MOD_RES (69)..(78): Any amino acid
  MOD_RES (101)..(102): Any amino acid
  MOD_RES (120)..(122): Any amino acid
  MOD_RES (136)..(172): Any amino acid
  MOD_RES (199)..(203): Any amino acid
  MOD_RES (214)..(238): Any amino acid
  MOD_RES (248)..(249): Any amino acid
  MOD_RES (259)..(260): Any amino acid
  MOD_RES (286)..(286): Any amino acid
  MOD_RES (298)..(308): Any amino acid
  MOD_RES (346)..(376): Any amino acid
  MOD_RES (386)..(391): Any amino acid
  MOD_RES (439)..(442): Any amino acid
  MOD_RES (479)..(487): Any amino acid
  MOD_RES (532)..(538): Any amino acid
  MOD_RES (556)..(562): Any amino acid
XXXXXXXXXXXXVKGDRICIGYHANNSTETVDTILERNXXXTHAQDILERTHNGKLCRLRGIPPLELGXXXXXXXXXXNPECDRLLNVPEWSYIVEKENPXXSLCYPGNFNDYEELKLLXXXVRHFEKVKILPRDXXXXXXXXXXXXXXXXXXXXXXXXXXXXXXXXXXXXXVAQGSYNNTSGKQMLIIWGVHHPIDEXXXXXLYQNVETYVSXXXXXXXXXXXXXXXXXXXXXXXXXRMEFSWILLXXLDTINFESTXXLVVPEYGFKISKRGGSGIMKTERTLXNCDTKCQTPLGXXXXXXXXXXXHPLTMGECPKYVKSDRLVLATGLRNAHKMESRGLFGAXXXXXXXXXXXXXXXXXXXXXXXXXXXXXXXDKESTQKAIXXXXXXENSVIEKMNIQFEAVEKEFSNLEKRLENLNKKVEDGFLDVWTYNTELXXXXENERTLGFHDSNVKNLYNKVRMQLRDNAKELGNGCFXXXXXXXXXCMSSVKNGTYNYPKYEEESKLKRNEIKGVKLSNMGIYQILAIYAXXXXXXXLAIMIAGIFLWMCSNGSXXXXXXX

SEQ ID NO: 418940 - protein, 562 aa, Influenza virus
  MOD_RES (1)..(24): Any amino acid
  MOD_RES (39)..(42): Any amino acid
  MOD_RES (54)..(78): Any amino acid
  MOD_RES (88)..(90): Any amino acid
  MOD_RES (101)..(102): Any amino acid
  MOD_RES (120)..(122): Any amino acid
  MOD_RES (136)..(172): Any amino acid
  MOD_RES (199)..(249): Any amino acid
  MOD_RES (263)..(273): Any amino acid
  MOD_RES (286)..(286): Any amino acid
  MOD_RES (297)..(315): Any amino acid
  MOD_RES (345)..(376): Any amino acid
  MOD_RES (386)..(391): Any amino acid
  MOD_RES (438)..(445): Any amino acid
  MOD_RES (469)..(487): Any amino acid
  MOD_RES (529)..(538): Any amino acid
  MOD_RES (556)..(562): Any amino acid
XXXXXXXXXXXXXXXXXXXXXXXXNNSTEMVDTILERNXXXXHAQNILEKTHNXXXXXXXXXXXXXXXXXXXXXXXXXNPECDRFLSXXXWSYIVERETPXXNLCYPGSLNDYEELKYLXXXVTHFEKIKILPRDXXXXXXXXXXXXXXXXXXXXXXXXXXXXXXXXXXXXXVARGSYNNTSGEQMLVIWGVHHPKDEXXXXXXXXXXXXXXXXXXXXXXXXXXXXXXXXXXXXXXXXXXXXXXXXXXXWDTISFESTGNLVXXXXXXXXXXXGSSGIMKTGGTLXNCETQCQTPLXXXXXXXXXXXXXXXXXXXCPKYVKSERLVLATGLRNVPQMESRGLFGXXXXXXXXXXXXXXXXXXXXXXXXXXXXXXXXDKESTQKAVXXXXXXVNSVIEKINTQFESVGKEFSNLEKRLENLDKKMEDGFRDVWTYNAEXXXXXXXXRTLDFHDSSVKNLYEKVRMQLRDXXXXXXXXXXXXXXXXXXXCMNSVKTGTYDYPKYEEESKLNKNEIKGVKLSSMGIYQILAXXXXXXXXXXLAIMMAGIFFWMCSNGSXXXXXXX

SEQ ID NO: 418941 - protein, 562 aa, Influenza virus
  MOD_RES (1)..(29): Any amino acid
  MOD_RES (39)..(42): Any amino acid
  MOD_RES (59)..(85): Any amino acid
  MOD_RES (95)..(109): Any amino acid
  MOD_RES (119)..(173): Any amino acid
  MOD_RES (185)..(288): Any amino acid
  MOD_RES (299)..(315): Any amino acid
  MOD_RES (332)..(332): Any amino acid
  MOD_RES (348)..(407): Any amino acid
  MOD_RES (420)..(424): Any amino acid
  MOD_RES (437)..(451): Any amino acid
  MOD_RES (461)..(490): Any amino acid
  MOD_RES (502)..(508): Any amino acid
  MOD_RES (518)..(519): Any amino acid
  MOD_RES (534)..(562): Any amino acid
XXXXXXXXXXXXXXXXXXXXXXXXXXXXXKADTILERNXXXXHAKDILEKAHNGKLCRXXXXXXXXXXXXXXXXXXXXXXXXXXXLIVPEWSYIXXXXXXXXXXXXXXXFNDYEELKYXXXXXXXXXXXXXXXXXXXXXXXXXXXXXXXXXXXXXXXXXXXXXXXXXXXXXXXAKGSYNNTNGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEIKCQTPLGAXXXXXXXXXXXXXXXXXCPKYVKSKRLVLATGLXNVPQIEPRGLFGAIAXXXXXXXXXXXXXXXXXXXXXXXXXXXXXXXXXXXXXXXXXXXXXXXXXXXXXXXXXXXXKEFNNLEKRLENXXXXXEDGLLDVWTYNAXXXXXXXXXXXXXXXDSNVKNLYEXXXXXXXXXXXXXXXXXXXXXXXXXXXXXXSVRNGTYNYPKXXXXXXXKRNEIKGVEXXNMGVYQVLAIYATVXXXXXXXXXXXXXXXXXXXXXXXXXXXXX

SEQ ID NO: 418942 - protein, 562 aa, Influenza virus
  MOD_RES (1)..(321): Any amino acid
  MOD_RES (331)..(413): Any amino acid
  MOD_RES (427)..(459): Any amino acid
  MOD_RES (469)..(493): Any amino acid
  MOD_RES (509)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDRLVLAIGXXXXXXXXXXXXXXXXXXXXXXXXXXXXXXXXXXXXXXXXXXXXXXXXXXXXXXXXXXXXXXXXXXXXXXXXXXXXXXXXXXXEKRLGNLNKKMEDXXXXXXXXXXXXXXXXXXXXXXXXXXXXXXXXXDRVRMQLRDXXXXXXXXXXXXXXXXXXXXXXXXXNGTYDYSKYEEESKLXXXXXXXXXXXXXXXXXXXXXXXXXXXXXXXXXXXXXXXXXXXXXXXXXXXXXX

SEQ ID NO: 418943 - protein, 469 aa, Influenza virus
  MOD_RES (17)..(24): Any amino acid
  MOD_RES (44)..(51): Any amino acid
  MOD_RES (62)..(62): Any amino acid
  MOD_RES (73)..(83): Any amino acid
  MOD_RES (210)..(212): Any amino acid
  MOD_RES (386)..(399): Any amino acid
MNPNQKIITIGSVSLTXXXXXXXXQIAILATTVTLHFKQHECDXXXXXXXXPCEPIIIERNXTEIVYLNNTTXXXXXXXXXXXYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGXXXDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDLRSGYETFKVIGGWSTXXXXXXXXXXXXXXNNNWSGYSGIFSVEGKSCINRCFYVELIRGRPQETRVWWTSNSIVVFCGTSGTYGTGSWPDGANINFMPI

SEQ ID NO: 418944 - protein, 469 aa, Influenza virus
  MOD_RES (17)..(24): Any amino acid
  MOD_RES (44)..(51): Any amino acid
  MOD_RES (62)..(62): Any amino acid
  MOD_RES (73)..(83): Any amino acid
  MOD_RES (102)..(102): Any amino acid
  MOD_RES (210)..(212): Any amino acid
  MOD_RES (386)..(399): Any amino acid
  MOD_RES (453)..(454): Any amino acid
MNPNQKTITIGSVSLIXXXXXXXXQIAILVTTVTLHFKQNECSXXXXXXXXPCEPIIVERNXTEIVYLNDTIXXXXXXXXXXXYRSWSKPQCKITGFAPFSXDNSIRLSASGDIWVTREPYVSCSPSKCYQFALGQGATLDNKHSNDTIHDRTPHRTLLMNELGVSFHLGTKQVCIAWSSSSCHDGRAWLHVCVTGDDKNATASFIYNGXXXDSIVSWSQNILRTHESECVCISGTCAVVMTDGSASGKADTRILFIEEGKIIHISPLSGSAQHVEECSCYPRYPGVRCICRDNWRGSNRPVVDINMADYSIDSSYICSGLVGDTPRNGDSSSNSNCRNPNNERGNQGVKGWAFDSGNDVWMGRTINKDSRSGYETFKVIGGWTTXXXXXXXXXXXXXXSDNRSGYSGIFSVENKGCINRCFYVELIRGRKQETRVWWTSNSIAVFCGTSGTXXTGSWPDGADINFMPI

SEQ ID NO: 418945 - protein, 469 aa, Influenza virus
  MOD_RES (1)..(2): Any amino acid
  MOD_RES (17)..(24): Any amino acid
  MOD_RES (44)..(51): Any amino acid
  MOD_RES (62)..(62): Any amino acid
  MOD_RES (73)..(83): Any amino acid
  MOD_RES (98)..(102): Any amino acid
  MOD_RES (126)..(126): Any amino acid
  MOD_RES (162)..(163): Any amino acid
  MOD_RES (181)..(183): Any amino acid
  MOD_RES (210)..(212): Any amino acid
  MOD_RES (224)..(224): Any amino acid
  MOD_RES (318)..(320): Any amino acid
  MOD_RES (386)..(399): Any amino acid
  MOD_RES (450)..(456): Any amino acid
XXSNQKIITIGSASLTXXXXXXXXQIAILAATVTLHFKQHKCDXXXXXXXXPCEPIIIEKNXTEIVYLNSTTXXXXXXXXXXXYRDWSKPQCQIAGFXXXXXDNSIRLSADGDIWVTREPYVSCGXVKCYQFALGQGTTLNNKHSNGTIHDRSPHRTLLMNXXGVPFHLGTRQVCIAWSSXXXHDGKAWLHICVTGDDRNATASLIYDGXXXDSVGSWSQNILXTQESECICINGSCTVVMTDGSASGRADTKILFIEEGKVVHISPLAGSAQHVEECSCYSRYPNVRCVCRDNWKGSNRPIIDINIAEYSIDSSYVXXXLVGDTPRSDDSSSSSNCRDPNNEKGNQGVKGWAFDDGSDVWMGRTIGRDSRSGYETFRVIGGWATXXXXXXXXXXXXXXSNNWSGYSGIFSVEHKRCINRCFYVELIRGRQQETRVWWTSNSIVVFVAPXXXXXXXSWPDGANIDFMPV

SEQ ID NO: 418946 - protein, 469 aa, Influenza virus
  MOD_RES (1)..(2): Any amino acid
  MOD_RES (16)..(24): Any amino acid
  MOD_RES (42)..(51): Any amino acid
  MOD_RES (62)..(62): Any amino acid
  MOD_RES (73)..(86): Any amino acid
  MOD_RES (99)..(106): Any amino acid
  MOD_RES (158)..(167): Any amino acid
  MOD_RES (181)..(185): Any amino acid
  MOD_RES (209)..(212): Any amino acid
  MOD_RES (245)..(248): Any amino acid
  MOD_RES (331)..(332): Any amino acid
  MOD_RES (381)..(399): Any amino acid
  MOD_RES (410)..(414): Any amino acid
  MOD_RES (449)..(456): Any amino acid
XXPNQKIITMGSVSLXXXXXXXXXQIAILATTITLHFKQNEXXXXXXXXXXPCEPTIIERNXTEIMYLNNTTXXXXXXXXXXXXXXWSKTQCQITGFAXXXXXXXXRLSGGGDIWVTREPYVSCDTNKCYQFALGQGTTLENKHSNGTKHDRIPHRTXXXXXXXXXXHLGTRQVCVAWSSXXXXXGKAWLHVCITGDDKNATASFVYDXXXXDSIGSWSHNILRTQESECVCISGICTVVMTDGXXXXKADTRILFVKEGKIVHIGPLSGSAQHIEECSCYPQYPDVRCVCRDNWRGSNRPVLDISMEDYSIDSNYVCSGLVGDTPRNNDXXSNSNCKDPNNERGTQGVKGWAFDYGNDLWMGRTISKESRSGYETFRVTXXXXXXXXXXXXXXXXXXXSNNRSGYSGIXXXXXKSCVNRCFYVELIRGRSQETRVWWTSSSIVVFCGXXXXXXXXSWPDGANISFMPI

SEQ ID NO: 418947 - protein, 469 aa, Influenza virus
  MOD_RES (1)..(3): Any amino acid
  MOD_RES (17)..(24): Any amino acid
  MOD_RES (44)..(62): Any amino acid
  MOD_RES (73)..(87): Any amino acid
  MOD_RES (102)..(107): Any amino acid
  MOD_RES (136)..(140): Any amino acid
  MOD_RES (158)..(167): Any amino acid
  MOD_RES (185)..(192): Any amino acid
  MOD_RES (208)..(227): Any amino acid
  MOD_RES (240)..(249): Any amino acid
  MOD_RES (274)..(277): Any amino acid
  MOD_RES (296)..(296): Any amino acid
  MOD_RES (354)..(356): Any amino acid
  MOD_RES (367)..(375): Any amino acid
  MOD_RES (386)..(399): Any amino acid
  MOD_RES (409)..(414): Any amino acid
  MOD_RES (443)..(457): Any amino acid
XXXNQKIITIDSVSLTXXXXXXXXHIAILVTTVTLHFKQHDCDXXXXXXXXXXXXXXXXXXXKEIVYLNNTIXXXXXXXXXXXXXXXSKPQCHITGFAPFSXXXXXXLSAGGDIWITREPYVSCDSDKCYQFALGXXXXXDNKHSNDTVHDRIPHRTXXXXXXXXXXHLGTKQVCAAWSSSSCHXXXXXXXXCITGDDRNATASFVYXXXXXXXXXXXXXXXXXXXXSECVCINGSCTVXXXXXXXXXXADTRILFIREGKIVHVSPLSGSAQXXXXCSCYPRYPNVRCICKDNWXGSNRPIVDINMVDYSIDSGYVCSGLVGDTPRNDDRSSSSNCRNPNNEKGYPGVKGWAXXXGDDVLMGRTIXXXXXXXXXTFRVIGGWTTXXXXXXXXXXXXXXKNNWSGYSGXXXXXXKNCINRCFYVELIRGMPQEARVWWTSNSXXXXXXXXXXXXXXXWPDGANINLMPI

SEQ ID NO: 418948 - protein, 469 aa, Influenza virus
  MOD_RES (1)..(7): Any amino acid
  MOD_RES (17)..(34): Any amino acid
  MOD_RES (44)..(110): Any amino acid
  MOD_RES (127)..(192): Any amino acid
  MOD_RES (210)..(227): Any amino acid
  MOD_RES (243)..(282): Any amino acid
  MOD_RES (292)..(304): Any amino acid
  MOD_RES (314)..(323): Any amino acid
  MOD_RES (334)..(339): Any amino acid
  MOD_RES (353)..(358): Any amino acid
  MOD_RES (368)..(375): Any amino acid
  MOD_RES (386)..(423): Any amino acid
  MOD_RES (433)..(457): Any amino acid
  MOD_RES (467)..(469): Any amino acid
XXXXXXXITIGFVSLIXXXXXXXXXXXXXXXXXXLHFKQHECNXXXXXXXXXXXXXXXXXXXXXXXXXXXXXXXXXXXXXXXXXXXXXXXXXXXXXXXXXXXXXXXXXXXGGDIWVMREPYVSCNPXXXXXXXXXXXXXXXXXXXXXXXXXXXXXXXXXXXXXXXXXXXXXXXXXXXXXXXXXXXXXXXXXXCVTGYEKNATASFIYEGXXXXXXXXXXXXXXXXXXSECVCINGICTVVMTXXXXXXXXXXXXXXXXXXXXXXXXXXXXXXXXXXXXXXXXRYPDVRCVCXXXXXXXXXXXXXISMEDYSIGXXXXXXXXXXDTPRNDDRFSXXXXXXPNNERGYPGVKGWXXXXXXDLWMGTTISXXXXXXXXTFRVIGGWVTXXXXXXXXXXXXXXXXXXXXXXXXXXXXXXXXXXXXXXVELIRGRRQXXXXXXXXXXXXXXXXXXXXXXXXXWPDGANTNFXXX

SEQ ID NO: 418949 - protein, 469 aa, Influenza virus
  MOD_RES (1)..(196): Any amino acid
  MOD_RES (210)..(282): Any amino acid
  MOD_RES (299)..(341): Any amino acid
  MOD_RES (355)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDDENATASFIYGGXXXXXXXXXXXXXXXXXXXXXXXXXXXXXXXXXXXXXXXXXXXXXXXXXXXXXXXXXXXXXXXXXXXXXXXXXRYPDVRCTCRDNWKGSXXXXXXXXXXXXXXXXXXXXXXXXXXXXXXXXXXXXXXXXXXXNERGNHGVKGWAFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418950 - protein, 469 aa, Influenza virus
  MOD_RES (1)..(285): Any amino acid
  MOD_RES (295)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDVRCICKDNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418951 - protein, 580 aa, Influenza virus
  MOD_RES (23)..(29): Any amino acid
  MOD_RES (51)..(57): Any amino acid
  MOD_RES (72)..(86): Any amino acid
  MOD_RES (105)..(133): Any amino acid
  MOD_RES (148)..(172): Any amino acid
  MOD_RES (183)..(200): Any amino acid
  MOD_RES (213)..(259): Any amino acid
  MOD_RES (269)..(273): Any amino acid
  MOD_RES (287)..(291): Any amino acid
  MOD_RES (301)..(306): Any amino acid
  MOD_RES (332)..(340): Any amino acid
  MOD_RES (386)..(386): Any amino acid
  MOD_RES (408)..(414): Any amino acid
  MOD_RES (508)..(509): Any amino acid
  MOD_RES (519)..(520): Any amino acid
  MOD_RES (530)..(539): Any amino acid
  MOD_RES (559)..(561): Any amino acid
MLSLIMRTVIALSRFSYVFCLAXXXXXXXNNNNNTATLLCLGHHAVPNGTXXXXXXXDQIEVTNATELVQSXXXXXXXXXXXXXXXWEKNCTLIDALLGDPHCDXXXXXXXXXXXXXXXXXXXXXXXXXXXXXSLRSLVASSGTLEFXXXXXXXXXXXXXXXXXXXXXXXXXSFFSRLNWLTXXXXXXXXXXXXXXXXXXFDKLYIWGVHHPXXXXXXXXXXXXXXXXXXXXXXXXXXXXXXXXXXXXXXXXXXXXXXXYWTIVKPGDXXXXXSTGNLIAPRGYFKXXXXXLNNEIRWPPXXXXXXSECITPNGSIPNDKPFQNVNRITYGXXXXXXXXXTLKLATGMRNVPEKQTRGIFGAIAGFIENGWEGMVDGWYGFRHQNXNSEGTGQAADLKSTQAAIDQIXXXXXXXIGKTNEKFHQIEKEFSEVEGRIQDLEKYVEDTKIDLWSYNAELLVALENQHTIDLTDSEMNKLFEKTKKQLRENAEDMGNGCFKIYHKCDNACXXSIRNGTYDHXXYRDEALNNRXXXXXXXXXXGYKDWILWISFAISCFLLCXXXLGFIMWACQKGNIRCNICI

SEQ ID NO: 418952 - protein, 580 aa, Influenza virus
  MOD_RES (1)..(3): Any amino acid
  MOD_RES (23)..(32): Any amino acid
  MOD_RES (51)..(57): Any amino acid
  MOD_RES (72)..(90): Any amino acid
  MOD_RES (105)..(133): Any amino acid
  MOD_RES (148)..(172): Any amino acid
  MOD_RES (183)..(200): Any amino acid
  MOD_RES (213)..(259): Any amino acid
  MOD_RES (269)..(273): Any amino acid
  MOD_RES (287)..(306): Any amino acid
  MOD_RES (332)..(342): Any amino acid
  MOD_RES (385)..(386): Any amino acid
  MOD_RES (408)..(414): Any amino acid
  MOD_RES (508)..(509): Any amino acid
  MOD_RES (519)..(520): Any amino acid
  MOD_RES (530)..(539): Any amino acid
  MOD_RES (559)..(561): Any amino acid
  MOD_RES (580)..(580): Any amino acid
XXXHSMSGFRSNLVLSCIFCLAXXXXXXXXXXNNSTATLCLGHHAVANGTXXXXXXXDHIEVTNATELVQNXXXXXXXXXXXXXXXXXXXCTLMDALLGDPQCDXXXXXXXXXXXXXXXXXXXXXXXXXXXXXSLRSLIASSGTLEFXXXXXXXXXXXXXXXXXXXXXXXXXGFFSRLNWLHXXXXXXXXXXXXXXXXXXFDKLYVWGVHHPXXXXXXXXXXXXXXXXXXXXXXXXXXXXXXXXXXXXXXXXXXXXXXXYWTVVKPGDXXXXXSNGNLIAPRGYFRXXXXXXXXXXXXXXXXXXXXSACITPNGSISNDKPFQNVNKITYGXXXXXXXXXXXKLATGMRNIPEKQTRGLFGAIAGFIENGWEGMIDGWYGFRHHXXNSEGIGQAADLKSTQTAIDQIXXXXXXXIEKTNEKFHQIEKEFSEIEGRIQDLERYVEDTKIDLWSYNAGLLVALENQNTIDLTDSEMSKLFEKTRRQLRENAEDIGNGCFTIYHKCDNSCXXSIRNGTYNHXXYRDEAVNNRXXXXXXXXXXGYKDWVLWISFAISCFLICXXXLGFIVWACQRGNIRCNICX

SEQ ID NO: 418953 - protein, 580 aa, Influenza virus
  MOD_RES (1)..(10): Any amino acid
  MOD_RES (21)..(35): Any amino acid
  MOD_RES (51)..(57): Any amino acid
  MOD_RES (72)..(90): Any amino acid
  MOD_RES (105)..(133): Any amino acid
  MOD_RES (147)..(172): Any amino acid
  MOD_RES (183)..(200): Any amino acid
  MOD_RES (213)..(259): Any amino acid
  MOD_RES (269)..(273): Any amino acid
  MOD_RES (287)..(306): Any amino acid
  MOD_RES (332)..(345): Any amino acid
  MOD_RES (365)..(366): Any amino acid
  MOD_RES (384)..(386): Any amino acid
  MOD_RES (408)..(414): Any amino acid
  MOD_RES (426)..(428): Any amino acid
  MOD_RES (439)..(439): Any amino acid
  MOD_RES (506)..(509): Any amino acid
  MOD_RES (519)..(520): Any amino acid
  MOD_RES (530)..(539): Any amino acid
  MOD_RES (559)..(561): Any amino acid
XXXXXXXXXXIFIFILLTHWXXXXXXXXXXXXXXXMATLCLGHHAVQNGTXXXXXXXDQVEVTNATELVQIXXXXXXXXXXXXXXXXXXXCTLIDAMLGDPHCDXXXXXXXXXXXXXXXXXXXXXXXXXXXXXSLRSIVASSGTLEXXXXXXXXXXXXXXXXXXXXXXXXXXGFFRRLNWLTXXXXXXXXXXXXXXXXXXFDKLYIWGIHHPXXXXXXXXXXXXXXXXXXXXXXXXXXXXXXXXXXXXXXXXXXXXXXXYWTIVKSGDXXXXXSNGNLVAPRGYFKXXXXXXXXXXXXXXXXXXXXSGCITPNGSIPNEKPFQNVNKVTYGXXXXXXXXXXXXXXTGMRNVPERQIRGIFGAIAXXIENGWEGMMDGWYGFRHXXXNSEGRGQAADLKSTQAAINQIXXXXXXXIERTNEKFHQIXXXFTEVEGRIQDXEKYVEDTKVDLWSYNAEFLVALENQHTIHLTDSEMNKLFERTRKQLRENAEDMGGGCFKIYHRCDNXXXXSIRTGTYDHXXYRNEALNNRXXXXXXXXXXEYKDWILWISFATSCFLLCXXXLGFIMWTCQKGNIKCNICI

SEQ ID NO: 418954 - protein, 580 aa, Influenza virus
  MOD_RES (1)..(10): Any amino acid
  MOD_RES (21)..(35): Any amino acid
  MOD_RES (50)..(57): Any amino acid
  MOD_RES (72)..(90): Any amino acid
  MOD_RES (102)..(133): Any amino acid
  MOD_RES (148)..(172): Any amino acid
  MOD_RES (182)..(200): Any amino acid
  MOD_RES (210)..(259): Any amino acid
  MOD_RES (269)..(273): Any amino acid
  MOD_RES (283)..(306): Any amino acid
  MOD_RES (327)..(345): Any amino acid
  MOD_RES (366)..(367): Any amino acid
  MOD_RES (385)..(386): Any amino acid
  MOD_RES (408)..(414): Any amino acid
  MOD_RES (425)..(450): Any amino acid
  MOD_RES (479)..(481): Any amino acid
  MOD_RES (508)..(509): Any amino acid
  MOD_RES (519)..(520): Any amino acid
  MOD_RES (530)..(539): Any amino acid
  MOD_RES (559)..(561): Any amino acid
  MOD_RES (577)..(580): Any amino acid
XXXXXXXXXXIFNFILLTHWXXXXXXXXXXXXXXXAATLCLGHHAVSNGXXXXXXXXDRIEVTNATELVQGXXXXXXXXXXXXXXXXXXXCTLVDALLGDPXXXXXXXXXXXXXXXXXXXXXXXXXXXXXXXXTLRSLVASSGNLEFXXXXXXXXXXXXXXXXXXXXXXXXXSFFSKLNWLXXXXXXXXXXXXXXXXXXXSDKLYIWGVXXXXXXXXXXXXXXXXXXXXXXXXXXXXXXXXXXXXXXXXXXXXXXXXXXHWTIVKPGDXXXXXCTGNLIAPRXXXXXXXXXXXXXXXXXXXXXXXXFECITPNGSIPNNKPFQNVNXXXXXXXXXXXXXXXXXXXTGMRNVPETQTKGLFGAIAGXXENGWEGMVNGWYGFRHQXXNSEGMGQAADLKSTQAAVNQIXXXXXXXIKKTNEKFHQXXXXXXXXXXXXXXXXXXXXXXXXXXWSYNADVLVALENQHTIDLADSEMNKLFXXXKRQLRENAEDMGDGCFKIYHKCDNTCXXSIRNETYDHXXYRDEALSNRXXXXXXXXXXGYKNWILWISFAMSCFLLCXXXLGFVMWACQKGNIKCXXXX

SEQ ID NO: 418955 - protein, 580 aa, Influenza virus
  MOD_RES (1)..(10): Any amino acid
  MOD_RES (21)..(35): Any amino acid
  MOD_RES (45)..(57): Any amino acid
  MOD_RES (67)..(95): Any amino acid
  MOD_RES (105)..(136): Any amino acid
  MOD_RES (148)..(173): Any amino acid
  MOD_RES (183)..(200): Any amino acid
  MOD_RES (211)..(310): Any amino acid
  MOD_RES (327)..(345): Any amino acid
  MOD_RES (365)..(374): Any amino acid
  MOD_RES (386)..(395): Any amino acid
  MOD_RES (406)..(414): Any amino acid
  MOD_RES (424)..(463): Any amino acid
  MOD_RES (480)..(488): Any amino acid
  MOD_RES (508)..(539): Any amino acid
  MOD_RES (559)..(562): Any amino acid
XXXXXXXXXXIFIFLLLTHWXXXXXXXXXXXXXXXTAMLCLGHHXXXXXXXXXXXXXDNIEVTNATXXXXXXXXXXXXXXXXXXXXXXXXXXXXXSLLGDPHCDXXXXXXXXXXXXXXXXXXXXXXXXXXXXXXXXSIVASSGTVEFXXXXXXXXXXXXXXXXXXXXXXXXXXFFSRLNWLYXXXXXXXXXXXXXXXXXXFDKLYVWGIHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPNGSIPNGKPFQNVNXXXXXXXXXXXXXXXXXXXTGMRNIPERQTRGLFGAKAXXXXXXXXXXVDGWYGFRYQNXXXXXXXXXXDFKSTQAAINXXXXXXXXXVEKTNEKFHXXXXXXXXXXXXXXXXXXXXXXXXXXXXXXXXXXXXXXXXQHTIDLTDAEMNKLFEXXXXXXXXXAEDMGNGCLKIYHKCDNVCXXXXXXXXXXXXXXXXXXXXXXXXXXXXXXXXGYKDWFLWISFAISCLLLCXXXXGFIMWACQRGNIRCDICI

SEQ ID NO: 418956 - protein, 580 aa, Influenza virus
  MOD_RES (1)..(173): Any amino acid
  MOD_RES (183)..(377): Any amino acid
  MOD_RES (388)..(398): Any amino acid
  MOD_RES (408)..(468): Any amino acid
  MOD_RES (478)..(495): Any amino acid
  MOD_RES (506)..(568): Any amino acid
  MOD_RES (580)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFFARLNWLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRLVRFRHQNXXXXXXXXXXXSTQAAIDQVXXXXXXXXXXXXXXXXXXXXXXXXXXXXXXXXXXXXXXXXXXXXXXXXXXXXXXXXXXXXXMTDSEMNKLXXXXXXXXXXXXXXXXXXCFRIYHKCDNXXXXXXXXXXXXXXXXXXXXXXXXXXXXXXXXXXXXXXXXXXXXXXXXXXXXXXXXXXXXXXXCQKGNIRCDICX

SEQ ID NO: 418957 - protein, 580 aa, Influenza virus
  MOD_RES (1)..(379): Any amino acid
  MOD_RES (391)..(472): Any amino acid
  MOD_RES (482)..(498): Any amino acid
  MOD_RES (508)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHQNSEGXXXXXXXXXXXXXXXXXXXXXXXXXXXXXXXXXXXXXXXXXXXXXXXXXXXXXXXXXXXXXXXXXXXXXXXXXXXXXXXXXXEMSKLFERTXXXXXXXXXXXXXXXXXIYHKCNNACXXXXXXXXXXXXXXXXXXXXXXXXXXXXXXXXXXXXXXXXXXXXXXXXXXXXXXXXXXXXXXXXXXXXXXXXX

SEQ ID NO: 418958 - protein, 580 aa, Influenza virus
  MOD_RES (1)..(379): Any amino acid
  MOD_RES (391)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRYQNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418959 - protein, 580 aa, Influenza virus
  MOD_RES (1)..(379): Any amino acid
  MOD_RES (391)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHHNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418960 - protein, 580 aa, Influenza virus
  MOD_RES (1)..(379): Any amino acid
  MOD_RES (391)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHLNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418961 - protein, 574 aa, Influenza virus
  MOD_RES (11)..(23): Any amino acid
  MOD_RES (51)..(51): Any amino acid
  MOD_RES (66)..(82): Any amino acid
  MOD_RES (99)..(117): Any amino acid
  MOD_RES (127)..(127): Any amino acid
  MOD_RES (142)..(166): Any amino acid
  MOD_RES (177)..(194): Any amino acid
  MOD_RES (207)..(251): Any amino acid
  MOD_RES (263)..(267): Any amino acid
  MOD_RES (282)..(285): Any amino acid
  MOD_RES (295)..(300): Any amino acid
  MOD_RES (380)..(380): Any amino acid
  MOD_RES (402)..(408): Any amino acid
  MOD_RES (514)..(514): Any amino acid
  MOD_RES (528)..(533): Any amino acid
  MOD_RES (553)..(555): Any amino acid
HSMSGFRSNLXXXXXXXXXXXXXNNNNNTATLLCLGHHAVPNGTIVKTITXDQIEVTNATELVQSXXXXXXXXXXXXXXXXXKNCTLIDALLGDPQCDXXXXXXXXXXXXXXXXXXXCYPYDVPDYXSLRSLVASSGTLEFXXXXXXXXXXXXXXXXXXXXXXXXXSFFSRLNWLTXXXXXXXXXXXXXXXXXXFDKLYIWGVHHPXXXXXXXXXXXXXXXXXXXXXXXXXXXXXXXXXXXXXXXXXXXXXSIYWTIVKPGDXXXXXSTGNLIAPRGYFKIXXXXLNNEIRWPPXXXXXXSECITPNGSIPNDKPFQNVNRITYGACPRYVKQNTLKLATGMRNVPEKQTRGIFGAIAGFIENGWEGMVDGWYGFRHQNXNSEGTGQAADLKSTQAAINQIXXXXXXXIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDXYRDEALNNRFQIKXXXXXXGYKDWILWISFAISCFLLCXXXLGFIMWACQKGNIRCNICI

SEQ ID NO: 418962 - protein, 574 aa, Influenza virus
  MOD_RES (1)..(1): Any amino acid
  MOD_RES (11)..(26): Any amino acid
  MOD_RES (51)..(51): Any amino acid
  MOD_RES (66)..(84): Any amino acid
  MOD_RES (99)..(117): Any amino acid
  MOD_RES (127)..(127): Any amino acid
  MOD_RES (142)..(166): Any amino acid
  MOD_RES (177)..(194): Any amino acid
  MOD_RES (207)..(251): Any amino acid
  MOD_RES (263)..(267): Any amino acid
  MOD_RES (282)..(300): Any amino acid
  MOD_RES (380)..(380): Any amino acid
  MOD_RES (402)..(408): Any amino acid
  MOD_RES (419)..(420): Any amino acid
  MOD_RES (500)..(500): Any amino acid
  MOD_RES (514)..(514): Any amino acid
  MOD_RES (528)..(533): Any amino acid
  MOD_RES (548)..(555): Any amino acid
  MOD_RES (574)..(574): Any amino acid
XMKTIIIVLSXXXXXXXXXXXXXXXXNNSTATLCLGHHAVPNGTLVKTITXDHIEVTNATELVQNXXXXXXXXXXXXXXXXXXXCTLMDALLGDPHCDXXXXXXXXXXXXXXXXXXXCYPYYVPDYXSLRSLIASSGTLEFXXXXXXXXXXXXXXXXXXXXXXXXXGFFSRLNWLHXXXXXXXXXXXXXXXXXXFDKLYVWGVHHPXXXXXXXXXXXXXXXXXXXXXXXXXXXXXXXXXXXXXXXXXXXXXSVYWTVVKPGDXXXXXSNGNLIAPRGYYKMXXXXXXXXXXXXXXXXXXXSACITPNGSISNDKPFQNVNKITYGACPKYVKQSTLKLATGMRNIPEKQTRGLFGAIAGFIENGWEGMMDGWYGFRHHNXNSEGIGQAADLKSTQAAVNQIXXXXXXXIEKTNEKFHQXXKEFTEVEGRIQDLERYVEDTKIDLWSYNAGLLVALENQNTIDLTDSEMSKLFERTRKQLRENAEEMGNGCFKIYHKCNNXCIESIRNGTYDHNXYRDEAVNNRFQIKXXXXXXGYKDWVLWISFAISXXXXXXXXLGFIVWACQRGNIRCNICX

SEQ ID NO: 418963 - protein, 574 aa, Influenza virus
  MOD_RES (1)..(29): Any amino acid
  MOD_RES (51)..(51): Any amino acid
  MOD_RES (66)..(84): Any amino acid
  MOD_RES (97)..(117): Any amino acid
  MOD_RES (127)..(127): Any amino acid
  MOD_RES (141)..(166): Any amino acid
  MOD_RES (177)..(194): Any amino acid
  MOD_RES (204)..(251): Any amino acid
  MOD_RES (263)..(267): Any amino acid
  MOD_RES (281)..(300): Any amino acid
  MOD_RES (357)..(360): Any amino acid
  MOD_RES (388)..(390): Any amino acid
  MOD_RES (402)..(408): Any amino acid
  MOD_RES (419)..(433): Any amino acid
  MOD_RES (514)..(514): Any amino acid
  MOD_RES (526)..(533): Any amino acid
  MOD_RES (553)..(555): Any amino acid
XXXXXXXXXXXXXXXXXXXXXXXXXXXXXMATLCLGHHAVPNGTVVKTITXDQVEVTNATELVQIXXXXXXXXXXXXXXXXXXXCTLVDALLGDPHXXXXXXXXXXXXXXXXXXXXXCYPYDVPDHXSLRSIVASSGTLEXXXXXXXXXXXXXXXXXXXXXXXXXXGFFRRLNWLTXXXXXXXXXXXXXXXXXXSDKLYIWGVXXXXXXXXXXXXXXXXXXXXXXXXXXXXXXXXXXXXXXXXXXXXXXXXSIHWTIVKPGDXXXXXCTGNLIAPRGYFRXXXXXXXXXXXXXXXXXXXXSGCITPNGSIPNEKPFQNVNKITYGPCPRYVKQKTLKLATGMRNVPETQTRGIFGAXXXXIENGWEGMIDGWYGFRHRHQNSEGTGQXXXLKSTQAAIDQIXXXXXXXIKKTNEKFHQXXXXXXXXXXXXXXXEKYVEDTKVDLWSYNAELLIALENQHTIHLTDSEMNKLFEKTRRQLRENAEDLGNGCFKIYHKCDNSCIGSIRNETYDHDXYRNEALNNRFQXXXXXXXXEYKDWILWISFATSCFLLCXXXLGFIMWTCQKGNIKCNICI

SEQ ID NO: 418964 - protein, 574 aa, Influenza virus
  MOD_RES (1)..(29): Any amino acid
  MOD_RES (51)..(87): Any amino acid
  MOD_RES (97)..(117): Any amino acid
  MOD_RES (127)..(127): Any amino acid
  MOD_RES (142)..(167): Any amino acid
  MOD_RES (177)..(194): Any amino acid
  MOD_RES (207)..(251): Any amino acid
  MOD_RES (262)..(272): Any amino acid
  MOD_RES (282)..(300): Any amino acid
  MOD_RES (329)..(329): Any amino acid
  MOD_RES (357)..(361): Any amino acid
  MOD_RES (388)..(390): Any amino acid
  MOD_RES (400)..(408): Any amino acid
  MOD_RES (418)..(446): Any amino acid
  MOD_RES (460)..(461): Any amino acid
  MOD_RES (471)..(482): Any amino acid
  MOD_RES (514)..(515): Any amino acid
  MOD_RES (528)..(533): Any amino acid
  MOD_RES (553)..(556): Any amino acid
XXXXXXXXXXXXXXXXXXXXXXXXXXXXXAATLCLGHHAVPNGTIVRTITXXXXXXXXXXXXXXXXXXXXXXXXXXXXXXXXXXXXXIDALLGDPHXXXXXXXXXXXXXXXXXXXXXCYPYDVPEYXTLRSLVASSGNLEFXXXXXXXXXXXXXXXXXXXXXXXXXXFFSRLNWLYXXXXXXXXXXXXXXXXXXFDKLYIWGIHHPXXXXXXXXXXXXXXXXXXXXXXXXXXXXXXXXXXXXXXXXXXXXXSVYWTIVKPGXXXXXXXXXXXIAPRGYFKMXXXXXXXXXXXXXXXXXXXFECITPNGSIPNGKPFQNVNRITYGPCPXYIKQNTLKLATGMRNVPERQTRGIFGAXXXXXENGWEGMVNGWYGFRHQHQNSEGIGQXXXFKSTQAAINXXXXXXXXXVEKTNEKFHXXXXXXXXXXXXXXXXXXXXXXXXXXXXXYNAEFLVALENQHXXDLADSEMNKXXXXXXXXXXXXAEDMGNGCLKIYHKCDNTCMESIRNGTYNHDXXRDEALNNRSQIKXXXXXXGYKDWFLWISFAMSCFLLCXXXXGFIMWACQRGNIRCDICI

SEQ ID NO: 418965 - protein, 574 aa, Influenza virus
  MOD_RES (1)..(38): Any amino acid
  MOD_RES (50)..(87): Any amino acid
  MOD_RES (97)..(117): Any amino acid
  MOD_RES (127)..(251): Any amino acid
  MOD_RES (262)..(272): Any amino acid
  MOD_RES (282)..(304): Any amino acid
  MOD_RES (339)..(339): Any amino acid
  MOD_RES (357)..(371): Any amino acid
  MOD_RES (387)..(390): Any amino acid
  MOD_RES (400)..(446): Any amino acid
  MOD_RES (460)..(462): Any amino acid
  MOD_RES (472)..(483): Any amino acid
  MOD_RES (502)..(502): Any amino acid
  MOD_RES (512)..(516): Any amino acid
  MOD_RES (528)..(534): Any amino acid
  MOD_RES (548)..(560): Any amino acid
  MOD_RES (571)..(574): Any amino acid
XXXXXXXXXXXXXXXXXXXXXXXXXXXXXXXXXXXXXXAVPNGTMVKTIXXXXXXXXXXXXXXXXXXXXXXXXXXXXXXXXXXXXXXIDSLLGDPHXXXXXXXXXXXXXXXXXXXXXCYPYDVQDYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIYWTVVKPGXXXXXXXXXXXIAPRGYFKVXXXXXXXXXXXXXXXXXXXXXXXTPNGSIPNNKPFQNVNKITYGVCPRYVRQNTLKLXTGMRNIPERQTRGLFGAXXXXXXXXXXXXXXXGRLVRFRHQNSEGIGXXXXLKSTQAAITXXXXXXXXXXXXXXXXXXXXXXXXXXXXXXXXXXXXXXXXXXXXXXXYNAEILVALENQHXXXMTDSEMNKLXXXXXXXXXXXXEDMGNGCFTIYHKCDNVCXGSIRNGTYNXXXXXDEALSNRFQIKXXXXXXXYKNWILWISFAMSXXXXXXXXXXXXXWACQKGNIKCXXXX

SEQ ID NO: 418966 - protein, 574 aa, Influenza virus
  MOD_RES (1)..(317): Any amino acid
  MOD_RES (329)..(373): Any amino acid
  MOD_RES (402)..(465): Any amino acid
  MOD_RES (476)..(483): Any amino acid
  MOD_RES (495)..(562): Any amino acid
  MOD_RES (574)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNVNRITYGVCPXXXXXXXXXXXXXXXXXXXXXXXXXXXXXXXXXXXXXXXXXXXXXWYGFRHQNSEGRGQAADLKSTQAAIDQVXXXXXXXXXXXXXXXXXXXXXXXXXXXXXXXXXXXXXXXXXXXXXXXXXXXXXXXXXXXXXXXXSEMSKLFEKTXXXXXXXXEDMGNGCFRIYXXXXXXXXXXXXXXXXXXXXXXXXXXXXXXXXXXXXXXXXXXXXXXXXXXXXXXXXXXXXXXXXXXXXCQKGNIRCDICX

SEQ ID NO: 418967 - protein, 574 aa, Influenza virus
  MOD_RES (1)..(317): Any amino acid
  MOD_RES (332)..(373): Any amino acid
  MOD_RES (388)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNINRITYGACPKYIXXXXXXXXXXXXXXXXXXXXXXXXXXXXXXXXXXXXXXXXXXWYGFRHHNSEGTGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418968 - protein, 574 aa, Influenza virus
  MOD_RES (1)..(322): Any amino acid
  MOD_RES (332)..(373): Any amino acid
  MOD_RES (385)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYGACPRYIXXXXXXXXXXXXXXXXXXXXXXXXXXXXXXXXXXXXXXXXXXWYGFRHLNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418969 - protein, 574 aa, Influenza virus
  MOD_RES (1)..(377): Any amino acid
  MOD_RES (388)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRHQNSEGMGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418970 - protein, 486 aa, Influenza virus
  MOD_RES (16)..(79): Any amino acid
  MOD_RES (90)..(91): Any amino acid
  MOD_RES (101)..(101): Any amino acid
  MOD_RES (134)..(134): Any amino acid
  MOD_RES (151)..(159): Any amino acid
  MOD_RES (205)..(206): Any amino acid
  MOD_RES (218)..(228): Any amino acid
  MOD_RES (257)..(263): Any amino acid
  MOD_RES (275)..(278): Any amino acid
  MOD_RES (318)..(324): Any amino acid
  MOD_RES (340)..(357): Any amino acid
  MOD_RES (379)..(381): Any amino acid
  MOD_RES (392)..(413): Any amino acid
  MOD_RES (442)..(445): Any amino acid
AKAGVKMNPNQKIITXXXXXXXXXXXXXXXXXXXXXXXXXXXXXXXXXXXXXXXXXXXXXXXXXXXXXXXXXXXXXXXXEKEKEICSVVXXYRNWSKPQCXITGFAPFSKDNSIRLSAGGDIWVTREPYVSCDXDKCYQFALGQGTTLNNXXXXXXXXXRTPYRTLLMNELGVPFHLGTKQVCIAWSSSSCHDGKAWLHVCVTGXXKNATASFIYNGXXXXXXXXXXXEILRTQESECVCINGTCTVVMTDGSASGXXXXXXXEYYFVKEGKIVXXXXLSGSAQHVEECSCYPRYPGVRCVCRDNWKGSNRPIVDINXXXXXXXSSYVCSGLVGDTPRKXXXXXXXXXXXXXXXXXXHGVKGWAFDDGNDVWMGRTISXXXRSGYETFKVIXXXXXXXXXXXXXXXXXXXXXXRSGYSGIFSVEGKSCINRCFYVELIRGRXXXXEVLWTSNSIVVFCGTSGTYGTGSWPDGADINLHAYISFRNL

SEQ ID NO: 418971 - protein, 486 aa, Influenza virus
  MOD_RES (1)..(6): Any amino acid
  MOD_RES (16)..(91): Any amino acid
  MOD_RES (101)..(101): Any amino acid
  MOD_RES (134)..(134): Any amino acid
  MOD_RES (151)..(159): Any amino acid
  MOD_RES (189)..(193): Any amino acid
  MOD_RES (205)..(206): Any amino acid
  MOD_RES (218)..(228): Any amino acid
  MOD_RES (251)..(278): Any amino acid
  MOD_RES (318)..(324): Any amino acid
  MOD_RES (340)..(357): Any amino acid
  MOD_RES (379)..(381): Any amino acid
  MOD_RES (392)..(413): Any amino acid
  MOD_RES (442)..(445): Any amino acid
  MOD_RES (457)..(457): Any amino acid
  MOD_RES (485)..(486): Any amino acid
XXXXXXMNPNQKIIAXXXXXXXXXXXXXXXXXXXXXXXXXXXXXXXXXXXXXXXXXXXXXXXXXXXXXXXXXXXXXXXXXXXXXXXXXXXXYRKWSKPQCXIAGFAPFSKDNSIRLAAGGDIWVTRELYVSCDXGKCYQFALGQGTTLDNXXXXXXXXXRIPHRTLLMNELGIPFHLGTRQVCIAWSSXXXXXGKAWLHVCITGXXENATASFIYDGXXXXXXXXXXXKILRTQESECICINGTCTVIMTXXXXXXXXXXXXXXXXXXXXXXXXXXXXLSGSAQHIEECSCYPRFPGVRCICRDNWKGSNRPVVDINXXXXXXXSRYVCSGLVGDTPRNXXXXXXXXXXXXXXXXXXPGVKGWAFDNGDDVWMGRTINXXXRLGYETFKVIXXXXXXXXXXXXXXXXXXXXXXWSGYSGIFSVESKSCVNRCFYVELIRGSXXXXEVWWTSNSIVVXCGTSGTYGSGSWPDGADLGLMGRTRISXX

SEQ ID NO: 418972 - protein, 486 aa, Influenza virus
  MOD_RES (1)..(6): Any amino acid
  MOD_RES (16)..(91): Any amino acid
  MOD_RES (101)..(112): Any amino acid
  MOD_RES (134)..(134): Any amino acid
  MOD_RES (151)..(159): Any amino acid
  MOD_RES (170)..(171): Any amino acid
  MOD_RES (193)..(206): Any amino acid
  MOD_RES (218)..(228): Any amino acid
  MOD_RES (257)..(278): Any amino acid
  MOD_RES (316)..(324): Any amino acid
  MOD_RES (337)..(357): Any amino acid
  MOD_RES (379)..(381): Any amino acid
  MOD_RES (392)..(413): Any amino acid
  MOD_RES (436)..(445): Any amino acid
  MOD_RES (455)..(465): Any amino acid
  MOD_RES (484)..(486): Any amino acid
XXXXXXMNPNKKIITXXXXXXXXXXXXXXXXXXXXXXXXXXXXXXXXXXXXXXXXXXXXXXXXXXXXXXXXXXXXXXXXXXXXXXXXXXXXYRDWSKPQCXXXXXXXXXXXXSIRLSAGGAIWVTREPYVSCSXSKCYQFALGQGTTLSNXXXXXXXXXRTPHRTLLMNXXGVPFHLGTRQVCMAWSSSSCHXXXXXXXXXXXXXXRNATASFIYGGXXXXXXXXXXXNILRTQESECVCINGTCAVVMTDGSASEXXXXXXXXXXXXXXXXXXXXXXLLGSAQHVEECSCYPRYSGIRCVCRDNWRGSNRPIVDXXXXXXXXXSSYMCSGLVGDTXXXXXXXXXXXXXXXXXXXXXQGVKGWAFDNENDVWMGRTIGXXXRSGYETFRVIXXXXXXXXXXXXXXXXXXXXXXMSGYSGIFSVENKNCINRCFYVXXXXXXXXXXRVWWTSNSIXXXXXXXXXXXTGSWPDGANIKSHAYISFXXX

SEQ ID NO: 418973 - protein, 486 aa, Influenza virus
  MOD_RES (1)..(6): Any amino acid
  MOD_RES (16)..(91): Any amino acid
  MOD_RES (101)..(120): Any amino acid
  MOD_RES (130)..(134): Any amino acid
  MOD_RES (144)..(166): Any amino acid
  MOD_RES (185)..(206): Any amino acid
  MOD_RES (216)..(228): Any amino acid
  MOD_RES (257)..(278): Any amino acid
  MOD_RES (298)..(305): Any amino acid
  MOD_RES (318)..(324): Any amino acid
  MOD_RES (337)..(359): Any amino acid
  MOD_RES (379)..(382): Any amino acid
  MOD_RES (392)..(413): Any amino acid
  MOD_RES (427)..(445): Any amino acid
  MOD_RES (455)..(465): Any amino acid
  MOD_RES (476)..(486): Any amino acid
XXXXXXMNPIKKIITXXXXXXXXXXXXXXXXXXXXXXXXXXXXXXXXXXXXXXXXXXXXXXXXXXXXXXXXXXXXXXXXXXXXXXXXXXXXYRSWSKPQCXXXXXXXXXXXXXXXXXXXXDIWVTRVPYXXXXXNKCYQFALGXXXXXXXXXXXXXXXXXXXXXXXLMSELGVPFHLGTKQVCMXXXXXXXXXXXXXXXXXXXXXXNNATASFIYXXXXXXXXXXXXXDILRTQESECVCISGTCAVVMTDGNASGXXXXXXXXXXXXXXXXXXXXXXLSGNAQHVEECSCYPRYPNXXXXXXXXWKGSNRPVIDINXXXXXXXSSYLCSGLVGDTXXXXXXXXXXXXXXXXXXXXXXXVKGWAFDYGNDIWMGRTISXXXXLGYETFKVVXXXXXXXXXXXXXXXXXXXXXXRSGYSGVFSVEGKXXXXXXXXXXXXXXXXXXXKVWWTSNSIXXXXXXXXXXXTGSWPDGAEIXXXXXXXXXXX

SEQ ID NO: 418974 - protein, 486 aa, Influenza virus
  MOD_RES (1)..(6): Any amino acid
  MOD_RES (16)..(91): Any amino acid
  MOD_RES (101)..(124): Any amino acid
  MOD_RES (134)..(171): Any amino acid
  MOD_RES (182)..(206): Any amino acid
  MOD_RES (218)..(240): Any amino acid
  MOD_RES (255)..(278): Any amino acid
  MOD_RES (288)..(288): Any amino acid
  MOD_RES (298)..(305): Any amino acid
  MOD_RES (318)..(367): Any amino acid
  MOD_RES (378)..(445): Any amino acid
  MOD_RES (455)..(472): Any amino acid
  MOD_RES (483)..(486): Any amino acid
XXXXXXMNPNQRIITXXXXXXXXXXXXXXXXXXXXXXXXXXXXXXXXXXXXXXXXXXXXXXXXXXXXXXXXXXXXXXXXXXXXXXXXXXXXYRNWTKPQCXXXXXXXXXXXXXXXXXXXXXXXXTREPYVSCGXXXXXXXXXXXXXXXXXXXXXXXXXXXXXXXXXXXXXXGVPFYLGTKQXXXXXXXXXXXXXXXXXXXXXXXXXRNATASFVYDGXXXXXXXXXXXXXXXXXXXXXXXINGICTVVMTDGNAXXXXXXXXXXXXXXXXXXXXXXXXLSGGAQHVEXCSCYPRYPDXXXXXXXXWKGSNRPIIDINXXXXXXXXXXXXXXXXXXXXXXXXXXXXXXXXXXXXXXXXXXXXXXXXXXGNDLWMGRTIXXXXXXXXXXXXXXXXXXXXXXXXXXXXXXXXXXXXXXXXXXXXXXXXXXXXXXXXXXXXXXXXXXXXDVLWTSNSIXXXXXXXXXXXXXXXXXXADINLMPIYSXXXX

SEQ ID NO: 418975 - protein, 486 aa, Influenza virus
  MOD_RES (1)..(247): Any amino acid
  MOD_RES (257)..(308): Any amino acid
  MOD_RES (318)..(472): Any amino acid
  MOD_RES (483)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMTDGSASDXXXXXXXXXXXXXXXXXXXXXXXXXXXXXXXXXXXXXXXXXXXXXXXXXXXXSNRPVVDIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXADIKSHAYISXXXX

SEQ ID NO: 418976 - protein, 571 aa, Influenza virus
  MOD_RES (1)..(18): Any amino acid
  MOD_RES (45)..(46): Any amino acid
  MOD_RES (60)..(62): Any amino acid
  MOD_RES (76)..(76): Any amino acid
  MOD_RES (93)..(95): Any amino acid
  MOD_RES (105)..(107): Any amino acid
  MOD_RES (139)..(141): Any amino acid
  MOD_RES (157)..(157): Any amino acid
  MOD_RES (168)..(173): Any amino acid
  MOD_RES (206)..(207): Any amino acid
  MOD_RES (222)..(223): Any amino acid
  MOD_RES (233)..(233): Any amino acid
  MOD_RES (275)..(288): Any amino acid
  MOD_RES (303)..(306): Any amino acid
  MOD_RES (317)..(317): Any amino acid
  MOD_RES (342)..(343): Any amino acid
XXXXXXXXXXXXXXXXXXYTGNPVICLGHHAVVPNGTMVKTLTDXXIEVVTAQELVESQXXXELCPSPLRLVDGQXCDIVNGALGSPGCDHLXXXEWDVFIERPXXXDTCYPFDVPDYQSLRSILANNGKFEFIAEEFXXXTVKQNGKSGACKRANXNDFFNRLNWLXXXXXXAYPLQNLTKVNNGDYARLYIWGVHHPSTDTEQXXLYKNNPGRVTVSTKXXQTSVVPNIGXRPWVRGQSGRISFYWTIVEPGDLIVFNTIGNLIAPRGHYKLXXXXXXXXXXXXXXIGSCVSKCHTDRGSXXXXKPFQNISRISXGDCPKYVKQGSLKLATGMRNIPEKXXRGLFGAIAGFIENGWQGLIDGWYGFRHQNAEGTGTAADLKSTQAAIDQINGKLNRLIEKTNEKYHQIEKEFEQVEGRIQDLEKYVEDTKIDLWSYNAELLVALENQHTIDVTDSEMNKLFERVRRQLRENAEDKGNGCFEIFHQCDNNCIESIRNGTYDHDIYRDEAINNRFQIQGVKLTQGYKDIILWISFSISCFLLVSCFLLVALLLAFILWACQNGNIRCQICI

SEQ ID NO: 418977 - protein, 571 aa, Influenza virus
  MOD_RES (1)..(18): Any amino acid
  MOD_RES (45)..(46): Any amino acid
  MOD_RES (60)..(62): Any amino acid
  MOD_RES (76)..(76): Any amino acid
  MOD_RES (93)..(95): Any amino acid
  MOD_RES (105)..(108): Any amino acid
  MOD_RES (139)..(141): Any amino acid
  MOD_RES (157)..(157): Any amino acid
  MOD_RES (168)..(173): Any amino acid
  MOD_RES (206)..(207): Any amino acid
  MOD_RES (222)..(223): Any amino acid
  MOD_RES (233)..(233): Any amino acid
  MOD_RES (275)..(288): Any amino acid
  MOD_RES (303)..(306): Any amino acid
  MOD_RES (317)..(317): Any amino acid
  MOD_RES (342)..(343): Any amino acid
  MOD_RES (353)..(364): Any amino acid
  MOD_RES (435)..(445): Any amino acid
XXXXXXXXXXXXXXXXXXYTGNPVICMGHHAVVSNGTMVKTLADXXVEVVTAQELVEAQXXXELCPSPLKLIDGQXCDIINGALGSPGCDRLXXXEWDIFIERPXXXXTCYPFDVPEYQSLRSILANNGRFEFIAEEFXXXTVKQNGKSSACKRANXNDFFRRLNWLXXXXXXEYPLQNLTKINNGDYTRLYIWGVHHPSTDKEQXXLYKNSPGRVTVSTQXXQTSVVPNIDXRPLVRGQSGRVSFYWTIVEPEDLIVFNTIGNLVAPRGHYKLXXXXXXXXXXXXXXIGSCASKCHTDKGSXXXXKPFQNISRVSXGDCPKYIKQGSLKLATGMRNIPERXXKGLFGAIAGXXXXXXXXXXXXWYGFRHQNSEGTGTAADLKSTQTAIDQINGKLNRLIERTNEKYHQIEKEFGQVEGRIQDLERYVEDTKIDXXXXXXXXXXXLENQHTIDMTDSEMNKLFERVKRQLRENAEDRGNGCFEIFHKCDNSCIESIRNGTYNHDVYRDEAISNRFQIQGVRLTQGYKDIILWVSFSISCFLLASCFLLAALLLAFVLWACQNGNLRCQICI

SEQ ID NO: 418978 - protein, 571 aa, Influenza virus
  MOD_RES (1)..(18): Any amino acid
  MOD_RES (45)..(46): Any amino acid
  MOD_RES (60)..(62): Any amino acid
  MOD_RES (76)..(76): Any amino acid
  MOD_RES (91)..(95): Any amino acid
  MOD_RES (105)..(108): Any amino acid
  MOD_RES (126)..(126): Any amino acid
  MOD_RES (139)..(141): Any amino acid
  MOD_RES (155)..(157): Any amino acid
  MOD_RES (167)..(173): Any amino acid
  MOD_RES (194)..(194): Any amino acid
  MOD_RES (206)..(207): Any amino acid
  MOD_RES (222)..(223): Any amino acid
  MOD_RES (233)..(233): Any amino acid
  MOD_RES (275)..(288): Any amino acid
  MOD_RES (303)..(306): Any amino acid
  MOD_RES (317)..(317): Any amino acid
  MOD_RES (339)..(382): Any amino acid
  MOD_RES (442)..(448): Any amino acid
  MOD_RES (477)..(478): Any amino acid
  MOD_RES (569)..(571): Any amino acid
XXXXXXXXXXXXXXXXXXYTENPVICLGHHSVVANGTMVKTLTGXXIEVVAAQELVESQXXXELCPKPLKLVDGQXCDIVNSALGSPGCDXXXXXEWDVYIERPXXXXTCYPFDVPGYQSLRSILXNNGKFEFIVEKFXXXTVKQDGKSSACKRXXXDDFFNRLNWXXXXXXXAYPFQNLTKVNSGDYARLYIXGVHHPSTDAEQXXLYENNPGRVTVSTRXXQTSIVPNIGXRPLVRSQSGRISFYWTIVDPGDIIVFNTIGNLIAPRGHYRLXXXXXXXXXXXXXXIGSCESKCHTEKGSXXXXKPFQNVSRIAXGECPKYVKQGSLRLATGMRNIXXXXXXXXXXXXXXXXXXXXXXXXXXXXXXXXXXXXXXXXXXXXKSTQAAIDKINGKLNRLIEKTNDKYHQIEKEFEQVEGRTQDLENYVEDTKVDLWSYNAEXXXXXXXQHIIDVTDSEMDKLFERVRHQLRENAEDXXNGCFEIFHRCDNKCIESIRNGTYDHNIYRDEAINSRFQIQGVKLAQGYKDIILWFSFSISCFLLISCFLLVALFLAFILWACQTGNIRCQXXX

SEQ ID NO: 418979 - protein, 571 aa, Influenza virus
  MOD_RES (1)..(18): Any amino acid
  MOD_RES (28)..(28): Any amino acid
  MOD_RES (45)..(46): Any amino acid
  MOD_RES (56)..(62): Any amino acid
  MOD_RES (74)..(76): Any amino acid
  MOD_RES (91)..(95): Any amino acid
  MOD_RES (105)..(108): Any amino acid
  MOD_RES (126)..(126): Any amino acid
  MOD_RES (139)..(141): Any amino acid
  MOD_RES (157)..(157): Any amino acid
  MOD_RES (168)..(174): Any amino acid
  MOD_RES (189)..(207): Any amino acid
  MOD_RES (220)..(223): Any amino acid
  MOD_RES (233)..(233): Any amino acid
  MOD_RES (243)..(243): Any amino acid
  MOD_RES (267)..(288): Any amino acid
  MOD_RES (303)..(306): Any amino acid
  MOD_RES (317)..(317): Any amino acid
  MOD_RES (331)..(383): Any amino acid
  MOD_RES (397)..(414): Any amino acid
  MOD_RES (435)..(451): Any amino acid
  MOD_RES (467)..(481): Any amino acid
  MOD_RES (491)..(495): Any amino acid
  MOD_RES (525)..(527): Any amino acid
XXXXXXXXXXXXXXXXXXYTGNLVICLXGHHAVPNGTIVKTLTDXXVEVVAAQELXXXXXXXELCSSPLRLVDXXXCDIVNAALGSPGCDXXXXXEWDVFVERPXXXXTCYPFDVPNYQSLRSILXNNGKLEFIAEEFXXXTIKQNGKSGACKRADXNDFFKRLNWLXXXXXXXYPLQNLTKTNNGDYXXXXXXXXXXXXXXXXXXXLYKSNPGRVTVSXXXXQTSVVPDIGXGPWVRGQSGXISFYWTIVVPGDLILFNTIGNLIXXXXXXXXXXXXXXXXXXXXXXIGSCISKCHTNRGSXXXXKPFQNVSRTAXGDCPRYVKQGSLKXXXXXXXXXXXXXXXXXXXXXXXXXXXXXXXXXXXXXXXXXXXXXXXXXXXXXSTQAAIDQVNGKLXXXXXXXXXXXXXXXXXXEQVEGRIQYLEKYVEDTKVDXXXXXXXXXXXXXXXXXIDVTDSEMSKLFERVXXXXXXXXXXXXXXXFEIFHQCNNXXXXXIRNGTYNHNVYRDEAINNRFQIQGIKLTQXXXDVILWISFSTTRQASPSCLVVRALLIAFVLWACQNGNVRCQICI

SEQ ID NO: 418980 - protein, 571 aa, Influenza virus
  MOD_RES (1)..(18): Any amino acid
  MOD_RES (28)..(28): Any amino acid
  MOD_RES (45)..(46): Any amino acid
  MOD_RES (60)..(63): Any amino acid
  MOD_RES (76)..(113): Any amino acid
  MOD_RES (127)..(128): Any amino acid
  MOD_RES (139)..(141): Any amino acid
  MOD_RES (151)..(174): Any amino acid
  MOD_RES (196)..(208): Any amino acid
  MOD_RES (222)..(223): Any amino acid
  MOD_RES (233)..(233): Any amino acid
  MOD_RES (251)..(253): Any amino acid
  MOD_RES (263)..(288): Any amino acid
  MOD_RES (303)..(306): Any amino acid
  MOD_RES (316)..(317): Any amino acid
  MOD_RES (328)..(384): Any amino acid
  MOD_RES (402)..(414): Any amino acid
  MOD_RES (424)..(424): Any amino acid
  MOD_RES (434)..(452): Any amino acid
  MOD_RES (470)..(487): Any amino acid
  MOD_RES (498)..(502): Any amino acid
  MOD_RES (538)..(541): Any amino acid
  MOD_RES (570)..(571): Any amino acid
XXXXXXXXXXXXXXXXXXHTGNPVICLXGHHAVSNGTVVKTLTDXXVEVITAQELVESKXXXXLCPSPLRLIDGQXXXXXXXXXXXXXXXXXXXXXXXXXXXXXXXXXXXXXXDVPDYQSIRSILAXXGKFEFIAEDFXXXAVKQNGKSGXXXXXXXXXXXXXXXXXXXXXXXXYPIQNLTKVNNGNYARLYIWGXXXXXXXXXXXXXYKNNPGRVSVSTKXXQTSVIPNIGXRPWVRGLSSRISFYWTIXXXGDVIVFNTIXXXXXXXXXXXXXXXXXXXXXXXXXXIGSCVSRCHTDKGSXXXXKPFHNISRIXXGNCPKYVKQGXXXXXXXXXXXXXXXXXXXXXXXXXXXXXXXXXXXXXXXXXXXXXXXXXXXXXXXXXTQTAIDQITGKLNRLIEXXXXXXXXXXXXXEKVEGRIQDXEEYVEDTKIXXXXXXXXXXXXXXXXXXXDVTDSEMNRLFERVRRQXXXXXXXXXXXXXXXXXXCDNTCIESIRXXXXXHDIYRNEAINNRFQIQGVKLIQGYKDIILWISFSMXXXXSISCFLLVALLIAFMLWACQNGNIRWPDXX

SEQ ID NO: 418981 - protein, 571 aa, Influenza virus
  MOD_RES (1)..(24): Any amino acid
  MOD_RES (42)..(50): Any amino acid
  MOD_RES (60)..(63): Any amino acid
  MOD_RES (76)..(244): Any amino acid
  MOD_RES (264)..(307): Any amino acid
  MOD_RES (317)..(386): Any amino acid
  MOD_RES (399)..(415): Any amino acid
  MOD_RES (426)..(452): Any amino acid
  MOD_RES (468)..(487): Any amino acid
  MOD_RES (498)..(507): Any amino acid
  MOD_RES (518)..(535): Any amino acid
  MOD_RES (562)..(571): Any amino acid
XXXXXXXXXXXXXXXXXXXXXXXXWICMGHHAVANGTIVKTXXXXXXXXXTAQELVEPQXXXXLCPSPLKLVDGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLYWTIVEPGNLIVFNTIGXXXXXXXXXXXXXXXXXXXXXXXXXXXXXXXXXXXXXXXXXXXXPFQNISRIAXXXXXXXXXXXXXXXXXXXXXXXXXXXXXXXXXXXXXXXXXXXXXXXXXXXXXXXXXXXXXXXXXXXXXXAAINQINGKLNRXXXXXXXXXXXXXXXXXKIEGRVQDLEXXXXXXXXXXXXXXXXXXXXXXXXXXXDVADSEMNKLFERIRXXXXXXXXXXXXXXXXXXXXCGNNCIESIRXXXXXXXXXXDDAINNRFQIXXXXXXXXXXXXXXXXXXVTTRQASPSCFLLIALLLAFMLWACQXXXXXXXXXX

SEQ ID NO: 418982 - protein, 571 aa, Influenza virus
  MOD_RES (1)..(28): Any amino acid
  MOD_RES (38)..(386): Any amino acid
  MOD_RES (399)..(541): Any amino acid
  MOD_RES (552)..(553): Any amino acid
  MOD_RES (563)..(571): Any amino acid
XXXXXXXXXXXXXXXXXXXXXXXXXXXXGHHSVPNGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAAIDQISGKLNRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSISCFLLAALXXTFILWACQNXXXXXXXXX

SEQ ID NO: 418983 - protein, 571 aa, Influenza virus
  MOD_RES (1)..(28): Any amino acid
  MOD_RES (42)..(541): Any amino acid
  MOD_RES (552)..(555): Any amino acid
  MOD_RES (565)..(571): Any amino acid
XXXXXXXXXXXXXXXXXXXXXXXXXXXXGHHAVTNGTMVKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSISCFLLIALXXXXFIWGLSEWKXXXXXXX

SEQ ID NO: 418984 - protein, 608 aa, Influenza virus
  MOD_RES (12)..(18): Any amino acid
  MOD_RES (28)..(35): Any amino acid
  MOD_RES (57)..(68): Any amino acid
  MOD_RES (92)..(93): Any amino acid
  MOD_RES (104)..(138): Any amino acid
  MOD_RES (148)..(163): Any amino acid
  MOD_RES (173)..(197): Any amino acid
  MOD_RES (207)..(222): Any amino acid
  MOD_RES (236)..(266): Any amino acid
  MOD_RES (283)..(302): Any amino acid
  MOD_RES (339)..(340): Any amino acid
  MOD_RES (350)..(352): Any amino acid
  MOD_RES (433)..(441): Any amino acid
  MOD_RES (516)..(516): Any amino acid
  MOD_RES (527)..(551): Any amino acid
  MOD_RES (580)..(580): Any amino acid
  MOD_RES (608)..(608): Any amino acid
SVKMEKIVLLLXXXXXXXSDQICIGYHXXXXXXXXQVDTIMEKNVTVTHAQDILEKXXXXXXXXXXXXKPLILRDCSVAGWLLGNPMCDEFXXVPEWSYIVEKXXXXXXXXXXXXXXXXXXXXXXXXXXXXXXXXXXXADHPPKVAWXXXXXXXXXXXXXXXXNGRSSFFRNXXXXXXXXXXXXXXXXXXXXXXXXXLLVLWGIHHXXXXXXXXXXXXXXXXYISVGTSTLNQRLXXXXXXXXXXXXXXXXXXXXXXXXXXXXXXXFESNGNFIAPEYAYKIXXXXXXXXXXXXXXXXXXXXPSVKLPMGAIGAIDSSMPFHNIHPLTIGECPKYVKSXXLVLATGLRNXXXREREGGRRRKRGLFGRRGLFGAIAGFIEGGWQGMVDGWYGYHHSNEQGSGYAADKESTQKAIDGVTNKVNSIIDKMNTQFXXXXXXXXXLERRIENLNKKMEDGFLDVWTYNAELLVLMENERTLDFHDSNVKNLYDKVRLQLRDNAKELGNGCFEFYHKCDNXCMESVRNGTYXXXXXXXXXXXXXXXXXXXXXXXXXTYQILSIYSTVASSLSTGNHGSLVLSLWXAGLSLWMCSNGSLQCRICIKFVSSDCSX

SEQ ID NO: 418985 - protein, 608 aa, Influenza virus
  MOD_RES (12)..(18): Any amino acid
  MOD_RES (28)..(35): Any amino acid
  MOD_RES (57)..(68): Any amino acid
  MOD_RES (92)..(93): Any amino acid
  MOD_RES (104)..(163): Any amino acid
  MOD_RES (173)..(197): Any amino acid
  MOD_RES (207)..(222): Any amino acid
  MOD_RES (236)..(266): Any amino acid
  MOD_RES (283)..(304): Any amino acid
  MOD_RES (314)..(316): Any amino acid
  MOD_RES (339)..(340): Any amino acid
  MOD_RES (350)..(358): Any amino acid
  MOD_RES (368)..(378): Any amino acid
  MOD_RES (433)..(441): Any amino acid
  MOD_RES (468)..(470): Any amino acid
  MOD_RES (516)..(516): Any amino acid
  MOD_RES (527)..(551): Any amino acid
  MOD_RES (567)..(580): Any amino acid
  MOD_RES (608)..(608): Any amino acid
ICQMEKIVLLFXXXXXXXGDQICIGYHXXXXXXXXQIDTIMEKNVTVTHAKDILEKXXXXXXXXXXXXKPLILKDCSVAGWLLGNPLCDEFXXVSEWSYIVEKXXXXXXXXXXXXXXXXXXXXXXXXXXXXXXXXXXXXXXXXXXXXXXXXXXXXXXXXXXXXTGRSSFFRNXXXXXXXXXXXXXXXXXXXXXXXXXLLILWGIHHXXXXXXXXXXXXXXXXYVSVGTSTLNLRLXXXXXXXXXXXXXXXXXXXXXXXXXXXXXXXFESTGNFIAPEYAYIVXXXXXXXXXXXXXXXXXXXXXXCQTPMGAINXXXSSMPFHNVHPLTIGKCPKYVKSXXLVLATGPRNXXXXXXXXXRRKKRGLFGXXXXXXXXXXXIEGGWQGMIDGWYGYHHNNGQGSGYAADQESTQKAINGITNKVNSIINKMNTQFXXXXXXXXXLEKRIENLNRKMEDGFLNVWTYNAELXXXMENERTLDLHDSNVKNLYEKVRLQLKDNAKELGNGCFEFYHRCDNXCMESIRNGTYXXXXXXXXXXXXXXXXXXXXXXXXXIYQILSIYSTAASSLXXXXXXXXXXXXXXAGLSFWMCSNGSLQCKICIKICESRLRX

SEQ ID NO: 418986 - protein, 608 aa, Influenza virus
  MOD_RES (1)..(18): Any amino acid
  MOD_RES (28)..(35): Any amino acid
  MOD_RES (57)..(68): Any amino acid
  MOD_RES (92)..(93): Any amino acid
  MOD_RES (104)..(163): Any amino acid
  MOD_RES (173)..(197): Any amino acid
  MOD_RES (207)..(222): Any amino acid
  MOD_RES (236)..(266): Any amino acid
  MOD_RES (283)..(304): Any amino acid
  MOD_RES (314)..(316): Any amino acid
  MOD_RES (336)..(340): Any amino acid
  MOD_RES (350)..(358): Any amino acid
  MOD_RES (368)..(384): Any amino acid
  MOD_RES (433)..(441): Any amino acid
  MOD_RES (474)..(476): Any amino acid
  MOD_RES (516)..(516): Any amino acid
  MOD_RES (527)..(551): Any amino acid
  MOD_RES (567)..(580): Any amino acid
  MOD_RES (595)..(598): Any amino acid
  MOD_RES (608)..(608): Any amino acid
XXXXXXXXXXXXXXXXXXSDHICIGYHXXXXXXXXQVDTIMERNVTVTHAQNILEKXXXXXXXXXXXXRPLILKDCSIAGWLLGNPMCDKFXXAPEWSYIVERXXXXXXXXXXXXXXXXXXXXXXXXXXXXXXXXXXXXXXXXXXXXXXXXXXXXXXXXXXXXSGRSSFFRNXXXXXXXXXXXXXXXXXXXXXXXXXLLIIWGIHHXXXXXXXXXXXXXXXXYISIGTSTLNQRSXXXXXXXXXXXXXXXXXXXXXXXXXXXXXXXFDSNGNFIAPENAYKIXXXXXXXXXXXXXXXXXXXXXXCQTPIGAINXXXSSLPFHNVHPFTIGECPKYXXXXXLILATGLRNXXXXXXXXXRRKRGLFGAXXXXXXXXXXXXXXXXXGMVDGWYGFHHSNDQGSGYAADRESTQKAVDGITNKVNSIIGKMNTQFXXXXXXXXXLERRIESLNKKMEDDFLDVWTYNAEILVLMENXXXLDFHDSNVRNLYDKVRHQLRDNARELGNGCFEFYHKCNNXCMESVKNGTYXXXXXXXXXXXXXXXXXXXXXXXXXVYQILSIYSTVVSSLXXXXXXXXXXXXXXAGLFLWMCSNGSYNXXXXFKFVSSDCSX

SEQ ID NO: 418987 - protein, 608 aa, Influenza virus
  MOD_RES (1)..(18): Any amino acid
  MOD_RES (28)..(35): Any amino acid
  MOD_RES (57)..(68): Any amino acid
  MOD_RES (91)..(197): Any amino acid
  MOD_RES (207)..(222): Any amino acid
  MOD_RES (236)..(266): Any amino acid
  MOD_RES (283)..(304): Any amino acid
  MOD_RES (314)..(316): Any amino acid
  MOD_RES (339)..(358): Any amino acid
  MOD_RES (368)..(387): Any amino acid
  MOD_RES (398)..(399): Any amino acid
  MOD_RES (433)..(441): Any amino acid
  MOD_RES (467)..(480): Any amino acid
  MOD_RES (505)..(506): Any amino acid
  MOD_RES (516)..(516): Any amino acid
  MOD_RES (527)..(551): Any amino acid
  MOD_RES (575)..(580): Any amino acid
XXXXXXXXXXXXXXXXXXGDRICIGYHXXXXXXXXHVDTIMEKNITVTHAQDILERXXXXXXXXXXXXRPLILRDCSVSGWLLGNPMCDAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLVMWGIHHXXXXXXXXXXXXXXXXYVSIGTSTLNQRMXXXXXXXXXXXXXXXXXXXXXXXXXXXXXXXFESNGNFITPEYAYKIXXXXXXXXXXXXXXXXXXXXXXCQTPVGAINXXXSSMPLHNIHPLTIGECPRYVKSXXXXXXXXXXXXXXXXXXXXKRKKRGLFGXXXXXXXXXXXXXXXXXXXXDGWYGYHHINXXGSGYAADKKSTQKAIDGITNKINSIIDKMNIQFXXXXXXXXXLEGRIENLNKKMEEGFIDVWTYNAEXXXXXXXXXXXXXXDSNVKNLYNKVRLQLKDNARELGNXXFEFYHKCDDXCIESVRNGTYXXXXXXXXXXXXXXXXXXXXXXXXXTYQILSVYSTVASSPSTGNHGSLXXXXXXAGLLLWMCSNGSLQCRVCIRFVNSDCSK

SEQ ID NO: 418988 - protein, 608 aa, Influenza virus
  MOD_RES (1)..(18): Any amino acid
  MOD_RES (28)..(44): Any amino acid
  MOD_RES (57)..(68): Any amino acid
  MOD_RES (92)..(197): Any amino acid
  MOD_RES (207)..(222): Any amino acid
  MOD_RES (236)..(273): Any amino acid
  MOD_RES (283)..(304): Any amino acid
  MOD_RES (314)..(316): Any amino acid
  MOD_RES (336)..(358): Any amino acid
  MOD_RES (368)..(403): Any amino acid
  MOD_RES (433)..(448): Any amino acid
  MOD_RES (468)..(481): Any amino acid
  MOD_RES (502)..(516): Any amino acid
  MOD_RES (527)..(553): Any amino acid
  MOD_RES (563)..(563): Any amino acid
  MOD_RES (574)..(580): Any amino acid
  MOD_RES (599)..(608): Any amino acid
XXXXXXXXXXXXXXXXXXSDQICVGYHXXXXXXXXXXXXXXXXXVTVTHAQDLLEKXXXXXXXXXXXXKPLILGDCSVAGWLLGNPTCDEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLVLWGVHHXXXXXXXXXXXXXXXXHISVGTSTLNQKLXXXXXXXXXXXXXXXXXXXXXXXXXXXXXXXXXXXXXXIAPEYAYKVXXXXXXXXXXXXXXXXXXXXXXCQTPLGAINXXXSSKPFHNIHPFTIGECPRYXXXXXXXXXXXXXXXXXXXXXXXRRKRRGLFGXXXXXXXXXXXXXXXXXXXXXXXXXXXXXXXXXXXXAADKESTQRAIDGITNRVNSIIDKMNTRFXXXXXXXXXXXXXXXXLNNKMEDGFLGVWTYNAELXXXXXXXXXXXXXXSNVKNLYDRVRLQLRDNAREXXXXXXXXXXXXXXXCMDSVRNGTYXXXXXXXXXXXXXXXXXXXXXXXXXXXQILSLYSTVXEFPSTGNHGSXXXXXXXAGLSLWMCFNGSLQCRIAXXXXXXXXXX

SEQ ID NO: 418989 - protein, 608 aa, Influenza virus
  MOD_RES (1)..(21): Any amino acid
  MOD_RES (36)..(69): Any amino acid
  MOD_RES (83)..(304): Any amino acid
  MOD_RES (314)..(318): Any amino acid
  MOD_RES (328)..(360): Any amino acid
  MOD_RES (370)..(414): Any amino acid
  MOD_RES (424)..(456): Any amino acid
  MOD_RES (468)..(554): Any amino acid
  MOD_RES (567)..(608): Any amino acid
XXXXXXXXXXXXXXXXXXXXXDQICIGYHANNSTEXXXXXXXXXXXXXXXXXXXXXXXXXXXXXXXXXXPFILKDCSVSGWLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCQTPMGAVNXXXXXMPFHNVHPFXXXXXXXXXXXXXXXXXXXXXXXXXXXXXXXXXKKKRGLFGAXXXXXXXXXXXXXXXXXXXXXXXXXXXXXXXXXXXXXXXXXXXXXNGVTNKVNSXXXXXXXXXXXXXXXXXXXXXXXXXXXXXXXXXFLDIWTYNAELXXXXXXXXXXXXXXXXXXXXXXXXXXXXXXXXXXXXXXXXXXXXXXXXXXXXXXXXXXXXXXXXXXXXXXXXXXXXXXXXXXXXXXXILSIYSTVTSSLXXXXXXXXXXXXXXXXXXXXXXXXXXXXXXXXXXXXXXXXXX

SEQ ID NO: 418990 - protein, 608 aa, Influenza virus
  MOD_RES (1)..(21): Any amino acid
  MOD_RES (36)..(320): Any amino acid
  MOD_RES (336)..(362): Any amino acid
  MOD_RES (376)..(608): Any amino acid
XXXXXXXXXXXXXXXXXXXXXDHICIGYHANNSTKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFHNVHPLAIGECPKYXXXXXXXXXXXXXXXXXXXXXXXXXXXKRRKKRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418991 - protein, 608 aa, Influenza virus
  MOD_RES (1)..(21): Any amino acid
  MOD_RES (36)..(362): Any amino acid
  MOD_RES (375)..(608): Any amino acid
XXXXXXXXXXXXXXXXXXXXXDRICIGYHANNSTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRRQKRGLFGAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418992 - protein, 608 aa, Influenza virus
  MOD_RES (1)..(21): Any amino acid
  MOD_RES (35)..(366): Any amino acid
  MOD_RES (376)..(608): Any amino acid
XXXXXXXXXXXXXXXXXXXXXDQICVGYHANNSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 418993 - protein, 599 aa, Influenza virus
  MOD_RES (12)..(18): Any amino acid
  MOD_RES (61)..(64): Any amino acid
  MOD_RES (92)..(92): Any amino acid
  MOD_RES (104)..(115): Any amino acid
  MOD_RES (130)..(135): Any amino acid
  MOD_RES (145)..(163): Any amino acid
  MOD_RES (173)..(193): Any amino acid
  MOD_RES (203)..(217): Any amino acid
  MOD_RES (232)..(260): Any amino acid
  MOD_RES (285)..(298): Any amino acid
  MOD_RES (346)..(348): Any amino acid
  MOD_RES (432)..(432): Any amino acid
  MOD_RES (507)..(507): Any amino acid
  MOD_RES (523)..(541): Any amino acid
  MOD_RES (563)..(571): Any amino acid
  MOD_RES (599)..(599): Any amino acid
SVKMEKIVLLLXXXXXXXSDQICIGYHYHANNSTEQVDTIMEKNVTVTHAQDILEKTHNGXXXXLDGVKPLILRDCSVAGWLLGNPMCDEFXNVPEWSYIVEKXXXXXXXXXXXXFNDYEELKHLLSRIXXXXXXADHPPKVAWXXXXXXXXXXXXXXXXXXXSFFRNVVWLXXXXXXXXXXXXXXXXXXXXXLLVLWGIHHXXXXXXXXXXXXXXXTYISVGTSTLNQRLXXXXXXXXXXXXXXXXXXXXXXXXXXXXXINFESNGNFIAPEYAYKIVKKGDSXXXXXXXXXXXXXXPSVKLPMGAINSSMPSMPFHNIHPLTIGECPKYVKSNRLVLATGLRNXXXREREGGRRRKRGLFGAIAAGFIEGGWQGMVDGWYGYHHSNEQGSGYAADKESTQKAIDGVTNKVNSIIDKMNTQFEAVGREFNXLERRIENLNKKMEDGFLDVWTYNAELLVLMENERTLDFHDSNVKNLYDKVRLQLRDNAKELGNGCFEFYHKCDNXCMESVRNGTYDYPQYXXXXXXXXXXXXXXXXXXXGTYQILSIYSTVASSLALAIMXXXXXXXXXAGLSLWMCSNGSLQCRICIKICESRLRX

SEQ ID NO: 418994 - protein, 599 aa, Influenza virus
  MOD_RES (12)..(18): Any amino acid
  MOD_RES (57)..(64): Any amino acid
  MOD_RES (92)..(92): Any amino acid
  MOD_RES (104)..(115): Any amino acid
  MOD_RES (130)..(163): Any amino acid
  MOD_RES (173)..(193): Any amino acid
  MOD_RES (203)..(217): Any amino acid
  MOD_RES (232)..(260): Any amino acid
  MOD_RES (285)..(300): Any amino acid
  MOD_RES (345)..(355): Any amino acid
  MOD_RES (432)..(432): Any amino acid
  MOD_RES (444)..(467): Any amino acid
  MOD_RES (507)..(507): Any amino acid
  MOD_RES (523)..(541): Any amino acid
  MOD_RES (563)..(571): Any amino acid
  MOD_RES (585)..(589): Any amino acid
  MOD_RES (599)..(599): Any amino acid
ICQMEKIVLLFXXXXXXXSDHICIGYHYHANNSTKQVDTIMEKNITVTHAQNILEKXXXXXXXXLNGVKPLILKDCSVAGWLLGNPLCDEFXNVSEWSYIVEKXXXXXXXXXXXXFNNYEELKHLLNRIXXXXXXXXXXXXXXXXXXXXXXXXXXXXXXXXXXSFYRNVVWLXXXXXXXXXXXXXXXXXXXXXLLILWGIHHXXXXXXXXXXXXXXXTYISIGTSTLNQRSXXXXXXXXXXXXXXXXXXXXXXXXXXXXXIHFESNGNFITPEYAYKIVKEGDSXXXXXXXXXXXXXXXXCQTPIGAINSSMPSMPFHNVHPLTIGECPKYVKSDKLVLATGLRXXXXXXXXXXXRKKRGLFGAIIAGFIEGGWQGMIDGWYGYHHNNEQGSGYAADQESTQKAINGVTNKVNSIINKMNTQFEAIGREFNXLEKRIENLNKKXXXXXXXXXXXXXXXXXXXXXXXXLDFHDSNVRNLYDKVRLQLKDNAKELGNGCFEFYHRCDNXCMESIRNGTYNYPQYXXXXXXXXXXXXXXXXXXXGIYQILSIYSTAASSLALAIIXXXXXXXXXAGLFLWMCSNGSYXXXXXFKFVSSDCSX

SEQ ID NO: 418995 - protein, 599 aa, Influenza virus
  MOD_RES (1)..(18): Any amino acid
  MOD_RES (61)..(64): Any amino acid
  MOD_RES (81)..(82): Any amino acid
  MOD_RES (92)..(92): Any amino acid
  MOD_RES (102)..(115): Any amino acid
  MOD_RES (130)..(163): Any amino acid
  MOD_RES (173)..(193): Any amino acid
  MOD_RES (203)..(217): Any amino acid
  MOD_RES (232)..(260): Any amino acid
  MOD_RES (285)..(300): Any amino acid
  MOD_RES (332)..(335): Any amino acid
  MOD_RES (346)..(355): Any amino acid
  MOD_RES (374)..(375): Any amino acid
  MOD_RES (432)..(433): Any amino acid
  MOD_RES (448)..(471): Any amino acid
  MOD_RES (489)..(496): Any amino acid
  MOD_RES (507)..(507): Any amino acid
  MOD_RES (523)..(541): Any amino acid
  MOD_RES (571)..(571): Any amino acid
XXXXXXXXXXXXXXXXXXGDQICIGYHYHANNSTVQVDTIMEKNVTVTHAKDILERTHNGXXXXLKGVRPLILKDCSIAGXXLGNPMCDKFXDVPEWSYIVXXXXXXXXXXXXXXLNDYEELKHLMSSTXXXXXXXXXXXXXXXXXXXXXXXXXXXXXXXXXXSFFRNVIWLXXXXXXXXXXXXXXXXXXXXXLLVMWGIHHXXXXXXXXXXXXXXXTYVSVGTSTLNLRLXXXXXXXXXXXXXXXXXXXXXXXXXXXXXISFESNGNFIAPENAYKIVKTGDSXXXXXXXXXXXXXXXXCQTPMGAINSSNSSMPFHNIHPLTIGKCPKYXXXXRLILATGLRNXXXXXXXXXXRKRGLFGAIAIAGFIEGGXXGMVDGWYGFHHSNEQGSGYAADRESTQKAMDGVTNKVNSIIGKMNTQFEAVGKEFNXXERRIESLNKKMEDGXXXXXXXXXXXXXXXXXXXXXXXXDSNVKNLYEKVRLQLRDXXXXXXXXCFEFYHKCNNXCMESVKNGTYDYPHYXXXXXXXXXXXXXXXXXXXVTYQILSIYSTVTSSLSTGNHGSLVLSLWXAGLSFWMCSNGSLQCKICIRFVNSDCSK

SEQ ID NO: 418996 - protein, 599 aa, Influenza virus
  MOD_RES (1)..(18): Any amino acid
  MOD_RES (54)..(64): Any amino acid
  MOD_RES (78)..(92): Any amino acid
  MOD_RES (102)..(115): Any amino acid
  MOD_RES (130)..(163): Any amino acid
  MOD_RES (173)..(193): Any amino acid
  MOD_RES (203)..(217): Any amino acid
  MOD_RES (229)..(260): Any amino acid
  MOD_RES (285)..(300): Any amino acid
  MOD_RES (314)..(314): Any amino acid
  MOD_RES (324)..(326): Any amino acid
  MOD_RES (345)..(357): Any amino acid
  MOD_RES (373)..(380): Any amino acid
  MOD_RES (432)..(433): Any amino acid
  MOD_RES (451)..(472): Any amino acid
  MOD_RES (490)..(497): Any amino acid
  MOD_RES (507)..(507): Any amino acid
  MOD_RES (520)..(541): Any amino acid
  MOD_RES (563)..(571): Any amino acid
  MOD_RES (599)..(599): Any amino acid
XXXXXXXXXXXXXXXXXXSDQICVGYHYHANNSTERVDTIMEKNVTVTHAQNIXXXXXXXXXXXLDGVRPLILRDCSXXXXXXXXXXXXXXXKVPEWSYIVXXXXXXXXXXXXXXFSDYEELKHLLSSTXXXXXXXXXXXXXXXXXXXXXXXXXXXXXXXXXXSFFRNVVWIXXXXXXXXXXXXXXXXXXXXXLLIIWGIHHXXXXXXXXXXXXXXXTYVSIGTSTLNXXXXXXXXXXXXXXXXXXXXXXXXXXXXXXXXINFDSNGNFIAPEYAYIVKKGDSAXXXXXXXXXXXXXXXXCQTPVGAINSSMPXMPLHNIHPLXXXECPKYVKSSKLILATGLRXXXXXXXXXXXXXKKRGLFGAIAGFIEGXXXXXXXXWYGYHHSNGQGSGYAADKESTQRAIDGVTNKINSIIDKMNTRFEAVGREFSXXERRIENLNRKMEDGFLDXXXXXXXXXXXXXXXXXXXXXXSNVKNLYDRVRLQLRDNXXXXXXXXFEFYHKCDDXCIESVRNGTYNYXXXXXXXXXXXXXXXXXXXXXXGVYQILSIYSTVVSSLALAIMXXXXXXXXXAGLLLWMCSNGSLQCRVCIKFVSSDCSX

SEQ ID NO: 418997 - protein, 599 aa, Influenza virus
  MOD_RES (1)..(21): Any amino acid
  MOD_RES (57)..(64): Any amino acid
  MOD_RES (77)..(115): Any amino acid
  MOD_RES (130)..(217): Any amino acid
  MOD_RES (227)..(271): Any amino acid
  MOD_RES (281)..(300): Any amino acid
  MOD_RES (314)..(326): Any amino acid
  MOD_RES (336)..(357): Any amino acid
  MOD_RES (367)..(380): Any amino acid
  MOD_RES (396)..(399): Any amino acid
  MOD_RES (427)..(507): Any amino acid
  MOD_RES (523)..(549): Any amino acid
  MOD_RES (563)..(571): Any amino acid
  MOD_RES (590)..(599): Any amino acid
XXXXXXXXXXXXXXXXXXXXXDQICIGYHANNSTEHVDTIMERNVTVTHAQDILERXXXXXXXXLEGVKPLILRNCXXXXXXXXXXXXXXXXXXXXXXXXXXXXXXXXXXXXXXXFRDYEELKHLLSRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXTHISVGTSTXXXXXXXXXXXXXXXXXXXXXXXXXXXXXXXXXXXXXXXXXXXXXPEYAYKVVKXXXXXXXXXXXXXXXXXXXXCQTPLGAINSSMPXXXXXXXXXXXXXECPKYVKSTXXXXXXXXXXXXXXXXXXXXXXRKRGLFGAIXXXXXXXXXXXXXXWYGYHHSKEQGSGYAXXXXSTQKAIDGITNKVNSIIDKMNTQFETVXXXXXXXXXXXXXXXXXXXXXXXXXXXXXXXXXXXXXXXXXXXXXXXXXXXXXXXXXXXXXXXXXXXXXXXXXXXXXXXXXCMDSVRNGTYSYPQYXXXXXXXXXXXXXXXXXXXXXXXXXXXYSTVASSLVLAIMXXXXXXXXXAGLSLWMCFNGSLQCRIAXXXXXXXXXX

SEQ ID NO: 418998 - protein, 599 aa, Influenza virus
  MOD_RES (1)..(21): Any amino acid
  MOD_RES (45)..(51): Any amino acid
  MOD_RES (61)..(274): Any amino acid
  MOD_RES (285)..(300): Any amino acid
  MOD_RES (314)..(358): Any amino acid
  MOD_RES (368)..(384): Any amino acid
  MOD_RES (394)..(403): Any amino acid
  MOD_RES (414)..(419): Any amino acid
  MOD_RES (430)..(510): Any amino acid
  MOD_RES (520)..(549): Any amino acid
  MOD_RES (563)..(576): Any amino acid
  MOD_RES (586)..(599): Any amino acid
XXXXXXXXXXXXXXXXXXXXXDHICIGYHANNSTKQVDTIMERNXXXXXXXDILEKAHNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYKIIKKGDSXXXXXXXXXXXXXXXXCQTPMGAVNSSMPXXXXXXXXXXXXXXXXXXXXXXXXXXXXXXXXXXXXXXXXXXXXXTRGLFGAIAXXXXXXXXXXXXXXXXXRHSNEQGSGXXXXXXXXXXAIDGITNKINXXXXXXNIQFEAVGREXXXXXXXXXXXXXXXXXXXXXXXXXXXXXXXXXXXXXXXXXXXXXXXXXXXXXXXXXXXXXXXXXXXXXXXXXXXXXXXXXSIRNGTYSYXXXXXXXXXXXXXXXXXXXXXXXXXXXXXXYSTVASSLTLAIMXXXXXXXXXXXXXXWMCSNGALQXXXXXXXXXXXXXX

SEQ ID NO: 418999 - protein, 599 aa, Influenza virus
  MOD_RES (1)..(21): Any amino acid
  MOD_RES (36)..(51): Any amino acid
  MOD_RES (61)..(305): Any amino acid
  MOD_RES (322)..(513): Any amino acid
  MOD_RES (523)..(554): Any amino acid
  MOD_RES (566)..(599): Any amino acid
XXXXXXXXXXXXXXXXXXXXXDQICVGYHANNSTVXXXXXXXXXXXXXXXXDILEKEHNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAIGAIDSSMPFHNVHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGTYDYPRYXXXXXXXXXXXXXXXXXXXXXXXXXXXXXXXXEFPSTGNHGSLXXXXXXXXXXXXXXXXXXXXXXXXXXXXXXXXXX

SEQ ID NO: 419000 - protein, 599 aa, Influenza virus
  MOD_RES (1)..(34): Any amino acid
  MOD_RES (44)..(51): Any amino acid
  MOD_RES (61)..(308): Any amino acid
  MOD_RES (321)..(599): Any amino acid
XXXXXXXXXXXXXXXXXXXXXXXXXXXXXXXXXXEQVDTIMERXXXXXXXXDILEKKHNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAINSSMPFHNVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419001 - protein, 599 aa, Influenza virus
  MOD_RES (1)..(308): Any amino acid
  MOD_RES (320)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAVNSSMPFHNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419002 - protein, 599 aa, Influenza virus
  MOD_RES (1)..(308): Any amino acid
  MOD_RES (321)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAINSSMPLHNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419003 - protein, 599 aa, Influenza virus
  MOD_RES (1)..(309): Any amino acid
  MOD_RES (319)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAINTSMPFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419004 - protein, 500 aa, Influenza virus
  MOD_RES (30)..(41): Any amino acid
  MOD_RES (54)..(74): Any amino acid
  MOD_RES (86)..(114): Any amino acid
  MOD_RES (240)..(240): Any amino acid
  MOD_RES (267)..(271): Any amino acid
  MOD_RES (289)..(292): Any amino acid
  MOD_RES (310)..(310): Any amino acid
  MOD_RES (331)..(333): Any amino acid
  MOD_RES (354)..(366): Any amino acid
  MOD_RES (388)..(388): Any amino acid
  MOD_RES (403)..(417): Any amino acid
  MOD_RES (456)..(456): Any amino acid
  MOD_RES (472)..(472): Any amino acid
LVFREQKQEFKMNPNKKIIEIITIGSICMXXXXXXXXXXXXNLDLNMGQPFYSXXXXXXXXXXXXXXXXXXXXXYENNTWVNQTYXXXXXXXXXXXXXXXXXXXXXXXXXXXXXGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRXNILRTQESECACVNGSCFTVMTDGPSXXXXXYKYKIFKNGKKGKWLNQXXXXAPNYHYEECSCYPDAGEXTCVCRDNWHGSNRPWVSFNQXXXYQIGYICSGVFGDNPRPNDGXXXXXXXXXXXXXGVKGFSFKYGNGVWIGRTKSTXSRSGFEMIWDPNGWXXXXXXXXXXXXXXXITDWSGYSGSFVQHPELTGLDCIRPCFWVELIRGRPKEXTIWTSGSSISFCGVNXIFLWCKIVTTVGWSWPDGAELPFTIDKS

SEQ ID NO: 419005 - protein, 500 aa, Influenza virus
  MOD_RES (1)..(1): Any amino acid
  MOD_RES (30)..(51): Any amino acid
  MOD_RES (61)..(74): Any amino acid
  MOD_RES (86)..(114): Any amino acid
  MOD_RES (240)..(240): Any amino acid
  MOD_RES (267)..(279): Any amino acid
  MOD_RES (289)..(292): Any amino acid
  MOD_RES (310)..(310): Any amino acid
  MOD_RES (331)..(333): Any amino acid
  MOD_RES (354)..(366): Any amino acid
  MOD_RES (388)..(388): Any amino acid
  MOD_RES (403)..(417): Any amino acid
  MOD_RES (456)..(456): Any amino acid
  MOD_RES (472)..(483): Any amino acid
  MOD_RES (496)..(500): Any amino acid
XGLREQKQEFKMNPNQKIIRDITIGSICMXXXXXXXXXXXXXXXXXXXXXXGPSHSIHTGXXXXXXXXXXXXXXYENTTWVNQTYXXXXXXXXXXXXXXXXXXXXXXXXXXXXXGWAVHSKDNSIRIGSRGDVFVVREPFISCSQMECRTFFLTHGALLNDKHSNETVKDRSPYRTLMSCPMGEAPSPYNSKFESVAWSASACHDGISWLTIGVSGPDNGAVAVVKYNGMITDTIKSWGXNIMRTQESECACINGSCFTIMTDGPSXXXXXXXXXXXXXGKRGKWVKSXXXXAPDYHYEECSCYPNAGEXICVCRDNWHGSNRPWISFNQXXXYRIGYICSGIFGDNPRPSDGXXXXXXXXXXXXXGIKGFSFKYGDGVWIGRTKSPXSRSGFEMVWDPNGWXXXXXXXXXXXXXXXLTDWSGYSGSFIQHPELTGLNCIRPCFWVELVRGRPKEXTVWTSGSSISFCGVSXXXXXXXXXXXXSWSWPDGAELPSXXXXX

SEQ ID NO: 419006 - protein, 500 aa, Influenza virus
  MOD_RES (1)..(1): Any amino acid
  MOD_RES (20)..(74): Any amino acid
  MOD_RES (86)..(114): Any amino acid
  MOD_RES (194)..(198): Any amino acid
  MOD_RES (240)..(240): Any amino acid
  MOD_RES (267)..(292): Any amino acid
  MOD_RES (310)..(310): Any amino acid
  MOD_RES (331)..(333): Any amino acid
  MOD_RES (354)..(366): Any amino acid
  MOD_RES (388)..(388): Any amino acid
  MOD_RES (400)..(417): Any amino acid
  MOD_RES (456)..(456): Any amino acid
  MOD_RES (472)..(483): Any amino acid
XFSGSQKQEFKMNPNQKIMXXXXXXXXXXXXXXXXXXXXXXXXXXXXXXXXXXXXXXXXXXXXXXXXXXXXXXXYKNNTWVNQTFXXXXXXXXXXXXXXXXXXXXXXXXXXXXXGWAIHSKDNNIRIGSKGDVFVTREPFISCSHMECRTFFLTQGSLLNDKHSNGTIKDRSPHRALMSCPVGEVPSPYNSRFXXXXXSASACHDGSSWLTIGISGPDSGAVAVLKYDGIITDTIRSWRXNTLRTQESECACANGFCFTVMTDGPNXXXXXXXXXXXXXXXXXXXXXXXXXXAPNYYYEECSCYPDSGEXMCVCRDNWHGSNRPWLSFNQXXXYKIGYICSGFFGDNPRPDDGXXXXXXXXXXXXXGVKGFAFKYGNGAWIGRTKSTXSRSGFEIIWDPXXXXXXXXXXXXXXXXXXTTDWSGYSGSFVQHPEMTGLDCMRPCFWVELIRGQPKEXTVWTSGSIISFCGVNXXXXXXXXXXXXGWSWPDDAELPFTIDKY

SEQ ID NO: 419007 - protein, 500 aa, Influenza virus
  MOD_RES (1)..(5): Any amino acid
  MOD_RES (28)..(74): Any amino acid
  MOD_RES (86)..(114): Any amino acid
  MOD_RES (155)..(159): Any amino acid
  MOD_RES (190)..(199): Any amino acid
  MOD_RES (240)..(240): Any amino acid
  MOD_RES (250)..(254): Any amino acid
  MOD_RES (265)..(299): Any amino acid
  MOD_RES (310)..(310): Any amino acid
  MOD_RES (320)..(320): Any amino acid
  MOD_RES (331)..(333): Any amino acid
  MOD_RES (354)..(366): Any amino acid
  MOD_RES (388)..(391): Any amino acid
  MOD_RES (403)..(417): Any amino acid
  MOD_RES (428)..(429): Any amino acid
  MOD_RES (455)..(456): Any amino acid
  MOD_RES (472)..(483): Any amino acid
  MOD_RES (496)..(500): Any amino acid
XXXXXQKQEIKMNPNQKINRDITIGSIXXXXXXXXXXXXXXXXXXXXXXXXXXXXXXXXXXXXXXXXXXXXXXXNQNSTWVSQTYXXXXXXXXXXXXXXXXXXXXXXXXXXXXXGWAIYSKDNGIRIGSKGDVFIIREPFISCSHSECRTFFLTXXXXXNDKHSNGTAKDRSPQRTLMSCPIGEAPSPYXXXXXXXXXXASACHDGTNWLTIGISGPDNEAVAVLKYNGLITDTIKSWKXSILRTQESEXXXXXGYCFTVMTDGXXXXXXXXXXXXXXXXXXXXXXXXXXXXXXXXXXXECSCYPDASEXTCVCRDSWHXSNRPWVSFDQXXXYQVGYICSGVFGDTPRPNDGXXXXXXXXXXXXXGVKGFSFRYGNGVWIGRTKSIXXXXGFEMIWDPDGWXXXXXXXXXXXXXXXITEWSGYSGSXXQHPELTGVDCIRPCFWIELIRGRPKXXTIWASGSSISFCGVDXXXXXXXXXXXXSWSWPDDAELPLXXXXX

SEQ ID NO: 419008 - protein, 500 aa, Influenza virus
  MOD_RES (1)..(75): Any amino acid
  MOD_RES (85)..(118): Any amino acid
  MOD_RES (150)..(161): Any amino acid
  MOD_RES (178)..(180): Any amino acid
  MOD_RES (193)..(199): Any amino acid
  MOD_RES (213)..(213): Any amino acid
  MOD_RES (236)..(240): Any amino acid
  MOD_RES (250)..(300): Any amino acid
  MOD_RES (310)..(321): Any amino acid
  MOD_RES (331)..(335): Any amino acid
  MOD_RES (354)..(366): Any amino acid
  MOD_RES (377)..(378): Any amino acid
  MOD_RES (388)..(417): Any amino acid
  MOD_RES (427)..(434): Any amino acid
  MOD_RES (456)..(456): Any amino acid
  MOD_RES (467)..(483): Any amino acid
  MOD_RES (493)..(500): Any amino acid
XXXXXXXXXXXXXXXXXXXXXXXXXXXXXXXXXXXXXXXXXXXXXXXXXXXXXXXXXXXXXXXXXXXXXXXXXXXENNTWGNQTXXXXXXXXXXXXXXXXXXXXXXXXXXXXXXXXXXHSKDNGIRIGSRGDVFIIREPFVSCSHLECRXXXXXXXXXXXXKHSNGTVNDRSPHRTLXXXPVGVAPSPYNSRXXXXXXXASACHDGASWLTIXISGPDDGAVAVLKYKGIITDTIXXXXXNVLRTQESEXXXXXXXXXXXXXXXXXXXXXXXXXXXXXXXXXXXXXXXXXXXXXXXXXXXCSCYPDAGKXXXXXXXXXXXXNRPWVSFTQXXXXXIGYICSGVLGDSPRPNDGXXXXXXXXXXXXXGIKGFSFRYGXXVWIGRTKSAXXXXXXXXXXXXXXXXXXXXXXXXXXXXXXVTDWSGYSGXXXXXXXXTGLNCMRPCFWVELIRGRPEEXTIWTSGSIISXXXXXXXXXXXXXXXXXDWSWPDGAEXXXXXXXX

SEQ ID NO: 419009 - protein, 500 aa, Influenza virus
  MOD_RES (1)..(131): Any amino acid
  MOD_RES (154)..(171): Any amino acid
  MOD_RES (184)..(210): Any amino acid
  MOD_RES (220)..(228): Any amino acid
  MOD_RES (238)..(335): Any amino acid
  MOD_RES (353)..(368): Any amino acid
  MOD_RES (382)..(437): Any amino acid
  MOD_RES (450)..(486): Any amino acid
  MOD_RES (496)..(500): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDVFAIREPFISCSYLECRTFFLXXXXXXXXXXXXXXXXXXSPHRSLMSCPVGXXXXXXXXXXXXXXXXXXXXXXXXXXXIIGISGPDNXXXXXXXXXGVITDTIKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMGYICSGVFGDSPRPNDXXXXXXXXXXXXXXXXKGFSYKYGNGVWIXXXXXXXXXXXXXXXXXXXXXXXXXXXXXXXXXXXXXXXXXXXXXXXXXXXXXXXXDCIKPCFWVELIXXXXXXXXXXXXXXXXXXXXXXXXXXXXXXXXXXXXXWPDRAELPFXXXXX

SEQ ID NO: 419010 - protein, 500 aa, Influenza virus
  MOD_RES (1)..(133): Any amino acid
  MOD_RES (143)..(500): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFVIREPFVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419011 - protein, 500 aa, Influenza virus
  MOD_RES (1)..(137): Any amino acid
  MOD_RES (147)..(500): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAPFISCSYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419012 - protein, 573 aa, Influenza virus
  MOD_RES (1)..(15): Any amino acid
  MOD_RES (48)..(73): Any amino acid
  MOD_RES (84)..(88): Any amino acid
  MOD_RES (102)..(152): Any amino acid
  MOD_RES (171)..(217): Any amino acid
  MOD_RES (227)..(229): Any amino acid
  MOD_RES (242)..(257): Any amino acid
  MOD_RES (276)..(287): Any amino acid
  MOD_RES (299)..(339): Any amino acid
  MOD_RES (401)..(441): Any amino acid
  MOD_RES (511)..(536): Any amino acid
XXXXXXXXXXXXXXXGDQICIGYHANNSTEQVDTIMEKNVTVTHAQDXXXXXXXXXXXXXXXXXXXXXXXXXXAGWLLGNPMCXXXXXVPEWSYIVEKDNPXXXXXXXXXXXXXXXXXXXXXXXXXXXXXXXXXXXXXXXXXXXXXXXXXXXYYNGRSSFFRNVVWLIKKXXXXXXXXXXXXXXXXXXXXXXXXXXXXXXXXXXXXXXXXXXXXXXXGTSTLNQRSXXXIATRPKVNGQSGXXXXXXXXXXXXXXXXFESNGNFIAPEYAYKIVKXXXXXXXXXXXXYGNCDTKCQTPXXXXXXXXXXXXXXXXXXXXXXXXXXXXXXXXXXXXXXXXXRKRKRKTRGLFGGLFGAIAGFIEGGWQGMVDGWYGYHHSNEQGSGYAADKESTQKAIDGITXXXXXXXXXXXXXXXXXXXXXXXXXXXXXXXXXXXXXXXXXVWTYNAELLVLMENERTLDFHDSNVKNLYDKVRLQLRDNAKELGNGCFEFYHKCDNECMESVRNGTYDYXXXXXXXXXXXXXXXXXXXXXXXXXXILSIYSTVASSLALAIMIAGLSFWMCSNGSLQCRICI

SEQ ID NO: 419013 - protein, 573 aa, Influenza virus
  MOD_RES (1)..(15): Any amino acid
  MOD_RES (47)..(73): Any amino acid
  MOD_RES (84)..(88): Any amino acid
  MOD_RES (102)..(152): Any amino acid
  MOD_RES (169)..(217): Any amino acid
  MOD_RES (227)..(229): Any amino acid
  MOD_RES (242)..(257): Any amino acid
  MOD_RES (276)..(287): Any amino acid
  MOD_RES (299)..(344): Any amino acid
  MOD_RES (401)..(441): Any amino acid
  MOD_RES (511)..(536): Any amino acid
XXXXXXXXXXXXXXXSDQICIGYHANNSKKQIDTIMEKNVIFTHAQXXXXXXXXXXXXXXXXXXXXXXXXXXXAGLVLGNPMCXXXXXAPEWSYIVEKNNPXXXXXXXXXXXXXXXXXXXXXXXXXXXXXXXXXXXXXXXXXXXXXXXXXXXYHTGRSSFFRNIVWLIXXXXXXXXXXXXXXXXXXXXXXXXXXXXXXXXXXXXXXXXXXXXXXXXXGTSTLNQRLXXXIATRPQVNGQRGXXXXXXXXXXXXXXXXFESTGNFIAPEYAFKIAKXXXXXXXXXXXXYGNCNTKCQTPXXXXXXXXXXXXXXXXXXXXXXXXXXXXXXXXXXXXXXXXXXXXXXEKRRKKRGLFGAIAGFIEGGWQGLVDGWYGYHHINGQGSGYAADRKSTQKAIDGVTXXXXXXXXXXXXXXXXXXXXXXXXXXXXXXXXXXXXXXXXXVWTYNTELLVLMENERTLYFHDSNVKNLYNKVRLQLKDNARELGNGCFEFYHRCDNECMESVKNGTYDYXXXXXXXXXXXXXXXXXXXXXXXXXXILSIYSTVVSSLVLAIMVAGLSFWMCSNGSLQCRVCI

SEQ ID NO: 419014 - protein, 573 aa, Influenza virus
  MOD_RES (1)..(15): Any amino acid
  MOD_RES (48)..(73): Any amino acid
  MOD_RES (84)..(88): Any amino acid
  MOD_RES (102)..(157): Any amino acid
  MOD_RES (170)..(217): Any amino acid
  MOD_RES (227)..(229): Any amino acid
  MOD_RES (242)..(263): Any amino acid
  MOD_RES (276)..(287): Any amino acid
  MOD_RES (299)..(344): Any amino acid
  MOD_RES (355)..(360): Any amino acid
  MOD_RES (401)..(441): Any amino acid
  MOD_RES (497)..(497): Any amino acid
  MOD_RES (511)..(536): Any amino acid
XXXXXXXXXXXXXXXGDRICIGYHANNSTKQVDTIMEKIVTVTHAQDXXXXXXXXXXXXXXXXXXXXXXXXXXAGWLIGNPKCXXXXXTPEWSYIVEKANPXXXXXXXXXXXXXXXXXXXXXXXXXXXXXXXXXXXXXXXXXXXXXXXXXXXXXXXXSSFYRNVVWLIKXXXXXXXXXXXXXXXXXXXXXXXXXXXXXXXXXXXXXXXXXXXXXXXXGTSTLNKRSXXXIATRPRVNGQSGXXXXXXXXXXXXXXXXXXXXXXFIAPEYAYRIIKXXXXXXXXXXXXYGNCNAKCQTPXXXXXXXXXXXXXXXXXXXXXXXXXXXXXXXXXXXXXXXXXXXXXXERRRKKRGLFXXXXXXIEGGWQGMIDGWYGYHHTNDQGSGYAADKKSTQKAINGITXXXXXXXXXXXXXXXXXXXXXXXXXXXXXXXXXXXXXXXXXVWTYNAELFVLMENERTLDLHDSNVKNLYDKVRHQLRDNAKEMGNGCFEFYHKCNXKCMESVRNGTYNYXXXXXXXXXXXXXXXXXXXXXXXXXXILSIYSSVASSLVLAIMMAGLSFWMCSNGSLQCTICI

SEQ ID NO: 419015 - protein, 573 aa, Influenza virus
  MOD_RES (1)..(15): Any amino acid
  MOD_RES (48)..(73): Any amino acid
  MOD_RES (84)..(91): Any amino acid
  MOD_RES (102)..(157): Any amino acid
  MOD_RES (171)..(217): Any amino acid
  MOD_RES (227)..(229): Any amino acid
  MOD_RES (240)..(266): Any amino acid
  MOD_RES (276)..(287): Any amino acid
  MOD_RES (299)..(348): Any amino acid
  MOD_RES (359)..(369): Any amino acid
  MOD_RES (401)..(444): Any amino acid
  MOD_RES (511)..(536): Any amino acid
  MOD_RES (567)..(573): Any amino acid
XXXXXXXXXXXXXXXSDRICIGYHANNSTKQIDTIMERNVTVTHAQNXXXXXXXXXXXXXXXXXXXXXXXXXXAGWILGNPMCXXXXXXXXWSYIVEKDSPXXXXXXXXXXXXXXXXXXXXXXXXXXXXXXXXXXXXXXXXXXXXXXXXXXXXXXXXPSFFRNVVWLTKKXXXXXXXXXXXXXXXXXXXXXXXXXXXXXXXXXXXXXXXXXXXXXXXGTPTLNQRSXXXIAIRPKVNGQXXXXXXXXXXXXXXXXXXXXXXXXXXXPEYAYKIIKXXXXXXXXXXXXYGNCDAKCQTPXXXXXXXXXXXXXXXXXXXXXXXXXXXXXXXXXXXXXXXXXXXXXXXXXXETRGLFGAIAXXXXXXXXXXXDGWYGYHHNNAQGSGYAADKDSTQKAVDGITXXXXXXXXXXXXXXXXXXXXXXXXXXXXXXXXXXXXXXXXXXXXYNAELLVLIENERTLDFHDSNVRNLYDKVRFQLKDNAKEWGNGCFEFYHKCDDVCMESVRNGTYKYXXXXXXXXXXXXXXXXXXXXXXXXXXILSVYSTVASSLTLAIMIAGLFFWMCSNGSXXXXXXX

SEQ ID NO: 419016 - protein, 573 aa, Influenza virus
  MOD_RES (1)..(15): Any amino acid
  MOD_RES (48)..(91): Any amino acid
  MOD_RES (102)..(159): Any amino acid
  MOD_RES (171)..(217): Any amino acid
  MOD_RES (227)..(229): Any amino acid
  MOD_RES (242)..(266): Any amino acid
  MOD_RES (276)..(348): Any amino acid
  MOD_RES (358)..(378): Any amino acid
  MOD_RES (401)..(446): Any amino acid
  MOD_RES (456)..(467): Any amino acid
  MOD_RES (488)..(488): Any amino acid
  MOD_RES (509)..(536): Any amino acid
  MOD_RES (548)..(549): Any amino acid
  MOD_RES (561)..(573): Any amino acid
XXXXXXXXXXXXXXXSDQICIGHHANNSTEQVDTIMERNVTVTHARDXXXXXXXXXXXXXXXXXXXXXXXXXXXXXXXXXXXXXXXXXXXXWSYIVEKDKPXXXXXXXXXXXXXXXXXXXXXXXXXXXXXXXXXXXXXXXXXXXXXXXXXXXXXXXXXXFFRNVVWLVKKXXXXXXXXXXXXXXXXXXXXXXXXXXXXXXXXXXXXXXXXXXXXXXXGTSTLNHRSXXXIATRSKVNGQSGXXXXXXXXXXXXXXXXXXXXXXXXXPEYAYKIAKXXXXXXXXXXXXXXXXXXXXXXXXXXXXXXXXXXXXXXXXXXXXXXXXXXXXXXXXXXXXXXXXXXXXXXXXXKTRGLFGAIXXXXXXXXXXXXXXXXXXXXXNEQGGGYAADKESTQRAIDGITXXXXXXXXXXXXXXXXXXXXXXXXXXXXXXXXXXXXXXXXXXXXXXAEFLVLMENXXXXXXXXXXXXKLYDRVRLQLRNNAKELGNGXFEFYHRCDDECIESVRNGTYXXXXXXXXXXXXXXXXXXXXXXXXXXXXILTIYSTVASSXXLAIIIAGLSFWXXXXXXXXXXXXX

SEQ ID NO: 419017 - protein, 573 aa, Influenza virus
  MOD_RES (1)..(16): Any amino acid
  MOD_RES (46)..(232): Any amino acid
  MOD_RES (242)..(348): Any amino acid
  MOD_RES (358)..(379): Any amino acid
  MOD_RES (394)..(448): Any amino acid
  MOD_RES (462)..(488): Any amino acid
  MOD_RES (498)..(500): Any amino acid
  MOD_RES (511)..(543): Any amino acid
  MOD_RES (553)..(553): Any amino acid
  MOD_RES (563)..(573): Any amino acid
XXXXXXXXXXXXXXXXDRICVGYHANNSTEQVDTIREKNVTVTRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLKVNGQSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXETKGLFGAIXXXXXXXXXXXXXXXXXXXXXXEHGSGYAADKASTQXXXXXXXXXXXXXXXXXXXXXXXXXXXXXXXXXXXXXXXXXXXXXXXXXXXXXXXLLVLMETERTLDFXXXXXXXXXXXXXXXXXXXXXXXXXXXFKFYHKCDNXXXESVKNGTYNYXXXXXXXXXXXXXXXXXXXXXXXXXXXXXXXXXVVSSLALAIXVAGLSLWMCXXXXXXXXXXX

SEQ ID NO: 419018 - protein, 573 aa, Influenza virus
  MOD_RES (1)..(30): Any amino acid
  MOD_RES (47)..(381): Any amino acid
  MOD_RES (399)..(452): Any amino acid
  MOD_RES (462)..(557): Any amino acid
  MOD_RES (568)..(573): Any amino acid
XXXXXXXXXXXXXXXXXXXXXXXXXXXXXXQVDTIVEKNVTVTHTQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSGYAANKESTQKAINGXXXXXXXXXXXXXXXXXXXXXXXXXXXXXXXXXXXXXXXXXXXXXXXXXXXXXXMVNERTLDFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLCMCSNGSLXXXXXX

SEQ ID NO: 419019 - protein, 573 aa, Influenza virus
  MOD_RES (1)..(32): Any amino acid
  MOD_RES (48)..(382): Any amino acid
  MOD_RES (399)..(558): Any amino acid
  MOD_RES (568)..(573): Any amino acid
XXXXXXXXXXXXXXXXXXXXXXXXXXXXXXXXDTTMEKNVTVTQAQDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGYGEDNESTQKAVDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYWMCSNGSLXXXXXX

SEQ ID NO: 419020 - protein, 573 aa, Influenza virus
  MOD_RES (1)..(32): Any amino acid
  MOD_RES (47)..(573): Any amino acid
XXXXXXXXXXXXXXXXXXXXXXXXXXXXXXXXDTIMEKSVTVSHAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419021 - protein, 573 aa, Influenza virus
  MOD_RES (1)..(34): Any amino acid
  MOD_RES (44)..(573): Any amino acid
XXXXXXXXXXXXXXXXXXXXXXXXXXXXXXXXXXIIEKNVTVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419022 - protein, 471 aa, Influenza virus
  MOD_RES (1)..(6): Any amino acid
  MOD_RES (16)..(83): Any amino acid
  MOD_RES (126)..(127): Any amino acid
  MOD_RES (205)..(216): Any amino acid
  MOD_RES (235)..(236): Any amino acid
  MOD_RES (251)..(265): Any amino acid
  MOD_RES (283)..(283): Any amino acid
  MOD_RES (313)..(315): Any amino acid
  MOD_RES (334)..(334): Any amino acid
  MOD_RES (359)..(360): Any amino acid
  MOD_RES (383)..(403): Any amino acid
  MOD_RES (416)..(417): Any amino acid
  MOD_RES (436)..(436): Any amino acid
  MOD_RES (471)..(471): Any amino acid
XXXXXXIITIGSVSLXXXXXXXXXXXXXXXXXXXXXXXXXXXXXXXXXXXXXXXXXXXXXXXXXXXXXXXXXXXXXXXXXXXXYRNWSKPQCQITGFAPFSKDNSIRLSAGGDIWVTREPYVSCDXXKCYQFALGQGTTLDNKHSNGTIHDRIPHRTLLMNELGVPFHLGTKQVCIAWSSSSCHDGKAWLHVCVTGDDRNATASXXXXXXXXXXXXSWSQNILRTQESECVCINXXCTVVMTDGSASGRAXXXXXXXXXXXXXXXSPLSGSAQHIEECSCYPXSYPNVRCVCRDNWKGSNRPVKLDINMADYXXXSSYVCSGLVGDTPRNDDSXSSSNCRDPNNERGNPGVKGWAFDNXXDVWMGRTISKDSRSGYETFRVIXXXXXXXXXXXXXXXXXXXXXNWSGYSGIFSVEXXSCINRCFYVELIRGRPQEXRVWWTSNSIVVFCGTSGTYGTGSWPDGANINFMPX

SEQ ID NO: 419023 - protein, 471 aa, Influenza virus
  MOD_RES (1)..(6): Any amino acid
  MOD_RES (16)..(83): Any amino acid
  MOD_RES (126)..(127): Any amino acid
  MOD_RES (205)..(216): Any amino acid
  MOD_RES (234)..(236): Any amino acid
  MOD_RES (251)..(265): Any amino acid
  MOD_RES (277)..(283): Any amino acid
  MOD_RES (304)..(315): Any amino acid
  MOD_RES (334)..(334): Any amino acid
  MOD_RES (359)..(360): Any amino acid
  MOD_RES (383)..(403): Any amino acid
  MOD_RES (416)..(417): Any amino acid
  MOD_RES (436)..(436): Any amino acid
  MOD_RES (451)..(456): Any amino acid
  MOD_RES (471)..(471): Any amino acid
XXXXXXIITIGSISLXXXXXXXXXXXXXXXXXXXXXXXXXXXXXXXXXXXXXXXXXXXXXXXXXXXXXXXXXXXXXXXXXXXXYRDWSKPQCQVTGFAPFSKDNSIQLSAGGDIWITREPYVSCSXXRCYQFALGQGTTLNNNHSNGTIHDRTPHRTLLMSELGVPFHLGTRQVCIAWSSSSCYDGKAWLHICVTGDDKNATASXXXXXXXXXXXXSWSKNILRTQESECICIXXXCAVVMTDGSASRKAXXXXXXXXXXXXXXXSPLTGSAQHIEXXXXXXXSYLNVRCVCRDNWMGSNRPVXXXXXXXXXXXXSSYICSGLVGDTPRNNDSXSNSNCKDPNNERGNSGVKGWAFDYXXDIWMGRTISKNSRSGYETFKVIXXXXXXXXXXXXXXXXXXXXXNWSGYSGVFSVEXXSCVNRCFYVELIRGRPKEXRVWWTTNSIVVFCGXXXXXXTGSWPDGADINFMPX

SEQ ID NO: 419024 - protein, 471 aa, Influenza virus
  MOD_RES (1)..(6): Any amino acid
  MOD_RES (16)..(83): Any amino acid
  MOD_RES (104)..(106): Any amino acid
  MOD_RES (116)..(116): Any amino acid
  MOD_RES (126)..(132): Any amino acid
  MOD_RES (142)..(142): Any amino acid
  MOD_RES (205)..(216): Any amino acid
  MOD_RES (235)..(236): Any amino acid
  MOD_RES (251)..(265): Any amino acid
  MOD_RES (276)..(287): Any amino acid
  MOD_RES (304)..(315): Any amino acid
  MOD_RES (334)..(334): Any amino acid
  MOD_RES (359)..(360): Any amino acid
  MOD_RES (383)..(403): Any amino acid
  MOD_RES (416)..(417): Any amino acid
  MOD_RES (434)..(437): Any amino acid
  MOD_RES (448)..(459): Any amino acid
  MOD_RES (471)..(471): Any amino acid
XXXXXXIITIGSASLXXXXXXXXXXXXXXXXXXXXXXXXXXXXXXXXXXXXXXXXXXXXXXXXXXXXXXXXXXXXXXXXXXXXYWNWSKPQCQIAGFAPFSKDXXXRLSAGGNIWXTREPYVSCGXXXXXXXALGQGTTLKXRHSNGTIHDRSSYRTLLMNELGIPFHLGTKQVCMAWSSSSCHDGRAWLHVCVTGDDGNATASXXXXXXXXXXXXSWSQNILKKQESECVCISXXCTVIMTDGSASGKAXXXXXXXXXXXXXXXSSLSGSAQHIXXXXXXXXXXXXIRCVCRDNWKGSNRPIXXXXXXXXXXXXSRYICSGLVGDTPRNDDGXSNSNCRDPNNEKGSQGVKGWAFDDXXDVWMGRTVSKDSRSGYETFRVTXXXXXXXXXXXXXXXXXXXXXNRSGYSGIFSIEXXGCINRCFYVEMIRGRPXXXXVWWTSNSIIVXXXXXXXXXXXXWPDGANINLMPX

SEQ ID NO: 419025 - protein, 471 aa, Influenza virus
  MOD_RES (1)..(6): Any amino acid
  MOD_RES (16)..(83): Any amino acid
  MOD_RES (101)..(106): Any amino acid
  MOD_RES (116)..(133): Any amino acid
  MOD_RES (143)..(144): Any amino acid
  MOD_RES (170)..(171): Any amino acid
  MOD_RES (204)..(216): Any amino acid
  MOD_RES (235)..(236): Any amino acid
  MOD_RES (251)..(265): Any amino acid
  MOD_RES (277)..(287): Any amino acid
  MOD_RES (300)..(315): Any amino acid
  MOD_RES (334)..(334): Any amino acid
  MOD_RES (345)..(346): Any amino acid
  MOD_RES (359)..(360): Any amino acid
  MOD_RES (383)..(417): Any amino acid
  MOD_RES (427)..(438): Any amino acid
  MOD_RES (456)..(461): Any amino acid
  MOD_RES (471)..(471): Any amino acid
XXXXXXIIAIGSVSLXXXXXXXXXXXXXXXXXXXXXXXXXXXXXXXXXXXXXXXXXXXXXXXXXXXXXXXXXXXXXXXXXXXXYRSWSKPQCEITGFAPFXXXXXXRLSAGGSIWXXXXXXXXXXXXXXXXXXLGQGTTLDHXXSNDTIHDRTSHRTLLMNELGVPFHMXXKQVCVAWSSSSCHDGNAWLHVCVTGNDRNATAXXXXXXXXXXXXXSCSQNILRTQESECVCVNXXCAVVMTDGNASGRAXXXXXXXXXXXXXXXSPLSGNAQHIEXXXXXXXXXXXVRCICRDNWKGSXXXXXXXXXXXXXXXXSHYVCSGLVGDTPRNDDIXSSSNCKDPNNXXGSPGVKGWAFDIXXDVWMGRTINEDSRSGYETFRVLXXXXXXXXXXXXXXXXXXXXXXXXXXXXXXXXXXXHCINRCFYVXXXXXXXXXXXXWWTSNSIVAFCGTSGTYXXXXXXDGANINFMAX

SEQ ID NO: 419026 - protein, 471 aa, Influenza virus
  MOD_RES (1)..(6): Any amino acid
  MOD_RES (16)..(83): Any amino acid
  MOD_RES (101)..(106): Any amino acid
  MOD_RES (116)..(133): Any amino acid
  MOD_RES (143)..(153): Any amino acid
  MOD_RES (163)..(167): Any amino acid
  MOD_RES (193)..(194): Any amino acid
  MOD_RES (205)..(225): Any amino acid
  MOD_RES (235)..(241): Any amino acid
  MOD_RES (251)..(265): Any amino acid
  MOD_RES (279)..(287): Any amino acid
  MOD_RES (304)..(334): Any amino acid
  MOD_RES (359)..(364): Any amino acid
  MOD_RES (383)..(417): Any amino acid
  MOD_RES (427)..(461): Any amino acid
  MOD_RES (471)..(471): Any amino acid
XXXXXXIITVGSVSLXXXXXXXXXXXXXXXXXXXXXXXXXXXXXXXXXXXXXXXXXXXXXXXXXXXXXXXXXXXXXXXXXXXXYKNWSKPQCKITGFAPFXXXXXXRLSAGGGIWXXXXXXXXXXXXXXXXXXLGQGTPLNNXXXXXXXXXXXPYRTLLMNEXXXXXHLGTKQVCVAWSRSSCHDGKAWLHIXXTGDDRKATASXXXXXXXXXXXXXXXXXXXXXQESECVCIDXXXXXXXTDGSATGKAXXXXXXXXXXXXXXXVPPLGSAQATEECXXXXXXXXXVTCVCRDNWKSSNRPVXXXXXXXXXXXXXXXXXXXXXXXXXXXXXXXSSSNCRDSNNERGHPGVKGWAFDSXXXXXXGRTISRDSRSGYETFRIIXXXXXXXXXXXXXXXXXXXXXXXXXXXXXXXXXXXNCINRCFYVXXXXXXXXXXXXXXXXXXXXXXXXXXXXXXXXXXXDGANINFMSX

SEQ ID NO: 419027 - protein, 471 aa, Influenza virus
  MOD_RES (1)..(133): Any amino acid
  MOD_RES (143)..(175): Any amino acid
  MOD_RES (194)..(195): Any amino acid
  MOD_RES (205)..(266): Any amino acid
  MOD_RES (283)..(337): Any amino acid
  MOD_RES (347)..(364): Any amino acid
  MOD_RES (378)..(425): Any amino acid
  MOD_RES (435)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGQGTTLDSXXXXXXXXXXXXXXXXXXXXXXXXXXXXXXXXXIAWSRSSCHDGRAWLHICXXGHDKNATASXXXXXXXXXXXXXXXXXXXXXXXXXXXXXXXXXXXXXXXXXXXXXXXXXXXXXXXXXXXXXXPLSGSAQHVEECSCYPXXXXXXXXXXXXXXXXXXXXXXXXXXXXXXXXXXXXXXXXXXXXXXXXXXXXXXXNCRDPNNESXXXXXXXXXXXXXXXXXXGRTISEDSRSGYEXXXXXXXXXXXXXXXXXXXXXXXXXXXXXXXXXXXXXXXXXXXXXXXXLELIRGRPQXXXXXXXXXXXXXXXXXXXXXXXXXXXXXXXXXXXXX

SEQ ID NO: 419028 - protein, 471 aa, Influenza virus
  MOD_RES (1)..(185): Any amino acid
  MOD_RES (199)..(270): Any amino acid
  MOD_RES (280)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKAWLHVCITGDDXXXXXXXXXXXXXXXXXXXXXXXXXXXXXXXXXXXXXXXXXXXXXXXXXXXXXXXXXXXXXXXXXXXXXXXXGAQHIEECSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419029 - protein, 570 aa, Influenza virus
  MOD_RES (1)..(13): Any amino acid
  MOD_RES (52)..(73): Any amino acid
  MOD_RES (85)..(89): Any amino acid
  MOD_RES (100)..(100): Any amino acid
  MOD_RES (110)..(157): Any amino acid
  MOD_RES (168)..(188): Any amino acid
  MOD_RES (200)..(240): Any amino acid
  MOD_RES (274)..(277): Any amino acid
  MOD_RES (287)..(306): Any amino acid
  MOD_RES (329)..(329): Any amino acid
  MOD_RES (343)..(344): Any amino acid
  MOD_RES (391)..(393): Any amino acid
  MOD_RES (413)..(413): Any amino acid
  MOD_RES (424)..(424): Any amino acid
  MOD_RES (463)..(467): Any amino acid
  MOD_RES (495)..(496): Any amino acid
  MOD_RES (510)..(526): Any amino acid
  MOD_RES (550)..(554): Any amino acid
XXXXXXXXXXXXXGKSDKICIGYHANNSTTQVDTILEKNVTVTHSVELLENXXXXXXXXXXXXXXXXXXXXXXEGWILGNPQCDXXXXXQSWSYIVERPXAQNGICYPGXXXXXXXXXXXXXXXXXXXXXXXXXXXXXXXXXXXXXXXXXXXXXXXXSSFYRNLLWIXXXXXXXXXXXXXXXXXXXXXPILYFWGVHHPXXXXXXXXXXXXXXXXXXXXXXXXXXXXXXXXXXXXXXXXXRGRIDYYWSVLKPGETLNVESNGNLIAPWYAYKXXXXNNNKGAVFKXXXXXXXXXXXXXXXXXXXXTNKTFQNVSPLWIGECPKYVKSXSLRLATGLRNVPQXXTRGLFGAIAGFIEGGWTGMIDGWYGYHHENSQGSGYAADKESTQKAXXXITNKVNSIIDKMNTQFEAVXHEFSNLERRIXNLNKRMEDGFLDVWTYNAELLVLLENERTLDLHDANVKXXXXXVKSQLRDNANDLGNGCFEFWHKCDNECXXSVKNGTYDYPKYQXXXXXXXXXXXXXXXXXLGVYQILAIYSTVSSSLVLVGLIXXXXXWMCSNGSMQCRICIGS

SEQ ID NO: 419030 - protein, 570 aa, Influenza virus
  MOD_RES (1)..(13): Any amino acid
  MOD_RES (52)..(73): Any amino acid
  MOD_RES (85)..(89): Any amino acid
  MOD_RES (100)..(100): Any amino acid
  MOD_RES (110)..(157): Any amino acid
  MOD_RES (168)..(188): Any amino acid
  MOD_RES (199)..(240): Any amino acid
  MOD_RES (274)..(306): Any amino acid
  MOD_RES (329)..(329): Any amino acid
  MOD_RES (343)..(344): Any amino acid
  MOD_RES (372)..(375): Any amino acid
  MOD_RES (391)..(393): Any amino acid
  MOD_RES (413)..(413): Any amino acid
  MOD_RES (424)..(424): Any amino acid
  MOD_RES (463)..(467): Any amino acid
  MOD_RES (495)..(496): Any amino acid
  MOD_RES (510)..(526): Any amino acid
  MOD_RES (550)..(554): Any amino acid
  MOD_RES (569)..(570): Any amino acid
XXXXXXXXXXXXXGRSDKICIGYHANNSTTKVDTILERNVTVTHSVELLESXXXXXXXXXXXXXXXXXXXXXXEGWILGNPRCDXXXXXRSWSYIVERLXAQHGICYPGXXXXXXXXXXXXXXXXXXXXXXXXXXXXXXXXXXXXXXXXXXXXXXXXPSFYRNLLWMXXXXXXXXXXXXXXXXXXXXXSVLYFWGVHHXXXXXXXXXXXXXXXXXXXXXXXXXXXXXXXXXXXXXXXXXXRGRIDYFWSILKPGETLNIESNGNLIAPWYAFRXXXXXXXXXXXXXXXXXXXXXXXXXXXXXXXXXTNKTFQNISPVWIGKCPKYVKSXSLKLATGLRNVPKXXTRGIFGAIAGFIEGGWTGLIDGWYGYHXXXXQGSGYAADRESTQKAXXXITTKVNSIINKMNTQFEAIXHEFSSLERRIXNLNKRMQDGFLNVWTYNAELLILLENERTLDMHDANVKXXXXXVRSQLRDNAKDLGNGCFEFWHKCNNECXXSVKNGTYNYPKYQXXXXXXXXXXXXXXXXXFGVYQILAIYSTISSSLVLMGLIXXXXXWMCSNSSMQCRICIXX

SEQ ID NO: 419031 - protein, 570 aa, Influenza virus
  MOD_RES (1)..(13): Any amino acid
  MOD_RES (52)..(73): Any amino acid
  MOD_RES (83)..(89): Any amino acid
  MOD_RES (100)..(100): Any amino acid
  MOD_RES (110)..(157): Any amino acid
  MOD_RES (168)..(188): Any amino acid
  MOD_RES (200)..(240): Any amino acid
  MOD_RES (274)..(306): Any amino acid
  MOD_RES (329)..(329): Any amino acid
  MOD_RES (343)..(344): Any amino acid
  MOD_RES (354)..(355): Any amino acid
  MOD_RES (373)..(380): Any amino acid
  MOD_RES (391)..(393): Any amino acid
  MOD_RES (413)..(413): Any amino acid
  MOD_RES (424)..(424): Any amino acid
  MOD_RES (463)..(467): Any amino acid
  MOD_RES (482)..(483): Any amino acid
  MOD_RES (495)..(496): Any amino acid
  MOD_RES (509)..(526): Any amino acid
  MOD_RES (537)..(537): Any amino acid
  MOD_RES (549)..(554): Any amino acid
  MOD_RES (569)..(570): Any amino acid
XXXXXXXXXXXXXSKSDRICIGYHANNSTTQIDTILEKNITVTHSVELLEDXXXXXXXXXXXXXXXXXXXXXXDGWILGNPQXXXXXXXQSWSYVVERPXARNGICYPGXXXXXXXXXXXXXXXXXXXXXXXXXXXXXXXXXXXXXXXXXXXXXXXXSSFYRNLVWIXXXXXXXXXXXXXXXXXXXXXSVLYFWGIHHPXXXXXXXXXXXXXXXXXXXXXXXXXXXXXXXXXXXXXXXXXKGRIDYYWSILRPGETLNVESNGNLVAPWYAYKXXXXXXXXXXXXXXXXXXXXXXXXXXXXXXXXXTNRTFQNVSPLWVGECPKYVRSXNLKLATGLRNIPQXXNRGLFGAIAXXIEGGWTGMVDGWYGYHHXXXXXXXXAADRESTQRAXXXITNKANSIIEKMNTQFDAVXHEFSNLEKRIXNMNKRMEDGFMDVWTYNAELLVLLEDERTLDQHDANVKXXXXXVKSQLKDNAKDLGNXXFEFWHKCDDECXXSVKKGTYDYPKYXXXXXXXXXXXXXXXXXXFDVYQILAIYXTVSSSLVLAGLXXXXXXWMCLNGSMQCRVCIXX

SEQ ID NO: 419032 - protein, 570 aa, Influenza virus
  MOD_RES (1)..(13): Any amino acid
  MOD_RES (23)..(24): Any amino acid
  MOD_RES (52)..(73): Any amino acid
  MOD_RES (85)..(89): Any amino acid
  MOD_RES (100)..(100): Any amino acid
  MOD_RES (110)..(188): Any amino acid
  MOD_RES (198)..(240): Any amino acid
  MOD_RES (259)..(264): Any amino acid
  MOD_RES (274)..(306): Any amino acid
  MOD_RES (316)..(317): Any amino acid
  MOD_RES (329)..(331): Any amino acid
  MOD_RES (341)..(344): Any amino acid
  MOD_RES (354)..(380): Any amino acid
  MOD_RES (391)..(393): Any amino acid
  MOD_RES (413)..(424): Any amino acid
  MOD_RES (460)..(467): Any amino acid
  MOD_RES (479)..(484): Any amino acid
  MOD_RES (495)..(496): Any amino acid
  MOD_RES (508)..(526): Any amino acid
  MOD_RES (548)..(554): Any amino acid
  MOD_RES (564)..(570): Any amino acid
XXXXXXXXXXXXXSKSDKICIGXXANNSTTQVNTILEKNVTVTHSIELLENXXXXXXXXXXXXXXXXXXXXXXEGWILGNPKCDXXXXXQRWSYIVERPXAKNGICYPGXXXXXXXXXXXXXXXXXXXXXXXXXXXXXXXXXXXXXXXXXXXXXXXXXXXXXXXXXXXXXXXXXXXXXXXXXXXXXXXSILYFWGVHXXXXXXXXXXXXXXXXXXXXXXXXXXXXXXXXXXXXXXXXXXXRSRIDYYWSMLKPGETLNXXXXXXLIAPWYAYRXXXXXXXXXXXXXXXXXXXXXXXXXXXXXXXXXTNKTFQNASXXWIGGCPKYVKSXXXRLATGLRNIXXXXARGLFGAIAXXXXXXXXXXXXXXXXXXXXXXXXXXXAADKESTQRAXXXITSKVNSIIDKVNTQFEAVXXXXXXXXXXXXSLNKRMEDGLLDVWTYNAELLVLLENGRTLDMHDAXXXXXXXXVKSLLRDNAKDXXXXXXEFWHKCDNDCXXSVENGTYDYPKXXXXXXXXXXXXXXXXXXXLGIYQILAIYSTVSSGLVLVGXXXXXXXWMCSNGSMPXXXXXXX

SEQ ID NO: 419033 - protein, 570 aa, Influenza virus
  MOD_RES (1)..(13): Any amino acid
  MOD_RES (23)..(26): Any amino acid
  MOD_RES (52)..(73): Any amino acid
  MOD_RES (85)..(89): Any amino acid
  MOD_RES (100)..(100): Any amino acid
  MOD_RES (110)..(188): Any amino acid
  MOD_RES (198)..(240): Any amino acid
  MOD_RES (267)..(308): Any amino acid
  MOD_RES (321)..(398): Any amino acid
  MOD_RES (408)..(424): Any amino acid
  MOD_RES (441)..(448): Any amino acid
  MOD_RES (459)..(469): Any amino acid
  MOD_RES (482)..(496): Any amino acid
  MOD_RES (506)..(526): Any amino acid
  MOD_RES (536)..(540): Any amino acid
  MOD_RES (550)..(556): Any amino acid
  MOD_RES (569)..(570): Any amino acid
XXXXXXXXXXXXXGKSDRICIGXXXXNSTTQVDTLLEKNVTVTHSIELLESXXXXXXXXXXXXXXXXXXXXXXKGWILGNPRCGXXXXXQSWSCIVERPXAQYGICYPGXXXXXXXXXXXXXXXXXXXXXXXXXXXXXXXXXXXXXXXXXXXXXXXXXXXXXXXXXXXXXXXXXXXXXXXXXXXXXXXPVLYFWGVHXXXXXXXXXXXXXXXXXXXXXXXXXXXXXXXXXXXXXXXXXXXKARIDYYWSFLKPGETLKVESNGNLIXXXXXXXXXXXXXXXXXXXXXXXXXXXXXXXXXXXXXXXXXXKTFQNVSPVWIGXXXXXXXXXXXXXXXXXXXXXXXXXXXXXXXXXXXXXXXXXXXXXXXXXXXXXXXXXXXXXXXXXXXXXXXXXXXXXXNSSVSRMSTXXXXXXXXXXXXXXXXXNLNKRMENGFLDVWTYXXXXXXXXENERTLDQHDXXXXXXXXXXXSQLKDNANDLGNXXXXXXXXXXXXXXXSIKNGTYDYXXXXXXXXXXXXXXXXXXXXXIGVYQILAIXXXXXSSLVLVGLVXXXXXXXCSNGSMQCKICIXX

SEQ ID NO: 419034 - protein, 570 aa, Influenza virus
  MOD_RES (1)..(14): Any amino acid
  MOD_RES (26)..(31): Any amino acid
  MOD_RES (41)..(247): Any amino acid
  MOD_RES (259)..(264): Any amino acid
  MOD_RES (274)..(308): Any amino acid
  MOD_RES (321)..(403): Any amino acid
  MOD_RES (413)..(426): Any amino acid
  MOD_RES (445)..(453): Any amino acid
  MOD_RES (463)..(471): Any amino acid
  MOD_RES (482)..(498): Any amino acid
  MOD_RES (508)..(527): Any amino acid
  MOD_RES (543)..(556): Any amino acid
  MOD_RES (569)..(570): Any amino acid
XXXXXXXXXXXXXXRSHKICIGYHAXXXXXXVDTILEKNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSVLRPGETLNXXXXXXLVAPWYAYRXXXXXXXXXXXXXXXXXXXXXXXXXXXXXXXXXXXKTFQNVSPIWIGXXXXXXXXXXXXXXXXXXXXXXXXXXXXXXXXXXXXXXXXXXXXXXXXXXXXXXXXXXXXXXXXXXXXXXXXXXXXXXXXXXXKMNTQFETVXXXXXXXXXXXXXXNKRMQDGFMGVWTYNAELXXXXXXXXXLDMHDVNVKXXXXXXXXXLRDNAMILGNXXXXXXXXXXXXXXXXXKNGTYKYPKXXXXXXXXXXXXXXXXXXXXGVYQILSIYSTVSSSXXXXXXXXXXXXXXCSNGSMQCNVCIXX

SEQ ID NO: 419035 - protein, 570 aa, Influenza virus
  MOD_RES (1)..(247): Any amino acid
  MOD_RES (258)..(317): Any amino acid
  MOD_RES (327)..(453): Any amino acid
  MOD_RES (463)..(500): Any amino acid
  MOD_RES (510)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSVLQPGETLXXXXXXXXXXXXXXXXXXXXXXXXXXXXXXXXXXXXXXXXXXXXXXXXXXXXXXXXXXXXWNGECPKYVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDLHDANVRXXXXXXXXXXXXXXXXXXXXXXXXXXXXXXXXXXXXXXGTYNYPKYHXXXXXXXXXXXXXXXXXXXXXXXXXXXXXXXXXXXXXXXXXXXXXXXXXXXXXXXXXXXXX

SEQ ID NO: 419036 - protein, 570 aa, Influenza virus
  MOD_RES (1)..(249): Any amino acid
  MOD_RES (259)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLKPGETLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419037 - protein, 619 aa, Influenza virus
  MOD_RES (14)..(23): Any amino acid
  MOD_RES (42)..(42): Any amino acid
  MOD_RES (67)..(93): Any amino acid
  MOD_RES (105)..(170): Any amino acid
  MOD_RES (185)..(204): Any amino acid
  MOD_RES (214)..(252): Any amino acid
  MOD_RES (264)..(273): Any amino acid
  MOD_RES (289)..(331): Any amino acid
  MOD_RES (341)..(341): Any amino acid
  MOD_RES (355)..(356): Any amino acid
  MOD_RES (375)..(375): Any amino acid
  MOD_RES (387)..(393): Any amino acid
  MOD_RES (449)..(449): Any amino acid
  MOD_RES (459)..(465): Any amino acid
  MOD_RES (480)..(483): Any amino acid
  MOD_RES (539)..(539): Any amino acid
  MOD_RES (552)..(553): Any amino acid
  MOD_RES (563)..(571): Any amino acid
  MOD_RES (593)..(598): Any amino acid
  MOD_RES (614)..(619): Any amino acid
SKSRGYKMNTQILXXXXXXXXXXGCDHSDNADKICLGHHAVXNGTKVNTLTERGIEVVNATETVETXXXXXXXXXXXXXXXXXXXXXXXXXXXGPPQCDQFLEFXXXXXXXXXXXXXXXXXXXXXXXXXXXXXXXXXXXXXXXXXXXXXXXXXXXXXXXXXXXXXXXXXXSSSFYAEMKWLLSNXXXXXXXXXXXXXXXXXXXXALIIWGVHHXXXXXXXXXXXXXXXXXXXXXXXXXXXXXXXXXXXXXXXNGQSGRIDFHWXXXXXXXXXXFTFNGAFIAPDRASFXXXXXXXXXXXXXXXXXXXXXXXXXXXXXXXXXXXXXXXXXXXGKCPRYVKQXSLLLATGMRNVPEXXTHKQLTHHMRKKRGLFGAXRETRGLFGAIAXXXXXXXLFGAIAGFIENGWEGLIDGWYGFRHQNAQGEGTAADYKSTQSAIDQITGKLNRLIXKTNQQFELIXXXXXXXEQQIGNVINWTRDSXXXXWSYNAELLVAMENQHTIDLADSEMNKLYERVRKQLRENAEEDGTGCFEIFHKCDDXCMESIRNNTYDHXXYRTESLQNRXXXXXXXXXSGYKDIILWFSFGASCFLLLAXXXXXXFICIKNGNMRCTICIXXXXXX

SEQ ID NO: 419038 - protein, 619 aa, Influenza virus
  MOD_RES (14)..(30): Any amino acid
  MOD_RES (40)..(42): Any amino acid
  MOD_RES (67)..(93): Any amino acid
  MOD_RES (105)..(171): Any amino acid
  MOD_RES (185)..(204): Any amino acid
  MOD_RES (214)..(252): Any amino acid
  MOD_RES (264)..(273): Any amino acid
  MOD_RES (289)..(331): Any amino acid
  MOD_RES (341)..(341): Any amino acid
  MOD_RES (355)..(356): Any amino acid
  MOD_RES (366)..(375): Any amino acid
  MOD_RES (395)..(401): Any amino acid
  MOD_RES (449)..(449): Any amino acid
  MOD_RES (459)..(465): Any amino acid
  MOD_RES (480)..(483): Any amino acid
  MOD_RES (539)..(539): Any amino acid
  MOD_RES (551)..(553): Any amino acid
  MOD_RES (563)..(571): Any amino acid
  MOD_RES (593)..(598): Any amino acid
  MOD_RES (614)..(619): Any amino acid
MKSRGYKMNNQILXXXXXXXXXXXXXXXXXGDKICLGHHXXXNGTKVDTLTERGVEVVNATETVERXXXXXXXXXXXXXXXXXXXXXXXXXXXGPPQCDLFLEFXXXXXXXXXXXXXXXXXXXXXXXXXXXXXXXXXXXXXXXXXXXXXXXXXXXXXXXXXXXXXXXXXXXPSFYAEMKWLLSSXXXXXXXXXXXXXXXXXXXXALIIWGIHHXXXXXXXXXXXXXXXXXXXXXXXXXXXXXXXXXXXXXXXNGQSGRINFHWXXXXXXXXXXFSFNGAFIAPNRASFXXXXXXXXXXXXXXXXXXXXXXXXXXXXXXXXXXXXXXXXXXXGRCPRYVKQXSLLLATGMKNVPEXXAHKQLTHHMXXXXXXXXXXRMTRGLFGAIGLFGAIAGFXXXXXXXIENGWEGLVDGWYGFRHQNSQGEGTAADYKSTQSAVDQITGKLNHLIXKTNQQFEMIXXXXXXXEKQIGNVINWTQDAXXXXWSYNAEFLVAVENQHTIDLTDSEMSKLYERVKKQLRENAEEDGNGCFEIFHQCDNXCMASIRNNTYDXXXYREEAMQNRXXXXXXXXXSGYKDVILWFSFGASCFILLAXXXXXXFICVKNGNMQCTICIXXXXXX

SEQ ID NO: 419039 - protein, 619 aa, Influenza virus
  MOD_RES (1)..(1): Any amino acid
  MOD_RES (14)..(42): Any amino acid
  MOD_RES (67)..(93): Any amino acid
  MOD_RES (105)..(171): Any amino acid
  MOD_RES (185)..(204): Any amino acid
  MOD_RES (214)..(252): Any amino acid
  MOD_RES (264)..(273): Any amino acid
  MOD_RES (289)..(331): Any amino acid
  MOD_RES (341)..(341): Any amino acid
  MOD_RES (353)..(356): Any amino acid
  MOD_RES (366)..(375): Any amino acid
  MOD_RES (386)..(402): Any amino acid
  MOD_RES (449)..(449): Any amino acid
  MOD_RES (459)..(465): Any amino acid
  MOD_RES (480)..(483): Any amino acid
  MOD_RES (501)..(504): Any amino acid
  MOD_RES (525)..(529): Any amino acid
  MOD_RES (539)..(539): Any amino acid
  MOD_RES (552)..(553): Any amino acid
  MOD_RES (563)..(571): Any amino acid
  MOD_RES (593)..(598): Any amino acid
  MOD_RES (608)..(608): Any amino acid
XKSRGYKMNIQILXXXXXXXXXXXXXXXXXXXXXXXXXXXXXNGTRVNTLTEKGIEVVNATETVEQXXXXXXXXXXXXXXXXXXXXXXXXXXXGPPQCDRFLEFXXXXXXXXXXXXXXXXXXXXXXXXXXXXXXXXXXXXXXXXXXXXXXXXXXXXXXXXXXXXXXXXXXXSSFYAEMEWLLSNXXXXXXXXXXXXXXXXXXXXALIVWGIHHXXXXXXXXXXXXXXXXXXXXXXXXXXXXXXXXXXXXXXXNGQFGRINFHWXXXXXXXXXXFSFNGAFVAPDRVSFXXXXXXXXXXXXXXXXXXXXXXXXXXXXXXXXXXXXXXXXXXXGKCPRYVRQXSLMLATGMKNVXXXXIHKQLTHHMXXXXXXXXXXRKTRGLFGAIXXXXXXXXXXXXXXXXXENGWEGLINGWYGFRHQNAQGEGIAADYKSTQSAINQITGKLNRIIXKTNQQFKLIXXXXXXXERQIGNVINWTRDAXXXXWSYNAELLIAMENQHTIXXXXSEMNKLYEKVRRQLRENAEEXXXXXFEIFHKCDNXCMASIRNSTYDHXXYRAESLQNRXXXXXXXXXSGYKEVILWFSFGASCLILLAXXXXXXFMCVKNGNMXCSALFVYSLRK

SEQ ID NO: 419040 - protein, 619 aa, Influenza virus
  MOD_RES (1)..(2): Any amino acid
  MOD_RES (14)..(42): Any amino acid
  MOD_RES (67)..(93): Any amino acid
  MOD_RES (105)..(204): Any amino acid
  MOD_RES (214)..(252): Any amino acid
  MOD_RES (264)..(273): Any amino acid
  MOD_RES (289)..(331): Any amino acid
  MOD_RES (341)..(343): Any amino acid
  MOD_RES (355)..(375): Any amino acid
  MOD_RES (394)..(407): Any amino acid
  MOD_RES (425)..(431): Any amino acid
  MOD_RES (449)..(449): Any amino acid
  MOD_RES (459)..(465): Any amino acid
  MOD_RES (478)..(487): Any amino acid
  MOD_RES (503)..(504): Any amino acid
  MOD_RES (524)..(541): Any amino acid
  MOD_RES (552)..(553): Any amino acid
  MOD_RES (563)..(571): Any amino acid
  MOD_RES (581)..(581): Any amino acid
  MOD_RES (593)..(598): Any amino acid
  MOD_RES (612)..(619): Any amino acid
XXSRGYKMNTRILXXXXXXXXXXXXXXXXXXXXXXXXXXXXXNGTKINTLTEREVEVVDATETVERXXXXXXXXXXXXXXXXXXXXXXXXXXXGPPQCDKFLEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALIVWGVHHXXXXXXXXXXXXXXXXXXXXXXXXXXXXXXXXXXXXXXXNGQFGRIDFHWXXXXXXXXXXFIFNGAFIAPDRVSFXXXXXXXXXXXXXXXXXXXXXXXXXXXXXXXXXXXXXXXXXXXGKCPKYVKQXXXLLATGMRNIPEXXXXXXXXXXXXXXXXXXXXXQMTRGLFGARGLFGAIAGXXXXXXXXXXXXXXGLIDGWYGYRHQNAQGEXXXXXXXSTQSAIDQVTGKLNRLIXRTNQQFELIXXXXXXXEKQLGNVINWTRXXXXXXXXXXAELLVALENQHTIDLXXSEMDKLYERVKRQLRENAEXXXXXXXXXXXXXXXXXXESIRNNTYNHXXYRKEAIQNRXXXXXXXXXGGYKDIILWXSFGASCFLFLAXXXXXXFICVRNGNMRCTIXXXXXXXX

SEQ ID NO: 419041 - protein, 619 aa, Influenza virus
  MOD_RES (1)..(2): Any amino acid
  MOD_RES (14)..(42): Any amino acid
  MOD_RES (63)..(204): Any amino acid
  MOD_RES (214)..(253): Any amino acid
  MOD_RES (264)..(278): Any amino acid
  MOD_RES (289)..(377): Any amino acid
  MOD_RES (387)..(408): Any amino acid
  MOD_RES (426)..(449): Any amino acid
  MOD_RES (459)..(466): Any amino acid
  MOD_RES (476)..(487): Any amino acid
  MOD_RES (503)..(504): Any amino acid
  MOD_RES (526)..(541): Any amino acid
  MOD_RES (551)..(553): Any amino acid
  MOD_RES (563)..(571): Any amino acid
  MOD_RES (581)..(581): Any amino acid
  MOD_RES (591)..(605): Any amino acid
  MOD_RES (615)..(619): Any amino acid
XXSRGYKMNTKILXXXXXXXXXXXXXXXXXXXXXXXXXXXXXNGAKVNTLTERGVEVVDATEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALITWGIHHXXXXXXXXXXXXXXXXXXXXXXXXXXXXXXXXXXXXXXXXGQSGRIDFYWXXXXXXXXXXXXXXXAFIAPDRATFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRGLFGAIAXXXXXXXXXXXXXXXXXXXXXXLIDGWYGFKHQNAQGEGXXXXXXXXXXXXXXXXXXXXXXXXKTNQQFELDXXXXXXXXQQIGNVINCXXXXXXXXXXXXAELLVAIENQHTIDLXXSEMKKLYERVKRLLRENAEEDXXXXXXXXXXXXXXXXASIRNNTYNXXXYREEAIQNRXXXXXXXXXNGYKDVILWXSFGASCFTLXXXXXXXXXXXXXXXTCSALFVYSXXXXX

SEQ ID NO: 419042 - protein, 619 aa, Influenza virus
  MOD_RES (1)..(57): Any amino acid
  MOD_RES (67)..(253): Any amino acid
  MOD_RES (263)..(377): Any amino acid
  MOD_RES (387)..(412): Any amino acid
  MOD_RES (425)..(488): Any amino acid
  MOD_RES (508)..(582): Any amino acid
  MOD_RES (593)..(619): Any amino acid
XXXXXXXXXXXXXXXXXXXXXXXXXXXXXXXXXXXXXXXXXXXXXXXXXXXXXXXXXVNATETVENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGQTGRIDFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRGLFGAIAXXXXXXXXXXXXXXXXXXXXXXXXXXWYGYKHQNAQGEXXXXXXXXXXXXXXXXXXXXXXXXXXXXXXXXXXXXXXXXXXXXXXXXXXXXXXXXXXXXXXXXEFLVAMENQHIIDLADSEMXXXXXXXXXXXXXXXXXXXXXXXXXXXXXXXXXXXXXXXXXXXXXXXXXXXXXXXXXXXXXXXXXXXXXXXXXXXFGASCFLLIAXXXXXXXXXXXXXXXXXXXXXXXXXXX

SEQ ID NO: 419043 - protein, 619 aa, Influenza virus
  MOD_RES (1)..(378): Any amino acid
  MOD_RES (393)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKPRPRRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419044 - protein, 573 aa, Influenza virus
  MOD_RES (16)..(22): Any amino acid
  MOD_RES (62)..(74): Any amino acid
  MOD_RES (98)..(98): Any amino acid
  MOD_RES (137)..(138): Any amino acid
  MOD_RES (151)..(155): Any amino acid
  MOD_RES (175)..(191): Any amino acid
  MOD_RES (202)..(204): Any amino acid
  MOD_RES (219)..(232): Any amino acid
  MOD_RES (254)..(255): Any amino acid
  MOD_RES (279)..(300): Any amino acid
  MOD_RES (568)..(573): Any amino acid
SKSRGYKMNTQILILXXXXXXXAKGDKICLGHHAVANGTKVNTLTERGIEVVNATETVETAXXXXXXXXXXXXXDLGQCGLLGTLIGPPQCDQFLEFXSDLIIERREGTDVCYPGKFTNEESLRQILRRSGGIGKEXXGFTYSGIRTNGAXXXXXRSGSSFYAEMKWLLSNSDNXXXXXXXXXXXXXXXXXALIIWGVHHSXXXSEQTKLYGSGNKLIXXXXXXXXXXXXXXPGARRIDFHWLLRIDFHWLLLXXNDTVTFTFNGAFIAPDRASFFRGXXXXXXXXXXXXXXXXXXXXXXGGTIVSSLPFQNINPRTVGKCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFLLLAIAMGLVFICIKNGNMQCTICIXXXXXX

SEQ ID NO: 419045 - protein, 573 aa, Influenza virus
  MOD_RES (1)..(22): Any amino acid
  MOD_RES (62)..(74): Any amino acid
  MOD_RES (95)..(98): Any amino acid
  MOD_RES (137)..(138): Any amino acid
  MOD_RES (151)..(155): Any amino acid
  MOD_RES (175)..(191): Any amino acid
  MOD_RES (202)..(204): Any amino acid
  MOD_RES (219)..(232): Any amino acid
  MOD_RES (253)..(255): Any amino acid
  MOD_RES (279)..(300): Any amino acid
  MOD_RES (354)..(355): Any amino acid
  MOD_RES (384)..(394): Any amino acid
  MOD_RES (478)..(483): Any amino acid
  MOD_RES (568)..(573): Any amino acid
XXXXXXXXXXXXXXXXXXXXXXVKGDKICLGHHAVSNGTKVNTLTEKGIEVVNATETVERTXXXXXXXXXXXXXDLGRCGLLGTLTGPPQCDQFXXXXADLIIERREGNDVCYPGRFTNEEPLRQILRGSGGIDKEXXGFTYNGIRTNGAXXXXXRLGSSFYAEMKWLLSSSDNXXXXXXXXXXXXXXXXXALIIWGIHHSXXXSEQTKLYGNGNKLVXXXXXXXXXXXXXXPGARPQVNGQSGRIDFHWLLXXXNDTVTFSFNGAFIAPNRASFFRGXXXXXXXXXXXXXXXXXXXXXXGGTIISNLPFQNINSRTVGRCPRYVKQTSLLLATGMKNVPEIPKKRGLFGAIAXXIENGWEGLVDGWYGFRHQNTQGEGTAADXXXXXXXXXXXTGKLNRLIDKTNQQFELINNEFNEVEQQIGNVINWTQDAMTEVWSYNAELLVALENQHTIDLTDSEMSKLYERVRKQLRENAEXXXXXXFEIFHKCDNQCMESIRNNTYNHTQYRTGSLQNRIQIDSVKLSSGYKDVILWFSFGASCFILLAIAMGLGFMCVKNGNMRCTICIXXXXXX

SEQ ID NO: 419046 - protein, 573 aa, Influenza virus
  MOD_RES (1)..(22): Any amino acid
  MOD_RES (62)..(75): Any amino acid
  MOD_RES (98)..(98): Any amino acid
  MOD_RES (137)..(138): Any amino acid
  MOD_RES (150)..(155): Any amino acid
  MOD_RES (175)..(191): Any amino acid
  MOD_RES (202)..(204): Any amino acid
  MOD_RES (219)..(232): Any amino acid
  MOD_RES (254)..(255): Any amino acid
  MOD_RES (279)..(300): Any amino acid
  MOD_RES (354)..(356): Any amino acid
  MOD_RES (373)..(394): Any amino acid
  MOD_RES (442)..(444): Any amino acid
  MOD_RES (479)..(484): Any amino acid
  MOD_RES (535)..(538): Any amino acid
  MOD_RES (562)..(562): Any amino acid
XXXXXXXXXXXXXXXXXXXXXXTNADKICLGHHAVSNGTKINTLTERGVEVVNATETVETTXXXXXXXXXXXXXXLGQCGLLGILIGPPQCDKFLEFXSDLIIERKEGTDICYPGKFVNEEALRQILRESGGIDKEXXGFTYSEIRTNGXXXXXXRSSSSFYAEMKWLLSNTDNXXXXXXXXXXXXXXXXXALIVWGIHHSXXXTEQTKLYGSGSKLIXXXXXXXXXXXXXXPGTRRIDFHWLFRIDFHWLMLXXNDTVTFIFNGAFIAPDRASFLRGXXXXXXXXXXXXXXXXXXXXXXGGTIISSLPFQNISPRAVGKCPRYVKQESLLLATGMRNIPENPKTRGLFGAIAXXXENGWEGLIDGWYGFRHXXXXXXXXXXXXXXXXXXXXXXTGKLNRLISKTNQQFELIDHEFTEVEKQIGNVINWTRDSMTEVWSYNXXXLVAIENQHTIDLADSEMNKLYERVRRQLRENAEEXXXXXXEIFHKCDDHCMESIRNNTYDHSKYREEAMQNRIQIDPVKLSGGYKDIILWXXXXASCFLLLAVVMGLVFICIKNGNVXCSALFVYSLRK

SEQ ID NO: 419047 - protein, 573 aa, Influenza virus
  MOD_RES (1)..(22): Any amino acid
  MOD_RES (32)..(40): Any amino acid
  MOD_RES (50)..(52): Any amino acid
  MOD_RES (62)..(78): Any amino acid
  MOD_RES (97)..(100): Any amino acid
  MOD_RES (137)..(138): Any amino acid
  MOD_RES (151)..(155): Any amino acid
  MOD_RES (175)..(191): Any amino acid
  MOD_RES (202)..(204): Any amino acid
  MOD_RES (219)..(232): Any amino acid
  MOD_RES (253)..(255): Any amino acid
  MOD_RES (266)..(268): Any amino acid
  MOD_RES (279)..(300): Any amino acid
  MOD_RES (316)..(316): Any amino acid
  MOD_RES (340)..(342): Any amino acid
  MOD_RES (354)..(394): Any amino acid
  MOD_RES (419)..(425): Any amino acid
  MOD_RES (443)..(453): Any amino acid
  MOD_RES (478)..(484): Any amino acid
  MOD_RES (530)..(539): Any amino acid
  MOD_RES (563)..(573): Any amino acid
XXXXXXXXXXXXXXXXXXXXXXTKGDKICLGXXXXXXXXXVNTLTERGVXXXNATETVETVXXXXXXXXXXXXXXXXXCGLLGTITGPPHCDQFLEXXXXLIIERREGADVCYPGKFVNGEALRQILRKSGGIGKEXXGFIYSGIRTNGTXXXXXRSGPSFYAEMKWLLSSTDNXXXXXXXXXXXXXXXXXALIVWGVHHSXXXAEQTKLYGSGNKLVXXXXXXXXXXXXXXTGARRIDFHQFGRIDFHWLMXXXNDTVTFNFNGXXXAPDRASFFKGXXXXXXXXXXXXXXXXXXXXXXGGTIASSLPFQNINSXTVGKCPRYIKQKSLMLATGMKNVXXXPKGRGLFGAIAXXXXXXXXXXXXXXXXXXXXXXXXXXXXXXXXXXXXXXXXXTGKLNRLIEKTNQQFELIDSEFNEXXXXXXXVINWTRDSITEVWSYNAXXXXXXXXXXXIDLTDSEMNKLYERVKRQLRENAEXXXXXXXEIFHKCDDDCMASIRNNTYDHTKYRTESLQNRIQIDQVKLSSGYKXXXXXXXXXXSCFLLLAIVMGLVFICVKNGNMRXXXXXXXXXXX

SEQ ID NO: 419048 - protein, 573 aa, Influenza virus
  MOD_RES (1)..(22): Any amino acid
  MOD_RES (33)..(78): Any amino acid
  MOD_RES (90)..(100): Any amino acid
  MOD_RES (137)..(141): Any amino acid
  MOD_RES (151)..(156): Any amino acid
  MOD_RES (167)..(191): Any amino acid
  MOD_RES (202)..(204): Any amino acid
  MOD_RES (214)..(232): Any amino acid
  MOD_RES (254)..(257): Any amino acid
  MOD_RES (267)..(300): Any amino acid
  MOD_RES (345)..(398): Any amino acid
  MOD_RES (418)..(428): Any amino acid
  MOD_RES (440)..(453): Any amino acid
  MOD_RES (470)..(498): Any amino acid
  MOD_RES (516)..(539): Any amino acid
  MOD_RES (561)..(573): Any amino acid
XXXXXXXXXXXXXXXXXXXXXXARGDKICLGHXXXXXXXXXXXXXXXXXXXXXXXXXXXXXXXXXXXXXXXXXXXXXXCGLLGTVTGPPXXXXXXXXXXXLIIERREGSDVCYPGGFTNEESLRQVLRRSGGISKEXXXXXYSGIRTNGVXXXXXXSGSSFYAELKXXXXXXXXXXXXXXXXXXXXXXXXXALVIWGVHHSXXXDEQTKLYGSXXXXXXXXXXXXXXXXXXXPGARRIDFNWLLRIDFHWLILXXXXTITFSFNGAXXXXXXXXXXXXXXXXXXXXXXXXXXXXXXXXXXEGTIVSSLPFQSINPRAVGKCPKYVKQESLMLATGMRNVPENPKXXXXXXXXXXXXXXXXXXXXXXXXXXXXXXXXXXXXXXXXXXXXXXXXXXXXXXNHLIGKTNQQFGLIDNEFNXXXXXXXXXXXWTRDAMTEVWSXXXXXXXXXXXXXXIDLADSEMKKLYERVRXXXXXXXXXXXXXXXXXXXXXXXXXXXXXRNNTYDHSRYREEAMQNXXXXXXXXXXXXXXXXXXXXXXXXSCFILLAIVMGLVFMCVKNGNXXXXXXXXXXXXX

SEQ ID NO: 419049 - protein, 573 aa, Influenza virus
  MOD_RES (1)..(85): Any amino acid
  MOD_RES (95)..(112): Any amino acid
  MOD_RES (134)..(156): Any amino acid
  MOD_RES (166)..(209): Any amino acid
  MOD_RES (219)..(236): Any amino acid
  MOD_RES (253)..(307): Any amino acid
  MOD_RES (317)..(324): Any amino acid
  MOD_RES (345)..(401): Any amino acid
  MOD_RES (423)..(457): Any amino acid
  MOD_RES (467)..(508): Any amino acid
  MOD_RES (519)..(543): Any amino acid
  MOD_RES (547)..(547): Ile or Leu
  MOD_RES (565)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXIGPPHCDQFXXXXXXXXXXXXXXXXXXYPGKFANEESLRQIIRRSGGIXXXXXXXXXXXXXXXXXXXXXXXTGSSFYAEMXXXXXXXXXXXXXXXXXXXXXXXXXXXXXXXXXXXXXXXXXXXXLYGNGNKLIXXXXXXXXXXXXXXXXXXPQVNGQFGRIDFHWLIXXXXXXXXXXXXXXXXXXXXXXXXXXXXXXXXXXXXXXXXXXXXXXXXXXXXXXXLPFQNINPKXXXXXXXXVKQKSILLATGMRNIPEKPKXXXXXXXXXXXXXXXXXXXXXXXXXXXXXXXXXXXXXXXXXXXXXXXXXXXXXXXXXIGRTNQQFELIDNEFTEVEKQXXXXXXXXXXXXXXXXXXXXXXXXXXXXXXXXXXXDSEIKKLYEXXXXXXXXXXXXXXXXXXXXXXXXXXXXXXXXXXXXXXXXXXRKEAMQNRIQXXXXXXXXXXXXXXXXXXXXXXXXXLLAXVMGLVFICMKNGNMQCTXXXXXXXXX

SEQ ID NO: 419050 - protein, 573 aa, Influenza virus
  MOD_RES (1)..(243): Any amino acid
  MOD_RES (253)..(405): Any amino acid
  MOD_RES (426)..(544): Any amino acid
  MOD_RES (557)..(559): Any amino acid
  MOD_RES (569)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRIDFHWLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNKQFELIDNEFSEIEQQIGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTIAMGLVFMCVXXXTCSALFVYSXXXXX

SEQ ID NO: 419051 - protein, 573 aa, Influenza virus
  MOD_RES (1)..(244): Any amino acid
  MOD_RES (254)..(405): Any amino acid
  MOD_RES (423)..(545): Any amino acid
  MOD_RES (565)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIDFHWLFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQQFEMIDNEFTEIEQQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIAMGLVFMCIKNGNMRCTXXXXXXXXX

SEQ ID NO: 419052 - protein, 573 aa, Influenza virus
  MOD_RES (1)..(244): Any amino acid
  MOD_RES (254)..(545): Any amino acid
  MOD_RES (563)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIDFNWLLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIAMGFVFICIKNGNMRXXXXXXXXXXX

SEQ ID NO: 419053 - protein, 573 aa, Influenza virus
  MOD_RES (1)..(547): Any amino acid
  MOD_RES (557)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAMGLVFICVXXXXXXXXXXXXXXXXX

SEQ ID NO: 419054 - protein, 573 aa, Influenza virus
  MOD_RES (1)..(547): Any amino acid
  MOD_RES (557)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAMGLVFICMXXXXXXXXXXXXXXXXX

SEQ ID NO: 419055 - protein, 469 aa, Influenza virus
  MOD_RES (20)..(20): Any amino acid
  MOD_RES (30)..(58): Any amino acid
  MOD_RES (72)..(83): Any amino acid
  MOD_RES (210)..(210): Any amino acid
  MOD_RES (255)..(258): Any amino acid
  MOD_RES (308)..(311): Any amino acid
  MOD_RES (392)..(393): Any amino acid
  MOD_RES (414)..(414): Any amino acid
  MOD_RES (469)..(469): Any amino acid
MNPNQKIITIGSVSLTIATXCFLMQIAILXXXXXXXXXXXXXXXXXXXXXXXXXXXXXERNITEIVYLNNTXXXXXXXXXXXXYRSWSKPQCQITGFAPFSKDNSIRLSAGGDIWITREPYVSCDTSKCYQFALGQGTTLDNKHSNGTIHDRIPHRTLLMNELGVPFHLGTKQVCIAWSSSSCHDGKAWLHVCVTGDDRNATASFIYNGXLVDSIGSWSQNILRTQESECVCINGSCTVVMTDGSASGKADTRIXXXXEGKIVHISPLSGSAQHIEECSCYPRYPNVRCVCRDNWKGSNRPVIDINMXXXXIDSSYVCSGLVGDTPRNEDGSSSSNCRDPNEERGNPGVKGWAFDSGDDVWMGRTISRDSRSGYETFRVIGGWTTANSKSQXXRQVIVDNNNWSGYSGIFSVEXKSCINRCFYVELIRGRPKETRVWWTSNSIVVFCGTSGTYGTGSWPDGANINFMPX

SEQ ID NO: 419056 - protein, 469 aa, Influenza virus
  MOD_RES (1)..(4): Any amino acid
  MOD_RES (20)..(20): Any amino acid
  MOD_RES (30)..(58): Any amino acid
  MOD_RES (72)..(83): Any amino acid
  MOD_RES (163)..(163): Any amino acid
  MOD_RES (181)..(183): Any amino acid
  MOD_RES (210)..(210): Any amino acid
  MOD_RES (225)..(227): Any amino acid
  MOD_RES (253)..(258): Any amino acid
  MOD_RES (272)..(274): Any amino acid
  MOD_RES (292)..(293): Any amino acid
  MOD_RES (308)..(311): Any amino acid
  MOD_RES (392)..(393): Any amino acid
  MOD_RES (410)..(414): Any amino acid
  MOD_RES (453)..(456): Any amino acid
  MOD_RES (469)..(469): Any amino acid
XXXXQKIITIGSISLTIAAXCFLMQIAVLXXXXXXXXXXXXXXXXXXXXXXXXXXXXXKRNITEIVYLNHTXXXXXXXXXXXXYRNWSKPQCQISGFAPFAKDNSIRLSAGGHIWVTREPYVSCSLNKCYQFALGQGTTLYNKHSNGTTHDRISHRTLLMNEXGVPFHLGTRQVCIAWSSXXXHDGKAWLHICVTGDDRNATASLIYNGXLVDSIVSWSQNILRXXXSECVCINGTCTVVMTDGNASGKADTXXXXXXEGKIIHISPLSGSXXXIEECSCYPQYPNVRCVCXXNWKGSNRPIIDINMXXXXINSSYVCSGLVGDTPRNDDSSSSSNCKDPNNERGNPGVKGWAFDNGDDVWMGRTISKDSRSGYETFKVIGGWTIANSKSQXXRQVIVDNSNWSGYSGIXXXXXKSCVNRCFYVELIRGMPQETRVWWTSNSIIVFCGTSGTXXXXSWPDGANISFMPX

SEQ ID NO: 419057 - protein, 469 aa, Influenza virus
  MOD_RES (1)..(7): Any amino acid
  MOD_RES (20)..(20): Any amino acid
  MOD_RES (30)..(58): Any amino acid
  MOD_RES (72)..(83): Any amino acid
  MOD_RES (162)..(168): Any amino acid
  MOD_RES (185)..(185): Any amino acid
  MOD_RES (210)..(210): Any amino acid
  MOD_RES (221)..(229): Any amino acid
  MOD_RES (255)..(258): Any amino acid
  MOD_RES (272)..(277): Any amino acid
  MOD_RES (307)..(311): Any amino acid
  MOD_RES (392)..(393): Any amino acid
  MOD_RES (414)..(414): Any amino acid
  MOD_RES (452)..(456): Any amino acid
  MOD_RES (469)..(469): Any amino acid
XXXXXXXITIGSVSLIIATXCFLMQIATLXXXXXXXXXXXXXXXXXXXXXXXXXXXXXEKNITEIVYLNSTXXXXXXXXXXXXYRDWSKPQCQIIGFAPFSKDNSVRLSASGDIWITREPYVSCGPGKCYQFALGQGTTLENKHSNGTIHDRTPHRTLLMNXXXXXXXLGTKQVCMAWSSSSCHXGKAWLHVCITGDDRNATASFIYDGXLIDSIGSWSQXXXXXXXXXCVCINGSCAVVMTDGSASGRADTRIXXXXEGKIAHISPLSGSXXXXXXCSCYPRYPDVRCVCRDNWKGSNRPVVDINXXXXXIDSSYLCSGLVGDTPRNEDSSSSSNCRDPNNEKGNPGVKGWAFDYGNDVWMGRTISMDSRSGYETFRVISGWTTANSKSKXXRQIIVDNNNWFGYFGIFFVEXKRCINRCFYVELIRGRPQETKVWWTSNSIVVFCGTSAXXXXXSWPDGANIDFVPX

SEQ ID NO: 419058 - protein, 469 aa, Influenza virus
  MOD_RES (1)..(9): Any amino acid
  MOD_RES (20)..(20): Any amino acid
  MOD_RES (30)..(58): Any amino acid
  MOD_RES (72)..(83): Any amino acid
  MOD_RES (100)..(104): Any amino acid
  MOD_RES (162)..(190): Any amino acid
  MOD_RES (208)..(229): Any amino acid
  MOD_RES (255)..(258): Any amino acid
  MOD_RES (272)..(296): Any amino acid
  MOD_RES (308)..(311): Any amino acid
  MOD_RES (321)..(325): Any amino acid
  MOD_RES (365)..(372): Any amino acid
  MOD_RES (390)..(393): Any amino acid
  MOD_RES (411)..(425): Any amino acid
  MOD_RES (443)..(443): Any amino acid
  MOD_RES (454)..(457): Any amino acid
  MOD_RES (469)..(469): Any amino acid
XXXXXXXXXIGSVSLTITTXCFFMQIAILXXXXXXXXXXXXXXXXXXXXXXXXXXXXXEKNITKIVYLNSTXXXXXXXXXXXXYRIWSKPQCQIRGFAPXXXXXSIRLSAGGNIWITREPYVSCDNDKCYQFALGQGTTLNNKHSNGTTHDRTSHRTLLMNXXXXXXXXXXXXXXXXXXXXXXXXXXXXXHVCVTGDDKNATASFIYXXXXXXXXXXXXXXXXXXXXXXCVCINGTCAVVMTDGSASRKADTRIXXXXEGKISHISPLSGSXXXXXXXXXXXXXXXXXXXXXXXXXGSNRPVIDVNMXXXXIDSSYMCSGXXXXXPRNEDSSSNSNCKDPNEERGSPGVKGWAFDNGNDVWMGRXXXXXXXXGYETFRVIDGWTTANSKXXXXRQVIVDNNSWSGYSGIFXXXXXXXXXXXXXXXLIRGRPQENRVWWTSNSXVVFCGTSGNYXXXXWPDGANINLMPX

SEQ ID NO: 419059 - protein, 469 aa, Influenza virus
  MOD_RES (1)..(10): Any amino acid
  MOD_RES (20)..(20): Any amino acid
  MOD_RES (30)..(58): Any amino acid
  MOD_RES (72)..(84): Any amino acid
  MOD_RES (94)..(105): Any amino acid
  MOD_RES (152)..(152): Any amino acid
  MOD_RES (162)..(190): Any amino acid
  MOD_RES (210)..(229): Any amino acid
  MOD_RES (242)..(242): Any amino acid
  MOD_RES (255)..(258): Any amino acid
  MOD_RES (271)..(312): Any amino acid
  MOD_RES (322)..(325): Any amino acid
  MOD_RES (365)..(375): Any amino acid
  MOD_RES (392)..(394): Any amino acid
  MOD_RES (404)..(425): Any amino acid
  MOD_RES (444)..(459): Any amino acid
  MOD_RES (469)..(469): Any amino acid
XXXXXXXXXXGSVSLTIAIXCFLMQITILXXXXXXXXXXXXXXXXXXXXXXXXXXXXXERNVTETLYLNHTXXXXXXXXXXXXXKSWSKPQCQXXXXXXXXXXXXVRLSAGGDIWVTREPYVSCSPNRCYQFALGQGTTLDNEHSNGTIHDXIPHRTLLMSXXXXXXXXXXXXXXXXXXXXXXXXXXXXXHVCVTGDDGNATASLIYDGXXXXXXXXXXXXXXXXXXXXCVCINGSCIVVMXDGSASGKAETRIXXXXEGKVVHISPLSGXXXXXXXXXXXXXXXXXXXXXXXXXXXXXXXXXXXXXXXXXXGSSYVCSGLXXXXPRNDDSSSNSNCRDPNDERGNPGVKGWAFDYGSDVWMGRXXXXXXXXXXXTFRVIGGWATANSKSQXXXQVMVDNNNWXXXXXXXXXXXXXXXXXXXXXXLVRGRPQETGVWWTSNSIXXXXXXXXXXXXXXXXDGANINFMHX

SEQ ID NO: 419060 - protein, 469 aa, Influenza virus
  MOD_RES (1)..(86): Any amino acid
  MOD_RES (100)..(141): Any amino acid
  MOD_RES (152)..(356): Any amino acid
  MOD_RES (366)..(396): Any amino acid
  MOD_RES (406)..(430): Any amino acid
  MOD_RES (440)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXWSKPQCRITGFAPXXXXXXXXXXXXXXXXXXXXXXXXXXXXXXXXXXXXXXXXXXNEHSNGTTHDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEDDVWMGRTXXXXXXXXXXXXXXXXXXXXXXXXXXXXXXXIVGNNNWSGXXXXXXXXXXXXXXXXXXXXXXXXXPQEDRVWWTXXXXXXXXXXXXXXXXXXXXXXXXXXXXXX

SEQ ID NO: 419061 - protein, 469 aa, Influenza virus
  MOD_RES (1)..(87): Any amino acid
  MOD_RES (97)..(398): Any amino acid
  MOD_RES (408)..(432): Any amino acid
  MOD_RES (442)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXSKPQCKITGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNNNRSGYSXXXXXXXXXXXXXXXXXXXXXXXXXEARVWWTSNXXXXXXXXXXXXXXXXXXXXXXXXXXXX

SEQ ID NO: 419062 - protein, 469 aa, Influenza virus
  MOD_RES (1)..(433): Any amino acid
  MOD_RES (443)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTTVWWTSNSXXXXXXXXXXXXXXXXXXXXXXXXXXX

SEQ ID NO: 419063 - protein, 597 aa, Influenza virus
  MOD_RES (16)..(24): Any amino acid
  MOD_RES (61)..(74): Any amino acid
  MOD_RES (99)..(100): Any amino acid
  MOD_RES (110)..(112): Any amino acid
  MOD_RES (123)..(125): Any amino acid
  MOD_RES (137)..(141): Any amino acid
  MOD_RES (151)..(163): Any amino acid
  MOD_RES (182)..(197): Any amino acid
  MOD_RES (209)..(212): Any amino acid
  MOD_RES (228)..(228): Any amino acid
  MOD_RES (244)..(244): Any amino acid
  MOD_RES (284)..(307): Any amino acid
  MOD_RES (335)..(335): Any amino acid
  MOD_RES (352)..(352): Any amino acid
  MOD_RES (371)..(377): Any amino acid
  MOD_RES (523)..(523): Any amino acid
  MOD_RES (578)..(582): Any amino acid
SKSRGYKMNTQILVFXXXXXXXXXGDKICLGHHAVANGTKVNTLTERGIEVVNATETVETXXXXXXXXXXXXXXTDLGQCGLLGTLIGPPQCDQFLEFXXDLIIERREGXXXDVCYPGKFTNXXXLRQILRGSGGIXXXXXGFTYSGIRTXXXXXXXXXXXXXGSSFYAEMKKWLLSNSDNXXXXXXXXXXXXXXXXPALIIWGVHHSXXXXEQTKLYGSGNKLITVXSSKYQQSFTPSPGARXQVNGQSGRIDFHWLLLDPNDTVTFTFNGAFIAPDRASFFXXXXXXXXXXXXXXXXXXXXXXXXGGTIVSSLPFQNINPRTVGKCPRYVKQXSLLLATGMRNVPENPKXCSPLSRCRETRGLFGAIAXXXXXXXLFGAIAGFIENGWEGLIDGWYGFRHQNAQGEGTAADYKSTQSAIDQITGKLNRLIDKTNQQFELIDNEFNEIEQQIGNVINWTRDSMTEVWSYNAELLVAMENQHTIDLADSEMNKLYERVRKQLRENAEEDGTGCFEIFHKCDDXCMESIRNNTYDHTQYRTESLQNRIQIDPVKLSSGYKDIILWFSFGASCFLLLAIXXXXXFICIKNGNMRCTICI

SEQ ID NO: 419064 - protein, 597 aa, Influenza virus
  MOD_RES (1)..(1): Any amino acid
  MOD_RES (16)..(24): Any amino acid
  MOD_RES (61)..(74): Any amino acid
  MOD_RES (96)..(100): Any amino acid
  MOD_RES (110)..(112): Any amino acid
  MOD_RES (123)..(125): Any amino acid
  MOD_RES (137)..(141): Any amino acid
  MOD_RES (151)..(163): Any amino acid
  MOD_RES (182)..(197): Any amino acid
  MOD_RES (209)..(212): Any amino acid
  MOD_RES (228)..(228): Any amino acid
  MOD_RES (244)..(244): Any amino acid
  MOD_RES (284)..(307): Any amino acid
  MOD_RES (334)..(335): Any amino acid
  MOD_RES (352)..(352): Any amino acid
  MOD_RES (379)..(385): Any amino acid
  MOD_RES (476)..(483): Any amino acid
  MOD_RES (509)..(513): Any amino acid
  MOD_RES (523)..(523): Any amino acid
  MOD_RES (578)..(582): Any amino acid
  MOD_RES (595)..(597): Any amino acid
XKSRGYKMNNQILILXXXXXXXXXADKICLGHHAVSNGTKVDTLTEKGIEVVNATETVERXXXXXXXXXXXXXXVDLGQCGLLGIITGPPQCDQFXXXXXNLIIERREGXXXDVCYPGKFVNXXXLRQILRESGGIXXXXXGFTYSGIMTXXXXXXXXXXXXXESSFYAEMKKWLLSNTDNXXXXXXXXXXXXXXXXPALIIWGIHHSXXXXEQTRLYGSGNKLVTVXSSNYQQSFVPSPGARXQVNGQFGRINFHWLMLNPNDTVTFSFNGAFIAPDRVSFLXXXXXXXXXXXXXXXXXXXXXXXXGGTIISNLPFQNINSRAIGKCPRYVKXXSLLLATGMKNVPEIPKXCSPLSRCRKTRGLFGAIGLFGAIAGFXXXXXXXIENGWEGLVDGWYGFRHQNAQGEGIAADYKSTQSAVDQITGKLNRIIEKTNQQFELIDNEFTEVEKQIGNVINWTRDAMTEIWSYNAELLXXXXXXXXIDLADSEMDKLYERVRRQLRENAEEXXXXXFEIFHKCDNXCMASIRNNTYDHSKYREEAMQNRIQINPVKLSSGYKEVILWFSFGASCFILLAIXXXXXFICVKNGNMRCTXXX

SEQ ID NO: 419065 - protein, 597 aa, Influenza virus
  MOD_RES (1)..(2): Any amino acid
  MOD_RES (16)..(27): Any amino acid
  MOD_RES (61)..(74): Any amino acid
  MOD_RES (99)..(100): Any amino acid
  MOD_RES (110)..(112): Any amino acid
  MOD_RES (123)..(125): Any amino acid
  MOD_RES (137)..(141): Any amino acid
  MOD_RES (151)..(163): Any amino acid
  MOD_RES (182)..(197): Any amino acid
  MOD_RES (209)..(212): Any amino acid
  MOD_RES (228)..(228): Any amino acid
  MOD_RES (244)..(244): Any amino acid
  MOD_RES (284)..(307): Any amino acid
  MOD_RES (323)..(324): Any amino acid
  MOD_RES (335)..(335): Any amino acid
  MOD_RES (352)..(352): Any amino acid
  MOD_RES (378)..(386): Any amino acid
  MOD_RES (404)..(409): Any amino acid
  MOD_RES (480)..(483): Any amino acid
  MOD_RES (504)..(523): Any amino acid
  MOD_RES (578)..(582): Any amino acid
  MOD_RES (593)..(597): Any amino acid
XXSRGYKMNTRILILXXXXXXXXXXXXICLGHHAVPNGTKVNTLAERGVEVVNATETVEQXXXXXXXXXXXXXXIDLGQCGLLGTITGPPQCDLFLEFXXDLIVERQEGXXXDVCYPGKFANXXXLRQILRRSGGIXXXXXGFTYSGMRTXXXXXXXXXXXXXGPSFYAEMKKWLLSNNDNXXXXXXXXXXXXXXXXPALIVWGIHHSXXXXEQAKLYGSGAKLITVXSSNYHQSFVPSPGVRXQVNGQTGRIDFHWLILNPNDTVTFNFNGAFIAPDRATFLXXXXXXXXXXXXXXXXXXXXXXXXGGTITSPLPFQNINPXXVGKCPRYVRQXSLMLATGMKNVPETPKXKRKRGLFGAITKPRPRRGLFGAIAGXXXXXXXXXENGWEGLINGWYGFRHQXXXXXXTAADYKSTPSAIDQITGKLNRLIEKTNQQFKLIDNEFSEIEQQIGNVINWTRDSITEVWSYNAEFLVAMEXXXXIDQADSEMNKLHERVRKQLRXXXXXXXXXXXXXXXXXXXXCMASIRNSTYDHSRYREEAMQNRMQINPVKLNSGYKDVILWFSFGASCFLFLAIXXXXXFMCVKNGNMRXXXXX

SEQ ID NO: 419066 - protein, 597 aa, Influenza virus
  MOD_RES (1)..(5): Any amino acid
  MOD_RES (16)..(27): Any amino acid
  MOD_RES (61)..(74): Any amino acid
  MOD_RES (99)..(100): Any amino acid
  MOD_RES (110)..(112): Any amino acid
  MOD_RES (123)..(125): Any amino acid
  MOD_RES (137)..(141): Any amino acid
  MOD_RES (151)..(163): Any amino acid
  MOD_RES (182)..(197): Any amino acid
  MOD_RES (209)..(212): Any amino acid
  MOD_RES (226)..(228): Any amino acid
  MOD_RES (244)..(244): Any amino acid
  MOD_RES (284)..(307): Any amino acid
  MOD_RES (335)..(340): Any amino acid
  MOD_RES (352)..(353): Any amino acid
  MOD_RES (363)..(392): Any amino acid
  MOD_RES (410)..(413): Any amino acid
  MOD_RES (476)..(484): Any amino acid
  MOD_RES (508)..(527): Any amino acid
  MOD_RES (565)..(565): Any amino acid
  MOD_RES (575)..(582): Any amino acid
  MOD_RES (597)..(597): Any amino acid
XXXXXYKMNTQILIFXXXXXXXXXXXXICLGHHAVTNGTKVNTLTERGVEVVNATETVENXXXXXXXXXXXXXXTDLGQCGILGILTGPPQCDRFLEFXXDLIVERQDGXXXDVCYPGKFSNXXXLRQVLRESGGIXXXXXGFTYSEIRTXXXXXXXXXXXXXDSSFYAEMKKWLLSNADNXXXXXXXXXXXXXXXXPALIVWGVHHSXXXXEQTKLYGNGAKLIXXXSSKCQQSFTPSPGTRXPVNGQSGRINFHWLMLNSNDTVIFSFNGAFVAPDRVSFFXXXXXXXXXXXXXXXXXXXXXXXXGGTITSNLPFQNVNSRAVGRCPRYVKQXXXXXXTGMRNVPEKPKXXRRRGLFGAIXXXXXXXXXXXXXXXXXXXXXXXXXXXXXXLIDGWYGFKHQNAQGEGXXXXYKSTQSAINQITGKLNRFIEKTNQQFEMIDNEFIEVEKQIGNVINWTRDSVTELWSYNAELLXXXXXXXXXDLADSEMSKLYERVKRQLRENAEXXXXXXXXXXXXXXXXXXXXIRNNTYDHNQYRAESLQNRIRIDPVKLSGGYKDIILWXSFGASCFVLXXXXXXXXYICVKNGNMQCTICX

SEQ ID NO: 419067 - protein, 597 aa, Influenza virus
  MOD_RES (1)..(31): Any amino acid
  MOD_RES (61)..(74): Any amino acid
  MOD_RES (94)..(112): Any amino acid
  MOD_RES (123)..(127): Any amino acid
  MOD_RES (137)..(141): Any amino acid
  MOD_RES (151)..(163): Any amino acid
  MOD_RES (181)..(215): Any amino acid
  MOD_RES (228)..(228): Any amino acid
  MOD_RES (244)..(244): Any amino acid
  MOD_RES (273)..(274): Any amino acid
  MOD_RES (284)..(307): Any amino acid
  MOD_RES (334)..(342): Any amino acid
  MOD_RES (352)..(353): Any amino acid
  MOD_RES (363)..(425): Any amino acid
  MOD_RES (455)..(458): Any amino acid
  MOD_RES (472)..(485): Any amino acid
  MOD_RES (503)..(536): Any amino acid
  MOD_RES (564)..(566): Any amino acid
  MOD_RES (578)..(583): Any amino acid
  MOD_RES (596)..(597): Any amino acid
XXXXXXXXXXXXXXXXXXXXXXXXXXXXXXXHHAVANGTRVNTLTEKGIEVVDATETVERXXXXXXXXXXXXXXTDMGQCGLLGTVTGPPQCDXXXXXXXXXXXXXXXXXXXDICYPGKFTNXXXXXQILRGSGGVXXXXXGFTYSGVRTXXXXXXXXXXXXXGSSSFYAEMKWLLSNSDXXXXXXXXXXXXXXXXXXXXXXXXXXXXXXXXXXXKLYGSGSKLITVXSYNYHQSFVPSPGSRXQVDGQSGRIDFHWMMLNPNDTITFSFNGXXIAPDRASFLXXXXXXXXXXXXXXXXXXXXXXXXGGTIASSLPFQNINSRTLGKCPRYVKXXXXXXXXXMKNVPEIPRXXKKRGLFGAIXXXXXXXXXXXXXXXXXXXXXXXXXXXXXXXXXXXXXXXXXXXXXXXXXXXXXXXXXXXXXXXGKLNRLIDRTNHQFELIDNEFNEVEKQIGXXXXWTRDSMTEIWSYNXXXXXXXXXXXXXXLANSEMNKLYERVKKQLXXXXXXXXXXXXXXXXXXXXXXXXXXXXXXXXXXTYREEAMQNRVKIDPVKLSNGYKDVILXXXFGASCFLLIAIXXXXXXICVKNGNHAVHYXX

SEQ ID NO: 419068 - protein, 597 aa, Influenza virus
  MOD_RES (1)..(42): Any amino acid
  MOD_RES (55)..(86): Any amino acid
  MOD_RES (96)..(165): Any amino acid
  MOD_RES (181)..(215): Any amino acid
  MOD_RES (227)..(232): Any amino acid
  MOD_RES (242)..(256): Any amino acid
  MOD_RES (277)..(315): Any amino acid
  MOD_RES (325)..(355): Any amino acid
  MOD_RES (370)..(432): Any amino acid
  MOD_RES (442)..(446): Any amino acid
  MOD_RES (469)..(487): Any amino acid
  MOD_RES (502)..(554): Any amino acid
  MOD_RES (564)..(568): Any amino acid
  MOD_RES (578)..(584): Any amino acid
  MOD_RES (594)..(597): Any amino acid
XXXXXXXXXXXXXXXXXXXXXXXXXXXXXXXXXXXXXXXXXXTLTGRGIEVVNAXXXXXXXXXXXXXXXXXXXXXXXXXXXXXXXXIGPPQCDLFXXXXXXXXXXXXXXXXXXXXXXXXXXXXXXXXXXXXXXXXXXXXXXXXXXXXXXXXXXXXXXXXXXXXXXPSFYAEMKWLLSNTDXXXXXXXXXXXXXXXXXXXXXXXXXXXXXXXXXXXRLYGSENKLITXXXXXXLQSFTPSPGXXXXXXXXXXXXXXXWLMLNPNGTITFTFNGSFIAXXXXXXXXXXXXXXXXXXXXXXXXXXXXXXXXXXXXXXXPFQNINSRVXXXXXXXXXXXXXXXXXXXXXXXXXXXXXXXAYRKRMTRGLFGAIXXXXXXXXXXXXXXXXXXXXXXXXXXXXXXXXXXXXXXXXXXXXXXXXXXXXXXXXXXXXXXXDKTNQQFEMXXXXXTEVERQIGNVINWTRDSITELWXXXXXXXXXXXXXXXXXXXDSEMNNLYERVRKQXXXXXXXXXXXXXXXXXXXXXXXXXXXXXXXXXXXXXXXXXXXXXXXXXXXXXSSGYKDVILXXXXXASCFIFLAIXXXXXXXCIKNGNMQCXXXX

SEQ ID NO: 419069 - protein, 597 aa, Influenza virus
  MOD_RES (1)..(44): Any amino acid
  MOD_RES (58)..(86): Any amino acid
  MOD_RES (96)..(170): Any amino acid
  MOD_RES (181)..(218): Any amino acid
  MOD_RES (228)..(258): Any amino acid
  MOD_RES (269)..(355): Any amino acid
  MOD_RES (367)..(460): Any amino acid
  MOD_RES (477)..(488): Any amino acid
  MOD_RES (505)..(585): Any amino acid
  MOD_RES (595)..(597): Any amino acid
XXXXXXXXXXXXXXXXXXXXXXXXXXXXXXXXXXXXXXXXXXXXTERGVEVVDATETXXXXXXXXXXXXXXXXXXXXXXXXXXXXXIGPPQCDRFXXXXXXXXXXXXXXXXXXXXXXXXXXXXXXXXXXXXXXXXXXXXXXXXXXXXXXXXXXXXXXXXXXXXXXXXXXXEMKWLLSNNDXXXXXXXXXXXXXXXXXXXXXXXXXXXXXXXXXXXXXXGNGNKLITVXXXXXXXXXXXXXXXXXXXXXXXXXXXXXXXMLNPNDTVIFXXXXXXXXXXXXXXXXXXXXXXXXXXXXXXXXXXXXXXXXXXXXXXXXXXXXXXXXXXXXXXXXXXXXXXXXXXXXXXXXXXXXXXXAYQKRMTRGLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRDSMTEVMVVYAELLVXXXXXXXXXXXXSEMDKLYTRVKRQLREXXXXXXXXXXXXXXXXXXXXXXXXXXXXXXXXXXXXXXXXXXXXXXXXXXXXXXXXXXXXXXXXXXXXXXXXXXXXXXXXXIKDGNMRCTXXX

SEQ ID NO: 419070 - protein, 597 aa, Influenza virus
  MOD_RES (1)..(170): Any amino acid
  MOD_RES (181)..(267): Any amino acid
  MOD_RES (277)..(355): Any amino acid
  MOD_RES (369)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEMKWLLSNADXXXXXXXXXXXXXXXXXXXXXXXXXXXXXXXXXXXXXXXXXXXXXXXXXXXXXXXXXXXXXXXXXXXXXXXXXXXXXXXXXXXXXXXGSFNGAFIAXXXXXXXXXXXXXXXXXXXXXXXXXXXXXXXXXXXXXXXXXXXXXXXXXXXXXXXXXXXXXXXXXXXXXXXXXXXXXXXAYQKQMTRGLFGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419071 - protein, 597 aa, Influenza virus
  MOD_RES (1)..(172): Any amino acid
  MOD_RES (182)..(361): Any amino acid
  MOD_RES (371)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKWLLSNSNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419072 - protein, 597 aa, Influenza virus
  MOD_RES (1)..(361): Any amino acid
  MOD_RES (371)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419073 - protein, 515 aa, Influenza virus
  MOD_RES (1)..(10): Any amino acid
  MOD_RES (38)..(62): Any amino acid
  MOD_RES (80)..(84): Any amino acid
  MOD_RES (127)..(127): Any amino acid
  MOD_RES (198)..(255): Any amino acid
  MOD_RES (309)..(318): Any amino acid
  MOD_RES (458)..(459): Any amino acid
  MOD_RES (478)..(478): Any amino acid
XXXXXXXXXXGVVNTTLSTIALLIGVGNLVFNTVIHEXXXXXXXXXXXXXXXXXXXXXXXXXITYNNTVINNITTTIITXXXXXFKSPLPLCPFRGFFPFHKDNAIRLGENKDVIVTREPYVSCDNXNCWSFALAQGALLGTKHSNGTIKDRTPYRSLIRFPIGTAPVLGNYKEICIAWSSSSCFDGKEWMHVCMTGXXXXXXXXXXXXXXXXXXXXXXXXXXXXXXXXXXXXXXXXXXXXXXXXXXXXXXXXXXGRMTDSIKSWRKDILRTQESECQCIDGTCVVAVTDGPAANSADHRVYWIREGRXXXXXXXXXXKIQHLEECSCYVDIDVYCICRDNWKGSNRPWMRINNETILETGYVCSKFHSDTPRPADPSTVSCDSPSNVNGGPGVKGFGFKAGNDVWLGRTVSTSGRSGFEIIKVTEGWINSPNHAKSVTQTLVSNNDWSGYSGSFIVXXKDCFQPCFYVELIRGRPNXNDDVSWTSNSIVTFCGLDNEPGSGNWPDGSNIGFMPK

SEQ ID NO: 419074 - protein, 515 aa, Influenza virus
  MOD_RES (1)..(10): Any amino acid
  MOD_RES (38)..(62): Any amino acid
  MOD_RES (80)..(84): Any amino acid
  MOD_RES (97)..(97): Any amino acid
  MOD_RES (127)..(127): Any amino acid
  MOD_RES (198)..(255): Any amino acid
  MOD_RES (309)..(318): Any amino acid
  MOD_RES (447)..(447): Any amino acid
  MOD_RES (458)..(459): Any amino acid
  MOD_RES (478)..(478): Any amino acid
XXXXXXXXXXGIVNTTLSTIALIIGVGNLIFNTVIHGXXXXXXXXXXXXXXXXXXXXXXXXXITYNSTVVNNITTTIVTXXXXXFKSSLPLCPFRGXFPFHKDNALRLAENKDVIITREPYVSCDYXDCWSFALAQGVLLGTKHSNGTVKDRTSYRSLIRFPVGTAPVLGNYREICIAWSSTSCFDGKEWMHICMTGXXXXXXXXXXXXXXXXXXXXXXXXXXXXXXXXXXXXXXXXXXXXXXXXXXXXXXXXXXGKMTDSIKSWRRDILRTQESECQRIDGTCVVTVTDGPAANNADHRIYWIREGKXXXXXXXXXXKIKHLEECSCYMDIDVYCVCRDNWKGSNRPWIRINNETILETRYVCSKFHSDTPRPDDPSTMSCDSPSNINGGLGVKGFGFKTGDDVWLGRTVSNSGRSGFEVIKVAEGWINSPSQAKSITQTLVSNNXWSGYSGSFVMXXNGCFQPCFYIELIRGRPNXNDNVSWTSNSIVTFCGLNNEPGSGNWPDGANIGFMPK

SEQ ID NO: 419075 - protein, 515 aa, Influenza virus
  MOD_RES (1)..(10): Any amino acid
  MOD_RES (38)..(62): Any amino acid
  MOD_RES (80)..(84): Any amino acid
  MOD_RES (127)..(127): Any amino acid
  MOD_RES (184)..(185): Any amino acid
  MOD_RES (197)..(255): Any amino acid
  MOD_RES (268)..(271): Any amino acid
  MOD_RES (281)..(281): Any amino acid
  MOD_RES (309)..(318): Any amino acid
  MOD_RES (458)..(459): Any amino acid
  MOD_RES (474)..(478): Any amino acid
  MOD_RES (490)..(494): Any amino acid
  MOD_RES (514)..(515): Any amino acid
XXXXXXXXXXGAVNTTLSTIALFIGVGNLAFNTVIHEXXXXXXXXXXXXXXXXXXXXXXXXXITYNNTVVNNITTTIIAXXXXXFKPPLPLCPFKGFFPFHKDNAIRPGENKGVIVTREPYISCDNXHCWSFALAQGALVGTKHSNGTIEDRTPYRSLIQFPMGTAPVLGNYREVCIAWSSSSXXDGKEWMHVSMTXXXXXXXXXXXXXXXXXXXXXXXXXXXXXXXXXXXXXXXXXXXXXXXXXXXXXXXXXXXGKMRDSIKSWRNXXXXTQESECLCIXGICVVAVTDGPADNSADHRIYWIRKGRXXXXXXXXXXRIQHLEECSCYTDIDIYCICRDNWKGSNRPWVRINNETILETGYICSKFHSDTPRPTDPSTISCDSPSNVKGGPGVKGFGFKKGSDVWLGRTVSISGRSSFEIIKVTDGWINSPNHVKSITQTLVSNSDWSGYSGSFIIXXGGCFQPCFYVELTRXXXXXNDEVSWTSNSIXXXXXLDNEPGSGKLPDGSDIGFMXX

SEQ ID NO: 419076 - protein, 515 aa, Influenza virus
  MOD_RES (1)..(10): Any amino acid
  MOD_RES (38)..(62): Any amino acid
  MOD_RES (80)..(84): Any amino acid
  MOD_RES (122)..(127): Any amino acid
  MOD_RES (186)..(186): Any amino acid
  MOD_RES (198)..(255): Any amino acid
  MOD_RES (267)..(272): Any amino acid
  MOD_RES (309)..(318): Any amino acid
  MOD_RES (341)..(344): Any amino acid
  MOD_RES (362)..(366): Any amino acid
  MOD_RES (403)..(405): Any amino acid
  MOD_RES (447)..(459): Any amino acid
  MOD_RES (478)..(478): Any amino acid
  MOD_RES (494)..(500): Any amino acid
  MOD_RES (510)..(515): Any amino acid
XXXXXXXXXXGVVNTALSTIALLIGIGNLVFNTVIHGXXXXXXXXXXXXXXXXXXXXXXXXXITYNKTVINNITTTITTXXXXXFKPSLPLCPFQGFFPFHKDNSARLIHHTNVIVTREPYXXXXXXGCWSFALAQGALLGTNHSNGTINDRTPYRSLIQFPIGTAPILGNYKEICVAWSSSSCFXGKEWMHVCITGXXXXXXXXXXXXXXXXXXXXXXXXXXXXXXXXXXXXXXXXXXXXXXXXXXXXXXXXXXGRVTDSIKSWRXXXXXXQESECQCIGGTCIVAVTDGPAANSAHHRVYWIREGKXXXXXXXXXXKIRHLEECSCYVDVDVYCICRDXXXXSNRPWMRISNETILETGXXXXXFHSDTPRPVDPSIMSCDSPSNINGEPGVKGFGFKVGXXXWLGRTVSINGRSGFEVIRVTEGWIDSPNHAKSLTQTLVSNNXXXXXXXXXXXXXKGCFQPCFYIELIRGKPNXNDDVSWASNSIVTFCXXXXXXXSGNWPDGSDXXXXXX

SEQ ID NO: 419077 - protein, 515 aa, Influenza virus
  MOD_RES (1)..(10): Any amino acid
  MOD_RES (38)..(62): Any amino acid
  MOD_RES (80)..(85): Any amino acid
  MOD_RES (95)..(98): Any amino acid
  MOD_RES (112)..(112): Any amino acid
  MOD_RES (124)..(134): Any amino acid
  MOD_RES (185)..(186): Any amino acid
  MOD_RES (198)..(255): Any amino acid
  MOD_RES (268)..(272): Any amino acid
  MOD_RES (283)..(285): Any amino acid
  MOD_RES (307)..(323): Any amino acid
  MOD_RES (341)..(345): Any amino acid
  MOD_RES (359)..(375): Any amino acid
  MOD_RES (392)..(392): Any amino acid
  MOD_RES (403)..(408): Any amino acid
  MOD_RES (433)..(434): Any amino acid
  MOD_RES (453)..(459): Any amino acid
  MOD_RES (478)..(478): Any amino acid
  MOD_RES (488)..(500): Any amino acid
  MOD_RES (512)..(515): Any amino acid
XXXXXXXXXXGSVNTVLSIIALLIGIGNLIFNTVIHEXXXXXXXXXXXXXXXXXXXXXXXXXVTYNNTVINNMTTTIINXXXXXXRLPLPLCPFXXXXPFHKGNSARLIHHXDVLVTREPYISXXXXXXXXXXXAQGALLGTRHSNGTIKDKTPYRSLIRFPIGVAPVLGNYKEIRIAWSSSSCXXGKEWLHVCITGXXXXXXXXXXXXXXXXXXXXXXXXXXXXXXXXXXXXXXXXXXXXXXXXXXXXXXXXXXGRMSDSIKSWRKXXXXXQESECQCISGXXXVSVTDGPAANSADHRIYWIKEXXXXXXXXXXXXXXXXXEECSCYVDTDVYCICRDXXXXXNRPWVRMNNETILXXXXXXXXXXXXXXXXXDPSVVSCDSPSNANGGXGVKGFGFKSGXXXXXXRTISYSSRSGFEIIRVIEGWINSPXXVKSVTQTLVSNDDWSGYSXXXXXXXKDCFQSCFYVELIRGRLNXDDDVSWTSNXXXXXXXXXXXXXSGHWPDGSNIGXXXX

SEQ ID NO: 419078 - protein, 515 aa, Influenza virus
  MOD_RES (1)..(12): Any amino acid
  MOD_RES (37)..(65): Any amino acid
  MOD_RES (79)..(87): Any amino acid
  MOD_RES (97)..(149): Any amino acid
  MOD_RES (159)..(168): Any amino acid
  MOD_RES (183)..(187): Any amino acid
  MOD_RES (198)..(256): Any amino acid
  MOD_RES (267)..(272): Any amino acid
  MOD_RES (283)..(292): Any amino acid
  MOD_RES (305)..(325): Any amino acid
  MOD_RES (337)..(350): Any amino acid
  MOD_RES (367)..(380): Any amino acid
  MOD_RES (391)..(413): Any amino acid
  MOD_RES (423)..(436): Any amino acid
  MOD_RES (447)..(468): Any amino acid
  MOD_RES (478)..(515): Any amino acid
XXXXXXXXXXXXVNTILSTKALLIGIGNLAFNAVIHXXXXXXXXXXXXXXXXXXXXXXXXXXXXXNHTTINNITNVVLXXXXXXXXXSLPLCPFKGXXXXXXXXXXXXXXXXXXXXXXXXXXXXXXXXXXXXXXXXXXXXXXXXXXXXXKDRAPYRSLXXXXXXXXXXLGNYKEMCAAWSSSXXXXXKEWMHVCMAGXXXXXXXXXXXXXXXXXXXXXXXXXXXXXXXXXXXXXXXXXXXXXXXXXXXXXXXXXXXRMADSIKSWRXXXXXXQESECQCLYGXXXXXXXXXXAANNADHRVYWIXXXXXXXXXXXXXXXXXXXXXCSCYVDIDIYCXXXXXXXXXXXXXXRINNETIVETGYVCSKXXXXXXXXXXXXXXSCSSPSGIEGXXXXXXXXXXXXXXXXXXXXXXXSGRLGFEIIXXXXXXXXXXXXXXAATQTLVSNNXXXXXXXXXXXXXXXXXXXXXXVELIRGRPIXXXXXXXXXXXXXXXXXXXXXXXXXXXXXXXXXXXXXX

SEQ ID NO: 419079 - protein, 515 aa, Influenza virus
  MOD_RES (1)..(173): Any amino acid
  MOD_RES (186)..(294): Any amino acid
  MOD_RES (309)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEICVAWSSTSCFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNKADHRIYWIREGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419080 - protein, 585 aa, Influenza virus
  MOD_RES (16)..(23): Any amino acid
  MOD_RES (42)..(42): Any amino acid
  MOD_RES (67)..(80): Any amino acid
  MOD_RES (91)..(91): Any amino acid
  MOD_RES (104)..(105): Any amino acid
  MOD_RES (115)..(125): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(211): Any amino acid
  MOD_RES (221)..(224): Any amino acid
  MOD_RES (235)..(241): Any amino acid
  MOD_RES (258)..(261): Any amino acid
  MOD_RES (282)..(311): Any amino acid
  MOD_RES (334)..(334): Any amino acid
  MOD_RES (348)..(349): Any amino acid
  MOD_RES (528)..(531): Any amino acid
  MOD_RES (566)..(568): Any amino acid
SKSRGYKMNTQILVFXXXXXXXXGCDHSDNADKICLGHHAVXNGTKVNTLTERGVEVVNATETVERXXXXXXXXXXXXXXDLGQCGLLGTXTGPPQCDQFLEFXXDLIIERREGXXXXXXXXXXXEEALRQILRESGGXXXXXMGFTYSGIRTNGXXXXXXRSGSSFYAEMKWLLSNXXXXXFPQMTKSYKNXXXXPALIIWGIHHXXXXXEQTKLYGSGXXXXTVGSSNYQQSXXXXXXXRPQVNGQSGRIDFHWLXXXXNDTVTFSFNGAFIAPDRASFXXXXXXXXXXXXXXXXXXXXXXXXXXXXXXSNLPFQNINSRAVGKCPRYVKQXSLLLATGMKNVPEXXTHKQLTHHMRKKRGLFGAGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYRXXXXQNRIQIDPVKLSSGYKDVILWFSFGASCFILLAIXXXLVFICVKNGNMRCTICI

SEQ ID NO: 419081 - protein, 585 aa, Influenza virus
  MOD_RES (16)..(30): Any amino acid
  MOD_RES (42)..(42): Any amino acid
  MOD_RES (67)..(80): Any amino acid
  MOD_RES (90)..(91): Any amino acid
  MOD_RES (101)..(105): Any amino acid
  MOD_RES (115)..(125): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(211): Any amino acid
  MOD_RES (221)..(224): Any amino acid
  MOD_RES (235)..(241): Any amino acid
  MOD_RES (258)..(261): Any amino acid
  MOD_RES (282)..(311): Any amino acid
  MOD_RES (333)..(334): Any amino acid
  MOD_RES (346)..(349): Any amino acid
  MOD_RES (400)..(400): Any amino acid
  MOD_RES (528)..(531): Any amino acid
  MOD_RES (566)..(568): Any amino acid
MKSRGYKMNIQILILXXXXXXXXXXXXXXXGDKICLGHHAEXNGTKVDTLTEKGIEVVNATETVEQXXXXXXXXXXXXXXDLGKCGLLGXXIGPPQCDQFXXXXXNLIIERREGXXXXXXXXXXXEETLRQILRKSGGXXXXXMGFTYTGVRTNGXXXXXXRSRSSFYAEMKWLLSSXXXXXFPQTTKSYKNXXXXPALIVWGIHHXXXXXEQTRLYGSGXXXXTVGSSKYQQSXXXXXXXRPQINGQSGRIDFYWLXXXXNDTVTFTFNGAFIAPNRASFXXXXXXXXXXXXXXXXXXXXXXXXXXXXXXSSLPFQNINPRTIGKCPRYVKXXSLMLATGMKNVXXXXAHKQLTHHMKKREKRGLFGAIAGFIENGWEGLVDGWYGFRHQKAQGEGTAXDYKSTQSAVNQITGKLNRLIDKTNQQFELIDNKFNEIEKQIGNVINWTRDSITEMWSYNAELLIAMENQHTIDLTDSEMNKLYEKVRRQLRENAEEDCTGCFEIFHQCDNDCMESIRNNTYDHKKYRXXXXQNRIQIDAVKLSSGYKEVILWFSFGASCFLLLAIXXXLVFMCVKNGNMRGTNWI

SEQ ID NO: 419082 - protein, 585 aa, Influenza virus
  MOD_RES (1)..(2): Any amino acid
  MOD_RES (16)..(30): Any amino acid
  MOD_RES (42)..(42): Any amino acid
  MOD_RES (67)..(80): Any amino acid
  MOD_RES (91)..(91): Any amino acid
  MOD_RES (104)..(105): Any amino acid
  MOD_RES (115)..(125): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(211): Any amino acid
  MOD_RES (221)..(224): Any amino acid
  MOD_RES (235)..(241): Any amino acid
  MOD_RES (258)..(261): Any amino acid
  MOD_RES (282)..(311): Any amino acid
  MOD_RES (334)..(334): Any amino acid
  MOD_RES (348)..(349): Any amino acid
  MOD_RES (368)..(379): Any amino acid
  MOD_RES (401)..(401): Any amino acid
  MOD_RES (508)..(511): Any amino acid
  MOD_RES (528)..(531): Any amino acid
  MOD_RES (566)..(568): Any amino acid
XXSRGYKMNTKILVLXXXXXXXXXXXXXXXADKICLGRHAVXNGAKVNTLTEREVEVVNATETVETXXXXXXXXXXXXXXDLSQCGLLGTXTGPPQCDLFLEFXXNLIVERREGXXXXXXXXXXXEESLRQILRGSGGXXXXXTGFTYSGIRTDGXXXXXXRSESSFYAEMEWLLSNXXXXXFPQMTKSYRNXXXXPALIIWGVHHXXXXXEQTKLYGNGXXXXTVWSSKYQQSXXXXXXXRPQMNGQSGRIDFHWMXXXXNDTITFSFNGAFVAPDRVSFXXXXXXXXXXXXXXXXXXXXXXXXXXXXXXSNLPFQNVNSRAVGKCPKYVKQXSLLLATGMRNVPEXXIHKQLTHHMKKKRGLFGAXXXXXXXXXXXXGLIDGWYGYRHQNAQGEGIAAXYKSTQSAINQITGKLNRLIERTNQQFELIDNEFNEIEQQIGNVINWTRDSLTEVWSYNADLLVAMENQHIIDLADSEMNKLYERVKRQLRENAEEDGNGCFEIFHQXXXXCMTSIRNNTYDHTQYRXXXXQNRVKIDPVKLSGGYKDVILWFSLGASCFLLIAIXXXLAFICIKNGNMRCTSCI

SEQ ID NO: 419083 - protein, 585 aa, Influenza virus
  MOD_RES (1)..(5): Any amino acid
  MOD_RES (16)..(32): Any amino acid
  MOD_RES (42)..(42): Any amino acid
  MOD_RES (54)..(80): Any amino acid
  MOD_RES (91)..(91): Any amino acid
  MOD_RES (101)..(105): Any amino acid
  MOD_RES (115)..(125): Any amino acid
  MOD_RES (139)..(143): Any amino acid
  MOD_RES (154)..(161): Any amino acid
  MOD_RES (178)..(182): Any amino acid
  MOD_RES (193)..(196): Any amino acid
  MOD_RES (207)..(211): Any amino acid
  MOD_RES (221)..(224): Any amino acid
  MOD_RES (235)..(241): Any amino acid
  MOD_RES (253)..(261): Any amino acid
  MOD_RES (275)..(311): Any amino acid
  MOD_RES (334)..(349): Any amino acid
  MOD_RES (361)..(361): Any amino acid
  MOD_RES (371)..(380): Any amino acid
  MOD_RES (398)..(401): Any amino acid
  MOD_RES (527)..(531): Any amino acid
  MOD_RES (566)..(568): Any amino acid
XXXXXYKMNTQILIFXXXXXXXXXXXXXXXXXKISLGHHAVXNGIKVDTLTEKXXXXXXXXXXXXXXXXXXXXXXXXXXXDLGRCGLLGTXIGPPQCDLFXXXXXDLIIERRDGXXXXXXXXXXXEETLRKILRKSGGXXXXXMRFTYSGIRTXXXXXXXXRSGPSFYAEMKWLLSDXXXXXFPQMTRSYKNXXXXPALITWGIHHXXXXXEQIKLYGSGXXXXTVWSSKYQRSXXXXXXXRPPVNGQSGRIXXXXXXXXXNDTVNFSFNGAFIXXXXXXXXXXXXXXXXXXXXXXXXXXXXXXXXXXXXXSKLPFQNINSRTVGRCPRYVKQXXXXXXXXXXXXXXXXKKKKKKRGLFGXRRRGLFGAIXXXXXXXXXXLIDGWYGYKHQNAQGEGXXXXYKSTQAAIDQITGTLNRLIDKTNQQFEMIDNEFNEVERQIGNVINWTRDSIIEVWSYNAEFLVAVENQHTIDLAESEMNKLYERVRKQLRENAEEDGTGCFELFHKCDDDCMASIRNNSYDHSKYXXXXXQNRIQINPVKLSSGYKDIILWFSFGASCFTLLAIXXXLVFICIKNGNMQCTICI

SEQ ID NO: 419084 - protein, 585 aa, Influenza virus
  MOD_RES (1)..(44): Any amino acid
  MOD_RES (57)..(81): Any amino acid
  MOD_RES (91)..(105): Any amino acid
  MOD_RES (115)..(125): Any amino acid
  MOD_RES (139)..(143): Any amino acid
  MOD_RES (153)..(161): Any amino acid
  MOD_RES (172)..(224): Any amino acid
  MOD_RES (234)..(261): Any amino acid
  MOD_RES (282)..(311): Any amino acid
  MOD_RES (321)..(323): Any amino acid
  MOD_RES (334)..(350): Any amino acid
  MOD_RES (361)..(361): Any amino acid
  MOD_RES (371)..(384): Any amino acid
  MOD_RES (402)..(405): Any amino acid
  MOD_RES (421)..(426): Any amino acid
  MOD_RES (450)..(452): Any amino acid
  MOD_RES (464)..(467): Any amino acid
  MOD_RES (483)..(497): Any amino acid
  MOD_RES (528)..(531): Any amino acid
  MOD_RES (566)..(568): Any amino acid
  MOD_RES (583)..(585): Any amino acid
XXXXXXXXXXXXXXXXXXXXXXXXXXXXXXXXXXXXXXXXXXXXTKVNTLTEKGIEXXXXXXXXXXXXXXXXXXXXXXXXXLGQCGLLGIXXXXXXXXXXXXXXXNLIIERSEGXXXXXXXXXXXGEALRQILRRSGGXXXXXTRFTYSGIRXXXXXXXXXRLGSSFYAEMXXXXXXXXXXXXXXXXXXXXXXXXXXXXXXXXXXXXXXXXXXXXXXXXXXXXXTVWSSKYRRXXXXXXXXXXXXXXXXXXXXXXXXXXXXNDTVTFNFNGAFVAPDRASFXXXXXXXXXXXXXXXXXXXXXXXXXXXXXXNNLPFQNINXXXVGECPRYVKQXXXXXXXXXXXXXXXXXKKRKKRGLFGXRKRGLFGAIXXXXXXXXXXXXXXWYGFRHQNSQGEGTAADXXXXQSAIDQITRKLNRLIXXXXXXFELIDNEFSEIEKQLGNVINWTRXXXIEIWSYNAEFLXXXXNQHTIDSTDSEMNKLXXXXXXXXXXXXXXXGTACFEIFHKCDDQCMGSIRNNTYDHSTYRXXXXQNIIQIDPVELSSGYKDVIIWFSFGASCFLFLAIXXXLIFMCVKNGNMQCTXXX

SEQ ID NO: 419085 - protein, 585 aa, Influenza virus
  MOD_RES (1)..(46): Any amino acid
  MOD_RES (62)..(81): Any amino acid
  MOD_RES (91)..(145): Any amino acid
  MOD_RES (156)..(225): Any amino acid
  MOD_RES (235)..(358): Any amino acid
  MOD_RES (368)..(386): Any amino acid
  MOD_RES (397)..(406): Any amino acid
  MOD_RES (416)..(427): Any amino acid
  MOD_RES (439)..(467): Any amino acid
  MOD_RES (483)..(502): Any amino acid
  MOD_RES (528)..(534): Any amino acid
  MOD_RES (557)..(571): Any amino acid
  MOD_RES (581)..(585): Any amino acid
XXXXXXXXXXXXXXXXXXXXXXXXXXXXXXXXXXXXXXXXXXXXXXVNTLTERGIEVVNATXXXXXXXXXXXXXXXXXXXXLGQCGFLGTXXXXXXXXXXXXXXXXXXXXXXXXXXXXXXXXXXXXXXXXXXXXXXXXXXXXXXXFTYTGVRTDGXXXXXXXXXXXXXXXXXXXXXXXXXXXXXXXXXXXXXXXXXXXXXXXXXXXXXXXXXXXXXXXXXXXXXXVESSNYQQSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKRRKRGLFXXXXXXXXXXXXXXXXXXXGFKHQNAQGEXXXXXXXXXXSAIDQITGTXXXXXXXXXXXXKLIDNEFTEIEXXXXXXXXXXXXXXXXXXXXXXXXXXXXXNQHTIDLTNSEMNKLXXXXXXXXXXXXXXXXXXXXEIFHKCDDRCMANIRNNTYDHRKYKXXXXXXXVKIDPVELSSGYKEIILWFSFGXXXXXXXXXXXXXXXICVKNGNMQXXXXX

SEQ ID NO: 419086 - protein, 585 aa, Influenza virus
  MOD_RES (1)..(358): Any amino acid
  MOD_RES (368)..(429): Any amino acid
  MOD_RES (446)..(503): Any amino acid
  MOD_RES (513)..(573): Any amino acid
  MOD_RES (585)..(585): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKRGLFGAIXXXXXXXXXXXXXXXXXXXXXXXXXXXXXXXXXXXXXXXXXXXXXXXXXXXXXXXXXXXXXXIDNEFSEVEKQLGNVIXXXXXXXXXXXXXXXXXXXXXXXXXXXXXXXXXXXXXXXXXXXXXXXXXXXXXXXXXXIFHKCDDNCXXXXXXXXXXXXXXXXXXXXXXXXXXXXXXXXXXXXXXXXXXXXXXXXXXXXXXXXXXXXXVKNGNHAVHYCX

SEQ ID NO: 419087 - protein, 585 aa, Influenza virus
  MOD_RES (1)..(361): Any amino acid
  MOD_RES (371)..(585): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKRGLFGAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419088 - protein, 585 aa, Influenza virus
  MOD_RES (1)..(363): Any amino acid
  MOD_RES (373)..(585): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419089 - protein, 471 aa, Influenza virus
  MOD_RES (39)..(61): Any amino acid
  MOD_RES (73)..(81): Any amino acid
  MOD_RES (164)..(168): Any amino acid
  MOD_RES (251)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (454)..(454): Any amino acid
MNPNQKLFALSGVAIALSVLNLLIGISNVGLNVSLHLKXXXXXXXXXXXXXXXXXXXXXXXENTYVNNTTIIXXXXXXXXXSYLLLNKSLCNVEGWVVIAKDNAVRFGESEQIIVTREPYVSCDPTGCKMYALHQGTTIRNKHSNGTIHDRTAFRGLISTPLGXXXXXSNSDFMCVGWSSTTCHDGIGRMTICIQGNNDNATATVYYNRRLTTTIKTWARNILRTQESECVCHNGTCAVVMTDGSASSQAXXXXXXXXXXXXXXXXXLKGSARHIEECSCYGHNXXVTCVCRDNWQGANRPIIEIDMNXLEHTSRYVCTGILTDTSRPGDKXXGDCSNPITGSPGAPGVKGFGFLNGDNTWLGRTISPRSRSGFEMLKIPNAGTDPXXXXXXRQEIVDNNNWSGYSGSFIDYWNDXSECYNPCFYVELIRGRPEEAKYVWWTSNSLIALCGSPXPVGSGSFPDGAQIQYFS

SEQ ID NO: 419090 - protein, 471 aa, Influenza virus
  MOD_RES (39)..(61): Any amino acid
  MOD_RES (73)..(81): Any amino acid
  MOD_RES (136)..(137): Any amino acid
  MOD_RES (164)..(168): Any amino acid
  MOD_RES (251)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (426)..(431): Any amino acid
  MOD_RES (449)..(454): Any amino acid
MNPSQKLFALSGVAIALSILNLLIGISNMSLNISLYSKXXXXXXXXXXXXXXXXXXXXXXXKNTYVNNTTVIXXXXXXXXXNYLMLNKSLCKVEGWVVVAKDNAIRFGESEQIVVTREPYVSCDPLSCKMYALHQXXTIRNKHSNSTTHDRTAFRGLMSTPLGXXXXXSNSDFLCVGWSSTSCHDGIARMTICIQGDNENATATVYYDRRLTTTIRTWAKNILRTQESECVRHNGTCAVVMTDGPANNQAXXXXXXXXXXXXXXXXXLKGSAKHIEECSCYGHSXXATCVCRDNWQGANRPVIEIDMNXLEHTSRYICTGVLTDTSRPSDKXXGDCNNPITGSPGVPGVKGFGFLDSGNTWLGRTISPKLRSGFEMLKIHNAGTDPXXXXXXRQEIVSNDNWSGYSGSFIDYWDEXNECYNPCFYXXXXXXRPEEAKYVEWTSNSLIAXXXXXXSVGSGSFPDGAQIKYFS

SEQ ID NO: 419091 - protein, 471 aa, Influenza virus
  MOD_RES (39)..(61): Any amino acid
  MOD_RES (73)..(81): Any amino acid
  MOD_RES (138)..(139): Any amino acid
  MOD_RES (164)..(168): Any amino acid
  MOD_RES (251)..(267): Any amino acid
  MOD_RES (285)..(286): Any amino acid
  MOD_RES (296)..(299): Any amino acid
  MOD_RES (309)..(309): Any amino acid
  MOD_RES (332)..(333): Any amino acid
  MOD_RES (387)..(392): Any amino acid
  MOD_RES (416)..(433): Any amino acid
  MOD_RES (451)..(454): Any amino acid
  MOD_RES (467)..(471): Any amino acid
MNPNQKLFTLSGVAIALGIINLLIGISNIGLNVSLHLRXXXXXXXXXXXXXXXXXXXXXXXENKYVNNTTIIXXXXXXXXXGYLLLNKSLCSVEGWVVIAQDNAIRFGESEQVIVTREPYVSCDPSGCRMYALHQGTXXRNKHSNGTTHDRTAFRGLISTHLGXXXXXSNSDFICVGWSSTSCHDGVGRMTICVQGNNENATATVYYNKRLTTTIKTWAKNILRTQDSECVSHNGTWAVVMTDGPASSQAXXXXXXXXXXXXXXXXXLRGSARHIEEWSCYGHSXXITCVCRDNWXXXXRPIIEIDMTXMEHTSQYLCTGVLTDTSRPKDKXXGECFNPITGSPGSPGVKGFGFLSGSNTWLGRTISPRLRSGFEMLRIPNAGIDPXXXXXXRQEIVGNDNWSGYSGSFIDYWDDXXXXXXXXXXXXXXXXXXEEAKYVWWASNSLIALCXXXXPVGPGSFPDGAQXXXXX

SEQ ID NO: 419092 - protein, 471 aa, Influenza virus
  MOD_RES (1)..(1): Any amino acid
  MOD_RES (39)..(61): Any amino acid
  MOD_RES (71)..(81): Any amino acid
  MOD_RES (102)..(117): Any amino acid
  MOD_RES (127)..(143): Any amino acid
  MOD_RES (164)..(168): Any amino acid
  MOD_RES (247)..(275): Any amino acid
  MOD_RES (285)..(286): Any amino acid
  MOD_RES (297)..(299): Any amino acid
  MOD_RES (309)..(309): Any amino acid
  MOD_RES (332)..(336): Any amino acid
  MOD_RES (387)..(392): Any amino acid
  MOD_RES (409)..(438): Any amino acid
  MOD_RES (454)..(454): Any amino acid
XNPNQKLFASSGIAIVLGIINLLIGVSNVGLNMSLHLKXXXXXXXXXXXXXXXXXXXXXXXGNTYVNNTTXXXXXXXXXXXNYLLLNKSLCKIEGWVVVAKXXXXXXXXXXXXXXXXEPYVSCDPIXXXXXXXXXXXXXXXXXSNGTIHDRAAFRGLISTQLGXXXXXSNSEFICVGWSSTTCHDGVNRMTICVQGDNNNATATVYYNGRLTTTIKTWAGNILRTQESECVCHNSTCVVVMTDGPAXXXXXXXXXXXXXXXXXXXXXXXXXXXXXEECSCYGHDXXVSCVCRDNWQXXXRPIIEIDMSXLEHTSKYVCTGVLTDTSRPGDRXXXXXSNPITGSPCAPGIKGFGFLNENNTWLGRTISPRSRNGFEMLKIPNAETDPXXXXXXRQEIVDNSNWSGYSGSXXXXXXXXXXXXXXXXXXXXXXXXXXXXXXVWWTSNSLVALCGSPXPIGSGFFPDGPQIQYFS

SEQ ID NO: 419093 - protein, 471 aa, Influenza virus
  MOD_RES (1)..(7): Any amino acid
  MOD_RES (39)..(62): Any amino acid
  MOD_RES (73)..(84): Any amino acid
  MOD_RES (109)..(117): Any amino acid
  MOD_RES (127)..(144): Any amino acid
  MOD_RES (164)..(182): Any amino acid
  MOD_RES (206)..(206): Any amino acid
  MOD_RES (224)..(229): Any amino acid
  MOD_RES (251)..(286): Any amino acid
  MOD_RES (299)..(299): Any amino acid
  MOD_RES (309)..(309): Any amino acid
  MOD_RES (320)..(345): Any amino acid
  MOD_RES (368)..(369): Any amino acid
  MOD_RES (379)..(392): Any amino acid
  MOD_RES (409)..(471): Any amino acid
XXXXXXXFASSGIAIALGIINLLIGISNVVLNVSLHLKXXXXXXXXXXXXXXXXXXXXXXXXNTYINNATIIXXXXXXXXXXXXMLNKSLCKIEGWVVIEKDNAVRFGXXXXXXXXXEPYVSCDPKXXXXXXXXXXXXXXXXXXNGTIHDRTTFRGLLSTPLGXXXXXXXXXXXXXXXXXXXCHDGVSRMTICVQGNNNNATATVXYDRRLTTTVKTWAGNILXXXXXXCVCHNGTCVVIMTDGSASSRAXXXXXXXXXXXXXXXXXXXXXXXXXXXXXXXXXXXXVTCGCRDNWQGAXRPVIEIDMSXMDHTSQYLCTXXXXXXXXXXXXXXXXXXXXXXXXXXAPGTKGFGFLNEDSTWLGRTISXXSRSGFEMLRXXXXXXXXXXXXXXRQEIVDNKNWSGYSGSXXXXXXXXXXXXXXXXXXXXXXXXXXXXXXXXXXXXXXXXXXXXXXXXXXXXXXXXXXXXXXX

SEQ ID NO: 419094 - protein, 471 aa, Influenza virus
  MOD_RES (1)..(17): Any amino acid
  MOD_RES (29)..(62): Any amino acid
  MOD_RES (73)..(90): Any amino acid
  MOD_RES (100)..(149): Any amino acid
  MOD_RES (161)..(218): Any amino acid
  MOD_RES (229)..(232): Any amino acid
  MOD_RES (251)..(315): Any amino acid
  MOD_RES (326)..(375): Any amino acid
  MOD_RES (387)..(399): Any amino acid
  MOD_RES (411)..(471): Any amino acid
XXXXXXXXXXXXXXXXXSVLNLLIGVSNXXXXXXXXXXXXXXXXXXXXXXXXXXXXXXXXXXNTYINNTTIIXXXXXXXXXXXXXXXXXXCNVEGWVVVXXXXXXXXXXXXXXXXXXXXXXXXXXXXXXXXXXXXXXXXXXXXXXXXXXDRTTFRGLISTXXXXXXXXXXXXXXXXXXXXXXXXXXXXXXXXXXXXXXXXXXXXXXXXXXXXXXXXXXARNILRTQDSXXXXHNGTCVVVMTDGSASGQAXXXXXXXXXXXXXXXXXXXXXXXXXXXXXXXXXXXXXXXXXXXXXXXXXXXXXXXXXXXXXXXXXYICTGILTDTXXXXXXXXXXXXXXXXXXXXXXXXXXXXXXXXXXXXXXXXXXXXXXXXXXMLKIPNAGIDPXXXXXXXXXXXXXSNRSGYSGSFIXXXXXXXXXXXXXXXXXXXXXXXXXXXXXXXXXXXXXXXXXXXXXXXXXXXXXXXXXXXXX

SEQ ID NO: 419095 - protein, 471 aa, Influenza virus
  MOD_RES (1)..(92): Any amino acid
  MOD_RES (102)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVEGWVVIEKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419096 - protein, 471 aa, Influenza virus
  MOD_RES (1)..(96): Any amino acid
  MOD_RES (108)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVIAKDNAIRFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419097 - protein, 567 aa, Influenza virus
  MOD_RES (1)..(9): Any amino acid
  MOD_RES (179)..(183): Any amino acid
  MOD_RES (417)..(418): Any amino acid
XXXXXXXXXLLASTNAYDRICIGYQSNNSTDTVNTLIEQNVPVTQTMELVETEKHPAYCNTDLGAPLELRDCKIEAVIYGNPKCDIHLKDQGWSYIVERPSAPEGMCYPGSVENLEELRFVFSNAASYKRIRLFDYSRWNVTSSGTSKACNASTGGQSFYRSINWLTKKKPDTYDFNEXXXXXNNEDGDIIFLWGIHHPPDTKEQTTLYKNANTLSSVTTNTINRSFQPNIGPRPLVRGQQGRMDYYWGILKRGETLKIRTNGNLIAPEFGYLLKGESHGRIIQNEDIPIGNCHTKCQTYAGAINSSKPFQNASRHYMGECPKYVKKASLRLAVGLRNTPSIEPKGLFGAIAGFIEGGWSGMIDGWYGFHHSNSEGTGMAADQKSTQEAIDKITNKVNNIVDKMNREFEVVNHEFSXXEKRINMINDKIDDQIEDLWAYNAELLVLLENQKTLDEHDSNVKNLFDEVKRRLSANAIDAGNGCFDILHKCNNECMETIKNGTYNHKEYEEEAKLERSKINGVKLEENTTYKILSIYSTVAASLCLAILIAGGLILGMQNGSCRCMFCI

SEQ ID NO: 419098 - protein, 567 aa, Influenza virus
  MOD_RES (1)..(9): Any amino acid
  MOD_RES (21)..(22): Any amino acid
  MOD_RES (101)..(102): Any amino acid
  MOD_RES (179)..(183): Any amino acid
  MOD_RES (244)..(266): Any amino acid
  MOD_RES (400)..(400): Any amino acid
  MOD_RES (417)..(418): Any amino acid
  MOD_RES (439)..(443): Any amino acid
  MOD_RES (537)..(537): Any amino acid
XXXXXXXXXLLVSTNAYDRIXXGYQSNNSTNTVNTLIEQKVPVTQTMELVEAEKHSAYCNTDLGTPLELRDCKVEAVIYGNPKCDVHLKDQSWSYIVERPXXPEGMCYPGFVENLEELRFVFSSAASYKRIRLFDYSKWNVTRSGTSKACNALTGGQSFYRSINWLTKKEPDTYDFNEXXXXXNNEDGNIIFLWGIHHPPNTKEQTALYKNANTLTSVTTNTINRIFQPNIGPRALVRGQQGRXXXXXXXXXXXXXXXXXXXXXXXAPEFGYLLRGESHGRTIQNEDIPIENCNTKCQTYAGAVNSSKPFQNTSRHYMGECPNYVKKESLRLAVGLRNTPSVEPRGLFGAIAGFIEGGWCGMIDGWYGFHHSNAEGTGMAADQKSTQEAIGKITNKVNNXVDKMNREFGVVNHEFSXXEKKINMINDKINDQIEDLWAXXXXXLVLLENQKILDEHDSNVENLFDEVRRRLSANAVDTGNGCFDILHKCDNECMETIKNGTYDHKEYEEEAKLEKSRINGVKLEENTSYKILSIYSXVAASLCLAVLIAGGLILGMQNGSYRCMFCI

SEQ ID NO: 419099 - protein, 567 aa, Influenza virus
  MOD_RES (1)..(9): Any amino acid
  MOD_RES (21)..(25): Any amino acid
  MOD_RES (74)..(77): Any amino acid
  MOD_RES (101)..(103): Any amino acid
  MOD_RES (160)..(162): Any amino acid
  MOD_RES (248)..(270): Any amino acid
  MOD_RES (352)..(382): Any amino acid
  MOD_RES (400)..(402): Any amino acid
  MOD_RES (417)..(418): Any amino acid
  MOD_RES (444)..(446): Any amino acid
  MOD_RES (539)..(539): Any amino acid
  MOD_RES (557)..(567): Any amino acid
XXXXXXXXXLLMSTNAYDRIXXXXXSNNSTDTVDTLIEQNIPVTQTMELVETKKHPAYCNTDLGSPLELRDCKXXXXIYGNPKCDTHLKDQDWSYIVERPXXXEGMCYPGSIENLEELRFVFSIAASYKRIRLFDYSGWNVTSSGTSKACSASTGGQSFXXXINWLTKKKNPEAYNFNEGSYVNNKDGDIIFLWGIHHPPDAKEQTTLYKNTNTLSSVTTNTINRNFQPNIGPRPLVREQQGRMDYYXXXXXXXXXXXXXXXXXXXXXXXGYLLKGESYGRIIQNEDIPIGSCHTKCQTYTGAINSSRPFQNASRHHMGECPKYVRKASLRLAVGLRNTPSIDPKGLFGAIXXXXXXXXXXXXXXXXXXXXXXXXXXXXXXXQKSTQEAIEKITNKVNNXXXKMNREFEVMNHEFSXXEKRTNMINDKIDDQIEGLWAYNAELXXXLENQKTLDKHDSNVKNLFDEVRRRLSTNAIDTGNGCFDILHKCDNKCMETIKNGTYNRKEYEEEAKLERSKINEVKLEENTTYRILSIYSTVXASLCLAILVAGGLILGMXXXXXXXXXXX

SEQ ID NO: 419100 - protein, 567 aa, Influenza virus
  MOD_RES (1)..(9): Any amino acid
  MOD_RES (26)..(28): Any amino acid
  MOD_RES (64)..(80): Any amino acid
  MOD_RES (98)..(122): Any amino acid
  MOD_RES (179)..(183): Any amino acid
  MOD_RES (252)..(271): Any amino acid
  MOD_RES (289)..(291): Any amino acid
  MOD_RES (351)..(382): Any amino acid
  MOD_RES (400)..(403): Any amino acid
  MOD_RES (417)..(418): Any amino acid
  MOD_RES (444)..(464): Any amino acid
  MOD_RES (485)..(497): Any amino acid
  MOD_RES (531)..(567): Any amino acid
XXXXXXXXXLLASTNAHDRICIGYQXXXSTDTVNTLMEQNVPVTQAMELVEAEKNPAYCNTDLXXXXXXXXXXXXXXXXXNPKCDIHLRDQGWSYIVXXXXXXXXXXXXXXXXXXXXXXXXXSSAASYKRVRLFDYSRWNVSSSGTSKACNASTGAQSFYRSINWLTKKKPDIYDFNEXXXXXNNENGDIIFLWGIHHPPDETEQTKLYKNTNTLSSVNTNTINRSFRPNIGPRPLVRGQQGTMDYYWGILXXXXXXXXXXXXXXXXXXXXYLLKGESHCRIIQNEDIXXXNCYTKCQTYAGAINSSRPFQNASRYYMGECPKYAKKASLRLALGLRNTPSIEPRGLFGAXXXXXXXXXXXXXXXXXXXXXXXXXXXXXXXXQKSTQEAINKITNKVNNXXXXMNREFEVVDHEFSXXEKRINVINDKIDDQIENLWAYNAELXXXXXXXXXXXXXXXXXXXXXDEVKRRLSTNAMDAGNGCFDXXXXXXXXXXXXXKNGTYNHKDYEEEAKLERSKINGVILEENTTYKXXXXXXXXXXXXXXXXXXXXXXXXXXXXXXXXXXXXX

SEQ ID NO: 419101 - protein, 567 aa, Influenza virus
  MOD_RES (1)..(9): Any amino acid
  MOD_RES (19)..(28): Any amino acid
  MOD_RES (46)..(46): Any amino acid
  MOD_RES (65)..(86): Any amino acid
  MOD_RES (101)..(133): Any amino acid
  MOD_RES (143)..(149): Any amino acid
  MOD_RES (167)..(171): Any amino acid
  MOD_RES (196)..(201): Any amino acid
  MOD_RES (221)..(234): Any amino acid
  MOD_RES (252)..(272): Any amino acid
  MOD_RES (290)..(291): Any amino acid
  MOD_RES (351)..(388): Any amino acid
  MOD_RES (406)..(418): Any amino acid
  MOD_RES (444)..(464): Any amino acid
  MOD_RES (489)..(497): Any amino acid
  MOD_RES (512)..(513): Any amino acid
  MOD_RES (531)..(567): Any amino acid
XXXXXXXXXILVSTNAYDXXXXXXXXXXSTDTVNTLTEQNVPVTQXMELVETEKNLAYCNTDLGXXXXXXXXXXXXXXXXXXXXXXHLKDQAWSYIVERPXXXXXXXXXXXXXXXXXXXXXXXXXXXXXXXXXFDYSKWNVSXXXXXXXCNASTGGQAFYRSINWLXXXXXPDTYDFNEGSYINNEEGDIIFLWGXXXXXXAKEQTALYKNANTLSSVNTXXXXXXXXXXXXXXPLVRGQQGWMDYYWGILXXXXXXXXXXXXXXXXXXXXXLLKGESHGKIIQNEDIPXXNCKTKCQTYAGAINSSKPLQNASRHYMGECPEYVKKESLRLALGLRNTPSVEPKGLFGAXXXXXXXXXXXXXXXXXXXXXXXXXXXXXXXXXXXXXXAIDKITNKINNIVDKMNXXXXXXXXXXXXXEKRINMISDKIDDQIEELWAYNAELXXXXXXXXXXXXXXXXXXXXXDEVRRRLSVNAIDTGKGCFDILHKXXXXXXXXXKNGTYDHKDYEEEAXXERSKINGVRLEENTTYKXXXXXXXXXXXXXXXXXXXXXXXXXXXXXXXXXXXXX

SEQ ID NO: 419102 - protein, 567 aa, Influenza virus
  MOD_RES (1)..(52): Any amino acid
  MOD_RES (64)..(171): Any amino acid
  MOD_RES (183)..(299): Any amino acid
  MOD_RES (317)..(325): Any amino acid
  MOD_RES (343)..(567): Any amino acid
XXXXXXXXXXXXXXXXXXXXXXXXXXXXXXXXXXXXXXXXXXXXXXXXXXXXEKHLAYCNTDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDIYDFNEGSYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYTGAINSSKPFQNASRYXXXXXXXXXKKESLRLAIGLRNTPSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419103 - protein, 567 aa, Influenza virus
  MOD_RES (1)..(172): Any amino acid
  MOD_RES (186)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTYDFNEGTYINNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419104 - protein, 567 aa, Influenza virus
  MOD_RES (1)..(172): Any amino acid
  MOD_RES (186)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTYDFNEGAYVNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419105 - protein, 567 aa, Influenza virus
  MOD_RES (1)..(176): Any amino acid
  MOD_RES (186)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNEGTYVNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419106 - protein, 562 aa, Influenza virus
  MOD_RES (11)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(245): Any amino acid
  MOD_RES (269)..(302): Any amino acid
  MOD_RES (315)..(323): Any amino acid
  MOD_RES (334)..(339): Any amino acid
  MOD_RES (372)..(425): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid
RWKHVTNTILXXXXXXXXXXXXXXXGYQSTNSTETVDTXXXXXXXXXXXXXXXXXEHNGMLCATXXXXXXXXXXXXIEGLIYGNPSCDXXXXXXXWSYIVERPSAXXXXXXXXXXXXXXXXXXXXXXXXXXXXXXXXXXXXXXXXXXXXXXXXXXXFYRSMRWLTXXXXXXXXXXXXXXXXXXXXXXXXXXXXXXXXXXXXXXXXXXXXXXXXXXXXXXXXXXXXXXXXXXXXXXXXXXXXXXXXVLKPGQTLRIRSNGNLIAPWYGHXXXXXXXXXXXXXXXXXXXXXXXXXXXXXXXXXXLPFQNVSKYAFGXXXXXXXXXSLKLAVGLRNXXXXXXRGLFGAIAGFIEGGWSGLVAGWYGFQHSNDQGXXXXXXXXXXXXXXXXXXXXXXXXXXXXXXXXXXXXXXXXXXXXXXXXXXXXXXDQIQDIWAYNAELLVLLENQKTLDEHDXXXXXXXXXXXXXXXXXXXEDGKGCFELYHKCDXXCMETIRNGTYXXXXXXXXXXXXXXXXXXXXXXXEGTYKILTIYSTVASSLXXXXXXXXXXXXXXXXXXXXXXXXX

SEQ ID NO: 419107 - protein, 562 aa, Influenza virus
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(245): Any amino acid
  MOD_RES (269)..(302): Any amino acid
  MOD_RES (315)..(323): Any amino acid
  MOD_RES (334)..(339): Any amino acid
  MOD_RES (372)..(425): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXGHQSTNSTETVNTXXXXXXXXXXXXXXXXXEHNGILCATXXXXXXXXXXXXIEGLVYGNPSCDXXXXXXXWSYIVERSSAXXXXXXXXXXXXXXXXXXXXXXXXXXXXXXXXXXXXXXXXXXXXXXXXXXXFYRNMRWLTXXXXXXXXXXXXXXXXXXXXXXXXXXXXXXXXXXXXXXXXXXXXXXXXXXXXXXXXXXXXXXXXXXXXXXXXXXXXXXXXILKPGQTLRVRSNGNLIAPLYGHXXXXXXXXXXXXXXXXXXXXXXXXXXXXXXXXXXLPFHNVSKYAFGXXXXXXXXXSLKLAIGLRNXXXXXXRGIFGAIAGFIEGGWPGLVAGWYGFQHTNDQGXXXXXXXXXXXXXXXXXXXXXXXXXXXXXXXXXXXXXXXXXXXXXXXXXXXXXXDQIQDVWAYNAELLVLLGNQKTLDEHEXXXXXXXXXXXXXXXXXXXEDGNGCFELYHKCNXXCMATIRNGTYXXXXXXXXXXXXXXXXXXXXXXXEGIYKILTIYSTAASSLXXXXXXXXXXXXXXXXXXXXXXXXX

SEQ ID NO: 419108 - protein, 562 aa, Influenza virus
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(245): Any amino acid
  MOD_RES (269)..(302): Any amino acid
  MOD_RES (315)..(323): Any amino acid
  MOD_RES (334)..(349): Any amino acid
  MOD_RES (372)..(425): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXGYLSTNSTETVYTXXXXXXXXXXXXXXXXXEHNGLLCATXXXXXXXXXXXXVEGLIYGNPSCNXXXXXXXWSYIVERPTAXXXXXXXXXXXXXXXXXXXXXXXXXXXXXXXXXXXXXXXXXXXXXXXXXXXFYRGMRWLTXXXXXXXXXXXXXXXXXXXXXXXXXXXXXXXXXXXXXXXXXXXXXXXXXXXXXXXXXXXXXXXXXXXXXXXXXXXXXXXXVLRPGQTLRVRSDGNLIAPWYGYXXXXXXXXXXXXXXXXXXXXXXXXXXXXXXXXXXLPFHNISKYAFGXXXXXXXXXSLKLAVGMRNXXXXXXXXXXXXXXXXIEGGWSGLIAGWYGFQHSNAQGXXXXXXXXXXXXXXXXXXXXXXXXXXXXXXXXXXXXXXXXXXXXXXXXXXXXXXDQIQNIWAYNAELLVLIENQKTLDEHVXXXXXXXXXXXXXXXXXXXEDGKGCFDLYHKCDXXCMGTIRNGTYXXXXXXXXXXXXXXXXXXXXXXXEETYKILTIYSTVASSIXXXXXXXXXXXXXXXXXXXXXXXXX

SEQ ID NO: 419109 - protein, 562 aa, Influenza virus
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (105)..(156): Any amino acid
  MOD_RES (166)..(245): Any amino acid
  MOD_RES (269)..(302): Any amino acid
  MOD_RES (315)..(323): Any amino acid
  MOD_RES (334)..(360): Any amino acid
  MOD_RES (372)..(425): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXVHQSTNSTEAVDTXXXXXXXXXXXXXXXXXEHNGVLCATXXXXXXXXXXXXVEGLVYGNPACDXXXXXXXWSYIVERPLXXXXXXXXXXXXXXXXXXXXXXXXXXXXXXXXXXXXXXXXXXXXXXXXXXXXFYKSMRWLTXXXXXXXXXXXXXXXXXXXXXXXXXXXXXXXXXXXXXXXXXXXXXXXXXXXXXXXXXXXXXXXXXXXXXXXXXXXXXXXXLLKPGQTLRVKSNGNLIAPWFGHXXXXXXXXXXXXXXXXXXXXXXXXXXXXXXXXXXLPFQNISKYAFGXXXXXXXXXSLKLAVGLKNXXXXXXXXXXXXXXXXXXXXXXXXXXXWYGFQHSNEQGXXXXXXXXXXXXXXXXXXXXXXXXXXXXXXXXXXXXXXXXXXXXXXXXXXXXXXDQIQDLWAYNAELLVLLENQKILDEHDXXXXXXXXXXXXXXXXXXXENGNGCFELYHRCDXXCMEAIRNGTYXXXXXXXXXXXXXXXXXXXXXXXEGAYKILTIYSTVASSFXXXXXXXXXXXXXXXXXXXXXXXXX

SEQ ID NO: 419110 - protein, 562 aa, Influenza virus
  MOD_RES (1)..(25): Any amino acid
  MOD_RES (39)..(55): Any amino acid
  MOD_RES (65)..(79): Any amino acid
  MOD_RES (89)..(96): Any amino acid
  MOD_RES (106)..(156): Any amino acid
  MOD_RES (166)..(249): Any amino acid
  MOD_RES (269)..(302): Any amino acid
  MOD_RES (315)..(323): Any amino acid
  MOD_RES (334)..(425): Any amino acid
  MOD_RES (436)..(438): Any amino acid
  MOD_RES (453)..(472): Any amino acid
  MOD_RES (482)..(487): Any amino acid
  MOD_RES (498)..(520): Any amino acid
  MOD_RES (530)..(562): Any amino acid
XXXXXXXXXXXXXXXXXXXXXXXXXGHQSTNSTDTVDTXXXXXXXXXXXXXXXXXGHNGMLCATXXXXXXXXXXXXXXXLIYGNPFCDXXXXXXXXSYIIERPSAXXXXXXXXXXXXXXXXXXXXXXXXXXXXXXXXXXXXXXXXXXXXXXXXXXXFYRSVRWLTXXXXXXXXXXXXXXXXXXXXXXXXXXXXXXXXXXXXXXXXXXXXXXXXXXXXXXXXXXXXXXXXXXXXXXXXXXXXXXXXXXXXGQTLRIISNGNLVAPWYGHXXXXXXXXXXXXXXXXXXXXXXXXXXXXXXXXXXLPFQNVSRYAFGXXXXXXXXXSLKLAVGPRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRIQDIWAYNXXXLVLLENQKPLDEHDXXXXXXXXXXXXXXXXXXXXDGKGCSELYXXXXXXCMETTRNGTYXXXXXXXXXXXXXXXXXXXXXXXDGTYKILTIXXXXXXXXXXXXXXXXXXXXXXXXXXXXXXXXX

SEQ ID NO: 419111 - protein, 562 aa, Influenza virus
  MOD_RES (1)..(26): Any amino acid
  MOD_RES (36)..(96): Any amino acid
  MOD_RES (106)..(250): Any amino acid
  MOD_RES (268)..(474): Any amino acid
  MOD_RES (484)..(523): Any amino acid
  MOD_RES (537)..(562): Any amino acid
XXXXXXXXXXXXXXXXXXXXXXXXXXYQSTNSTEAXXXXXXXXXXXXXXXXXXXXXXXXXXXXXXXXXXXXXXXXXXXXXXXXXXXXXXXXXXXXXSYIVERQSAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQTLRIRSNENLIAPWYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGCFELYHRXXXXXXXXXXXXXXXXXXXXXXXXXXXXXXXXXXXXXXXXYKILSIYSTVASSXXXXXXXXXXXXXXXXXXXXXXXXXX

SEQ ID NO: 419112 - protein, 562 aa, Influenza virus
  MOD_RES (1)..(26): Any amino acid
  MOD_RES (36)..(254): Any amino acid
  MOD_RES (265)..(562): Any amino acid
XXXXXXXXXXXXXXXXXXXXXXXXXXYQSTNSTEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRSNGNLVAPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419113 - protein, 562 aa, Influenza virus
  MOD_RES (11)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(244): Any amino acid
  MOD_RES (269)..(302): Any amino acid
  MOD_RES (320)..(323): Any amino acid
  MOD_RES (334)..(339): Any amino acid
  MOD_RES (372)..(424): Any amino acid
  MOD_RES (457)..(471): Any amino acid
  MOD_RES (486)..(487): Any amino acid
  MOD_RES (498)..(520): Any amino acid
  MOD_RES (538)..(562): Any amino acid
RWKHVTNTILXXXXXXXXXXXXXXXGYQSTNSTETVDTXXXXXXXXXXXXXXXXXEHNGMLCATXXXXXXXXXXXXIEGLIYGNPSCDXXXXXXXWSYIVERPSAXXXXXXXXXXXXXXXXXXXXXXXXXXXXXXXXXXXXXXXXXXXXXXXXXXXFYRSMRWLTXXXXXXXXXXXXXXXXXXXXXXXXXXXXXXXXXXXXXXXXXXXXXXXXXXXXXXXXXXXXXXXXXXXXXXXXXXXXXXXSVLKPGQTLRIRSNGNLIAPWYGHXXXXXXXXXXXXXXXXXXXXXXXXXXXXXXXXXXLPFQNVSKYAFGNCSKYXXXXSLKLAVGLRNXXXXXXRGLFGAIAGFIEGGWSGLVAGWYGFQHSNDQGXXXXXXXXXXXXXXXXXXXXXXXXXXXXXXXXXXXXXXXXXXXXXXXXXXXXXDDQIQDIWAYNAELLVLLENQKTLDEHDANVNXXXXXXXXXXXXXXXEDGKGCFELYHKCDXXCMETIRNGTYXXXXXXXXXXXXXXXXXXXXXXXEGTYKILTIYSTVASSLXXXXXXXXXXXXXXXXXXXXXXXXX

SEQ ID NO: 419114 - protein, 562 aa, Influenza virus
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(244): Any amino acid
  MOD_RES (269)..(302): Any amino acid
  MOD_RES (320)..(323): Any amino acid
  MOD_RES (334)..(346): Any amino acid
  MOD_RES (372)..(424): Any amino acid
  MOD_RES (457)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXGHQSTNSTETVNTXXXXXXXXXXXXXXXXXEHNGILCATXXXXXXXXXXXXIEGLVYGNPSCDXXXXXXXWSYIVERSSAXXXXXXXXXXXXXXXXXXXXXXXXXXXXXXXXXXXXXXXXXXXXXXXXXXXFYRNMRWLTXXXXXXXXXXXXXXXXXXXXXXXXXXXXXXXXXXXXXXXXXXXXXXXXXXXXXXXXXXXXXXXXXXXXXXXXXXXXXXXAVLKPGQTLRVRSNGNLIAPLYGHXXXXXXXXXXXXXXXXXXXXXXXXXXXXXXXXXXLPFHNVSKYAFGNCPKYXXXXSLKLAIGLRNXXXXXXXXXXXXXAGFIEGGWPGLVAGWYGFQHTNDQGXXXXXXXXXXXXXXXXXXXXXXXXXXXXXXXXXXXXXXXXXXXXXXXXXXXXXDDQIQDVWAYNAELLVLLGNQKTLDEHVANVNXXXXXXXXXXXXXXXEDGNGCFELYHKCNXXCMATIRNGTYXXXXXXXXXXXXXXXXXXXXXXXEGIYKILTIYSTAASSLXXXXXXXXXXXXXXXXXXXXXXXXX

SEQ ID NO: 419115 - protein, 562 aa, Influenza virus
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (106)..(156): Any amino acid
  MOD_RES (166)..(244): Any amino acid
  MOD_RES (269)..(302): Any amino acid
  MOD_RES (320)..(323): Any amino acid
  MOD_RES (334)..(349): Any amino acid
  MOD_RES (372)..(424): Any amino acid
  MOD_RES (455)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXGYLSTNSTETVYTXXXXXXXXXXXXXXXXXEHNGLLCATXXXXXXXXXXXXVEGLIYGNPSCNXXXXXXXWSYIVERPTAXXXXXXXXXXXXXXXXXXXXXXXXXXXXXXXXXXXXXXXXXXXXXXXXXXXFYRGMRWLTXXXXXXXXXXXXXXXXXXXXXXXXXXXXXXXXXXXXXXXXXXXXXXXXXXXXXXXXXXXXXXXXXXXXXXXXXXXXXXXSILKPGQTLRVKSNGNLIAPWFGHXXXXXXXXXXXXXXXXXXXXXXXXXXXXXXXXXXLPFHNISKYAFGTCPKYXXXXSLKLAVGMRNXXXXXXXXXXXXXXXXIEGGWSGLIAGWYGFQHSNAQGXXXXXXXXXXXXXXXXXXXXXXXXXXXXXXXXXXXXXXXXXXXXXXXXXXXXXDDQIQNIWAYNAELLVLIENQKTLDEHEANXXXXXXXXXXXXXXXXXEDGKGCFDLYHKCDXXCMGTIRNGTYXXXXXXXXXXXXXXXXXXXXXXXEETYKILTIYSTVASSIXXXXXXXXXXXXXXXXXXXXXXXXX

SEQ ID NO: 419116 - protein, 562 aa, Influenza virus
  MOD_RES (1)..(25): Any amino acid
  MOD_RES (39)..(55): Any amino acid
  MOD_RES (65)..(76): Any amino acid
  MOD_RES (89)..(95): Any amino acid
  MOD_RES (105)..(156): Any amino acid
  MOD_RES (166)..(244): Any amino acid
  MOD_RES (269)..(302): Any amino acid
  MOD_RES (320)..(323): Any amino acid
  MOD_RES (334)..(360): Any amino acid
  MOD_RES (372)..(424): Any amino acid
  MOD_RES (457)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXVHQSTNSTEAVDTXXXXXXXXXXXXXXXXXEHNGVLCATXXXXXXXXXXXXVEGLVYGNPACDXXXXXXXWSYIVERPLXXXXXXXXXXXXXXXXXXXXXXXXXXXXXXXXXXXXXXXXXXXXXXXXXXXXFYKSMRWLTXXXXXXXXXXXXXXXXXXXXXXXXXXXXXXXXXXXXXXXXXXXXXXXXXXXXXXXXXXXXXXXXXXXXXXXXXXXXXXXPVLKPGQTLRVRSDGNLIAPWYGYXXXXXXXXXXXXXXXXXXXXXXXXXXXXXXXXXXLPFQNISKYAFGICPKYXXXXSLKLAVGLKNXXXXXXXXXXXXXXXXXXXXXXXXXXXWYGFQHSNEQGXXXXXXXXXXXXXXXXXXXXXXXXXXXXXXXXXXXXXXXXXXXXXXXXXXXXXDDQIQDLWAYNAELLVLLENQKPLDEHDANVHXXXXXXXXXXXXXXXENGNGCFELYHRCDXXCMEAIRNGTYXXXXXXXXXXXXXXXXXXXXXXXEGAYKILTIYSTVASSFXXXXXXXXXXXXXXXXXXXXXXXXX

SEQ ID NO: 419117 - protein, 562 aa, Influenza virus
  MOD_RES (1)..(25): Any amino acid
  MOD_RES (35)..(55): Any amino acid
  MOD_RES (65)..(79): Any amino acid
  MOD_RES (89)..(96): Any amino acid
  MOD_RES (106)..(156): Any amino acid
  MOD_RES (166)..(244): Any amino acid
  MOD_RES (269)..(302): Any amino acid
  MOD_RES (320)..(323): Any amino acid
  MOD_RES (334)..(424): Any amino acid
  MOD_RES (434)..(444): Any amino acid
  MOD_RES (457)..(472): Any amino acid
  MOD_RES (482)..(487): Any amino acid
  MOD_RES (498)..(523): Any amino acid
  MOD_RES (537)..(562): Any amino acid
XXXXXXXXXXXXXXXXXXXXXXXXXGHQSTNSTDXXXXXXXXXXXXXXXXXXXXXGHNGMLCATXXXXXXXXXXXXXXXLIYGNPFCDXXXXXXXXSYIVERSSPXXXXXXXXXXXXXXXXXXXXXXXXXXXXXXXXXXXXXXXXXXXXXXXXXXXFYRSVRWLTXXXXXXXXXXXXXXXXXXXXXXXXXXXXXXXXXXXXXXXXXXXXXXXXXXXXXXXXXXXXXXXXXXXXXXXXXXXXXXXSVLRPGQTLRVRSNGNLVAPWYGHXXXXXXXXXXXXXXXXXXXXXXXXXXXXXXXXXXLPFQNVSRYAFGNCPMYXXXXSLKLAVGPRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEDQIQDIWAXXXXXXXXXXXQKTLDEHDSNVNXXXXXXXXXXXXXXXXDGKGCFETYXXXXXXCMETTRNGTYXXXXXXXXXXXXXXXXXXXXXXXXXXYKILSIYSTVASSXXXXXXXXXXXXXXXXXXXXXXXXXX

SEQ ID NO: 419118 - protein, 562 aa, Influenza virus
  MOD_RES (1)..(26): Any amino acid
  MOD_RES (36)..(96): Any amino acid
  MOD_RES (106)..(245): Any amino acid
  MOD_RES (268)..(444): Any amino acid
  MOD_RES (455)..(474): Any amino acid
  MOD_RES (484)..(562): Any amino acid
XXXXXXXXXXXXXXXXXXXXXXXXXXYQSTNSTEAXXXXXXXXXXXXXXXXXXXXXXXXXXXXXXXXXXXXXXXXXXXXXXXXXXXXXXXXXXXXXSYIIERPSAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLKPGQTLRIISNENLIAPWYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQKTLDEHDTNXXXXXXXXXXXXXXXXXXXXKGCFELYHRXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419119 - protein, 562 aa, Influenza virus
  MOD_RES (1)..(26): Any amino acid
  MOD_RES (36)..(250): Any amino acid
  MOD_RES (265)..(447): Any amino acid
  MOD_RES (457)..(562): Any amino acid
XXXXXXXXXXXXXXXXXXXXXXXXXXYQSTNSTEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQTLRIRSNENLIAPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDEHDANANXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419120 - protein, 562 aa, Influenza virus
  MOD_RES (1)..(29): Any amino acid
  MOD_RES (39)..(254): Any amino acid
  MOD_RES (264)..(562): Any amino acid
XXXXXXXXXXXXXXXXXXXXXXXXXXXXXTNSTETVGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRSNGNLVAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419121 - protein, 473 aa, Influenza virus
  MOD_RES (1)..(8): Any amino acid
  MOD_RES (18)..(51): Any amino acid
  MOD_RES (63)..(90): Any amino acid
  MOD_RES (104)..(110): Any amino acid
  MOD_RES (129)..(131): Any amino acid
  MOD_RES (145)..(157): Any amino acid
  MOD_RES (174)..(174): Any amino acid
  MOD_RES (196)..(224): Any amino acid
  MOD_RES (248)..(273): Any amino acid
  MOD_RES (289)..(292): Any amino acid
  MOD_RES (307)..(319): Any amino acid
  MOD_RES (333)..(350): Any amino acid
  MOD_RES (360)..(420): Any amino acid
  MOD_RES (436)..(449): Any amino acid
  MOD_RES (469)..(473): Any amino acid
XXXXXXXXIAIGSVSRTXXXXXXXXXXXXXXXXXXXXXXXXXXXXXXXXXXVPLVPCEPIIIXXXXXXXXXXXXXXXXXXXXXXXXXXXXWSKPQCQITGFAPXXXXXXXRLSAGGDIWVTREPYVSCXXXKCYQFALGQGTTLXXXXXXXXXXXXXPHRTLLMNELGVPFHLXTKQVCIAWSSSSCHDGKAWLHXXXXXXXXXXXXXXXXXXXXXXXXXXXXXNILRTQESECVCINGTCTVVMTDXXXXXXXXXXXXXXXXXXXXXXXXXXGSAQHVEECSCYPRYXXXXCVCRDNWKGSNRPVXXXXXXXXXXXXXYVCSGLVGDTPRNXXXXXXXXXXXXXXXXXXPGVKGWAFDXXXXXXXXXXXXXXXXXXXXXXXXXXXXXXXXXXXXXXXXXXXXXXXXXXXXXXXXXXXXXCINRCFYVELIRGRPXXXXXXXXXXXXXXFCGTSGTYGTGSWPDGANIXXXXX

SEQ ID NO: 419122 - protein, 473 aa, Influenza virus
  MOD_RES (1)..(90): Any amino acid
  MOD_RES (104)..(110): Any amino acid
  MOD_RES (129)..(131): Any amino acid
  MOD_RES (145)..(157): Any amino acid
  MOD_RES (174)..(174): Any amino acid
  MOD_RES (196)..(224): Any amino acid
  MOD_RES (248)..(273): Any amino acid
  MOD_RES (289)..(292): Any amino acid
  MOD_RES (307)..(319): Any amino acid
  MOD_RES (333)..(350): Any amino acid
  MOD_RES (360)..(420): Any amino acid
  MOD_RES (436)..(449): Any amino acid
  MOD_RES (469)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWLKPQCQITGSAPXXXXXXXRLSASGDIWLTREPYVSCXXXNCYQFALGQGATLXXXXXXXXXXXXXPYRTLLMSELGVPFHLXTKQVCMAWSSSSCHDGRAWLHXXXXXXXXXXXXXXXXXXXXXXXXXXXXXSILRTQESECICINGTCAVVMTDXXXXXXXXXXXXXXXXXXXXXXXXXXGSAQHIEECSCYPRHXXXXCVCRDNWRGSNRPVXXXXXXXXXXXXXYLCSGLVGDTPRSXXXXXXXXXXXXXXXXXXSGVKGWAFDXXXXXXXXXXXXXXXXXXXXXXXXXXXXXXXXXXXXXXXXXXXXXXXXXXXXXXXXXXXXXCVNRCFYVELVRGRPXXXXXXXXXXXXXXFCGTSGSYGTGSWPDGADIXXXXX

SEQ ID NO: 419123 - protein, 473 aa, Influenza virus
  MOD_RES (1)..(90): Any amino acid
  MOD_RES (104)..(110): Any amino acid
  MOD_RES (129)..(131): Any amino acid
  MOD_RES (141)..(157): Any amino acid
  MOD_RES (173)..(174): Any amino acid
  MOD_RES (194)..(224): Any amino acid
  MOD_RES (246)..(273): Any amino acid
  MOD_RES (289)..(292): Any amino acid
  MOD_RES (307)..(319): Any amino acid
  MOD_RES (329)..(350): Any amino acid
  MOD_RES (360)..(425): Any amino acid
  MOD_RES (436)..(449): Any amino acid
  MOD_RES (469)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSKPQCLITGFAPXXXXXXXRLSAGGSIWITREPYVSCXXXRCYQFALGQXXXXXXXXXXXXXXXXXPHRTLLMSELGVPFNXXTRQVCIAWSSASCHDGRAWXXXXXXXXXXXXXXXXXXXXXXXXXXXXXXXTILRTQESECVCISGTCAVVMXXXXXXXXXXXXXXXXXXXXXXXXXXXXGNAQHVEECSCYPQYXXXXCVYRDNWKGSNRPIXXXXXXXXXXXXXYFLDVFAGDXXXXXXXXXXXXXXXXXXXXXXPGVKGWGFDXXXXXXXXXXXXXXXXXXXXXXXXXXXXXXXXXXXXXXXXXXXXXXXXXXXXXXXXXXXXXXXXXXFYVELIRGKPXXXXXXXXXXXXXXFCGTTGTYGAGSWPDGANVXXXXX

SEQ ID NO: 419124 - protein, 473 aa, Influenza virus
  MOD_RES (1)..(90): Any amino acid
  MOD_RES (104)..(110): Any amino acid
  MOD_RES (129)..(131): Any amino acid
  MOD_RES (145)..(157): Any amino acid
  MOD_RES (167)..(174): Any amino acid
  MOD_RES (196)..(224): Any amino acid
  MOD_RES (246)..(273): Any amino acid
  MOD_RES (289)..(292): Any amino acid
  MOD_RES (307)..(323): Any amino acid
  MOD_RES (333)..(449): Any amino acid
  MOD_RES (469)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSKPQCQIAGFAPXXXXXXXRLSAGGGIWVNREPYVSCXXXKCYQFALGHGTTLXXXXXXXXXXXXXSYRTLLMSEXXXXXXXXTQQVCIAWSSSSCYDGKAWLHXXXXXXXXXXXXXXXXXXXXXXXXXXXXXNILITQESECVCIDGTCTVVMXXXXXXXXXXXXXXXXXXXXXXXXXXXXGGAQHVEECSCYPSYXXXXCVCWDNWRGSNRPIXXXXXXXXXXXXXXXXXGLVGDTPRDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFCGTPGTYGTGSWADGANIXXXXX

SEQ ID NO: 419125 - protein, 473 aa, Influenza virus
  MOD_RES (1)..(90): Any amino acid
  MOD_RES (100)..(110): Any amino acid
  MOD_RES (129)..(131): Any amino acid
  MOD_RES (143)..(162): Any amino acid
  MOD_RES (174)..(174): Any amino acid
  MOD_RES (184)..(185): Any amino acid
  MOD_RES (196)..(224): Any amino acid
  MOD_RES (234)..(236): Any amino acid
  MOD_RES (248)..(273): Any amino acid
  MOD_RES (289)..(293): Any amino acid
  MOD_RES (303)..(323): Any amino acid
  MOD_RES (333)..(449): Any amino acid
  MOD_RES (469)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSKPQCHITXXXXXXXXXXXRLAAAGDIWVAREPYVSCXXXKCNQFALGQGTXXXXXXXXXXXXXXXXXXXXLMNELGVPLHLXTKQLCIAWSXXSCHDGKEWLHXXXXXXXXXXXXXXXXXXXXXXXXXXXXXNILKTQESEXXXINGICTVVMTDXXXXXXXXXXXXXXXXXXXXXXXXXXGSAKHVEECSCYPQHXXXXXDCRDNWKGSXXXXXXXXXXXXXXXXXXXXXGLVGDTPRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFCGTSGTCGTGSWPDGANFXXXXX

SEQ ID NO: 419126 - protein, 473 aa, Influenza virus
  MOD_RES (1)..(93): Any amino acid
  MOD_RES (104)..(163): Any amino acid
  MOD_RES (174)..(175): Any amino acid
  MOD_RES (185)..(227): Any amino acid
  MOD_RES (237)..(238): Any amino acid
  MOD_RES (248)..(278): Any amino acid
  MOD_RES (288)..(454): Any amino acid
  MOD_RES (465)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPQCQITGFVPXXXXXXXXXXXXXXXXXXXXXXXXXXXXXXXXXXXXXXXXXXXXXXXXXXXXXXXXXXXXMNELGVPFNLXXKQVCIAYSSXXXXXXXXXXXXXXXXXXXXXXXXXXXXXXXXXXXXXXXXXXXRTQESGCVCXXGTCTAVMTDXXXXXXXXXXXXXXXXXXXXXXXXXXXXXXXIEECSCYPQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTHGTGSWPDXXXXXXXXX

SEQ ID NO: 419127 - protein, 473 aa, Influenza virus
  MOD_RES (1)..(164): Any amino acid
  MOD_RES (174)..(227): Any amino acid
  MOD_RES (237)..(238): Any amino acid
  MOD_RES (248)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNEIGVPFHLXXXXXXXXXXXXXXXXXXXXXXXXXXXXXXXXXXXXXXXXXXXXXXXXXXXXXXRTHESECVCXXGTCTVVLTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419128 - protein, 473 aa, Influenza virus
  MOD_RES (1)..(228): Any amino acid
  MOD_RES (238)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTQESDCVCIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419129 - protein, 473 aa, Influenza virus
  MOD_RES (1)..(228): Any amino acid
  MOD_RES (238)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTQEYECVCIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419130 - protein, 473 aa, Influenza virus
  MOD_RES (1)..(230): Any amino acid
  MOD_RES (240)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSECVCINGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419131 - protein, 275 aa, Influenza virus
  MOD_RES (143)..(145): Any amino acid
  MOD_RES (210)..(211): Any amino acid
  MOD_RES (227)..(234): Any amino acid
MLKMSLLTEVETYVLSIVPSGPLKAEIAQRLEDVFAGKNTDLEALMEWLKTRPILSPLTKGILGFVFTLTVPSERGLQRRRFVQNALNGNGDPNNMDRAVKLYRKLKREITFHGAKEVALSYSTGALASCMGLIYNRMGTVTXXXAFGLVCATCEQIADSQHRSHRQMVTTTNPLIRHENRMVLASTTAKAMEQMAGSSEQAAEAMEVAXXARQMVQAMRTIGTHPXXXXXXXXDLLENLQAYQKRMGVQMQRFKRPDSSWLFGGWNLALDIVDS

SEQ ID NO: 419132 - protein, 275 aa, Influenza virus
  MOD_RES (1)..(9): Any amino acid
  MOD_RES (71)..(74): Any amino acid
  MOD_RES (128)..(131): Any amino acid
  MOD_RES (143)..(145): Any amino acid
  MOD_RES (186)..(186): Any amino acid
  MOD_RES (210)..(211): Any amino acid
  MOD_RES (227)..(234): Any amino acid
  MOD_RES (256)..(256): Any amino acid
  MOD_RES (274)..(275): Any amino acid
XXXXXXXXXVETYVLSIIPSGPLKAEIAQKLEDVFAGKNADLEALMEWIKTRPILSPLTKGMLGFVFTLTXXXXRGLQRRRFIQNALNGNGDPNNMDKAVKLYRKLKREMTFHGAKEVSLSYSTGALXXXXGLIYNRMGAVTXXXAFGLICATCEQIADAQHRSHRQMAATTNPLIKHENRMVLAXTTAKAMEQVAGSSEQAAEAIEVAXXTRQMVHAMRTIGTQPXXXXXXXXDLLENLQTYQKRMGVQLQRFKXSSRHCSKYHWNLALDIVXX

SEQ ID NO: 419133 - protein, 275 aa, Influenza virus
  MOD_RES (1)..(9): Any amino acid
  MOD_RES (24)..(24): Any amino acid
  MOD_RES (49)..(57): Any amino acid
  MOD_RES (68)..(79): Any amino acid
  MOD_RES (143)..(145): Any amino acid
  MOD_RES (193)..(194): Any amino acid
  MOD_RES (209)..(211): Any amino acid
  MOD_RES (227)..(234): Any amino acid
  MOD_RES (256)..(275): Any amino acid
XXXXXXXXXVETYVLSVIPSGPLXAEIAQRLESVFAGKNSDLEALMEWXXXXXXXXXLTKGVLGFVFXXXXXXXXXXXXRRFVQNALSGNGDPNNMARAVKLYKKLKREITFYGAKEIALSYSAGALASCMGLIYNRMGTITXXXALGLVCATCEQIADSHHRSHRQMATITNPLIRHENRMVIASTTAKAMXXIAGSSEQAAEAMDIXXXARRMVQAMRAIGTHPXXXXXXXXNLLENLQAYQKRMGLQMQRFKXXXXXXXXXXXXXXXXXXXX

SEQ ID NO: 419134 - protein, 275 aa, Influenza virus
  MOD_RES (1)..(24): Any amino acid
  MOD_RES (48)..(90): Any amino acid
  MOD_RES (130)..(133): Any amino acid
  MOD_RES (143)..(154): Any amino acid
  MOD_RES (179)..(199): Any amino acid
  MOD_RES (210)..(211): Any amino acid
  MOD_RES (227)..(234): Any amino acid
  MOD_RES (256)..(275): Any amino acid
XXXXXXXXXXXXXXXXXXXXXXXXAEIAQRLEGVFAGKNTDLEVLMEXXXXXXXXXXXXXXXXXXXXXXXXXXXXXXXXXXXXXXXXXXXGDPSNMDRAVKLYKKLKREMTFHGAKEIALGYSTGALASXXXXIYNRMGTVAXXXXXXXXXXXXEQIADSQHKSHRQMVATTNPLIRHXXXXXXXXXXXXXXXXXXXXXEQAAEAMEIAXXARQMVHAMRTVGTHPXXXXXXXXDLIENLQAYQKRMGVQIQRFKXXXXXXXXXXXXXXXXXXXX

SEQ ID NO: 419135 - protein, 275 aa, Influenza virus
  MOD_RES (1)..(24): Any amino acid
  MOD_RES (40)..(95): Any amino acid
  MOD_RES (107)..(109): Any amino acid
  MOD_RES (123)..(211): Any amino acid
  MOD_RES (227)..(234): Any amino acid
  MOD_RES (256)..(275): Any amino acid
XXXXXXXXXXXXXXXXXXXXXXXXAEIAQRLENVFAGKNXXXXXXXXXXXXXXXXXXXXXXXXXXXXXXXXXXXXXXXXXXXXXXXXXXXXXXXXMDKAVKLYKKLXXXITFHGAKEISLSYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRQMVQAMRAVGTHPXXXXXXXXDLLDNLQAYQKRMGVQMHRFKXXXXXXXXXXXXXXXXXXXX

SEQ ID NO: 419136 - protein, 275 aa, Influenza virus
  MOD_RES (1)..(30): Any amino acid
  MOD_RES (40)..(109): Any amino acid
  MOD_RES (127)..(214): Any amino acid
  MOD_RES (225)..(247): Any amino acid
  MOD_RES (264)..(275): Any amino acid
XXXXXXXXXXXXXXXXXXXXXXXXXXXXXXLEDVFSGKNXXXXXXXXXXXXXXXXXXXXXXXXXXXXXXXXXXXXXXXXXXXXXXXXXXXXXXXXXXXXXXXXXXXXXXVTFHGAKEVALGYSTGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXMVQAMRTVGTXXXXXXXXXXXXXXXXXXXXXXXGVQMQRFRRPDSSWLFXXXXXXXXXXXX

SEQ ID NO: 419137 - protein, 275 aa, Influenza virus
  MOD_RES (1)..(109): Any amino acid
  MOD_RES (127)..(275): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITFHRAKEVALSYSAGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419138 - protein, 99 aa, Influenza virus
  MOD_RES (11)..(34): Any amino acid
  MOD_RES (44)..(67): Any amino acid
  MOD_RES (81)..(90): Any amino acid
MSLLTEVETPXXXXXXXXXXXXXXXXXXXXXXXXGILHLILWIXXXXXXXXXXXXXXXXXXXXXXXXGVPESMREEYRQEXXXXXXXXXXHFVSIELEG

SEQ ID NO: 419139 - protein, 99 aa, Influenza virus
  MOD_RES (1)..(1): Any amino acid
  MOD_RES (11)..(34): Any amino acid
  MOD_RES (44)..(67): Any amino acid
  MOD_RES (81)..(90): Any amino acid
XSLLTEVETLXXXXXXXXXXXXXXXXXXXXXXXXGIVHLILWIXXXXXXXXXXXXXXXXXXXXXXXXGVPKSMREEYRKEXXXXXXXXXXHFVNIELED

SEQ ID NO: 419140 - protein, 99 aa, Influenza virus
  MOD_RES (1)..(1): Any amino acid
  MOD_RES (11)..(34): Any amino acid
  MOD_RES (44)..(67): Any amino acid
  MOD_RES (81)..(99): Any amino acid
XSLLTEVETHXXXXXXXXXXXXXXXXXXXXXXXXGVLHLILWIXXXXXXXXXXXXXXXXXXXXXXXXGIPESMREEYQQEXXXXXXXXXXXXXXXXXXX

SEQ ID NO: 419141 - protein, 99 aa, Influenza virus
  MOD_RES (1)..(1): Any amino acid
  MOD_RES (11)..(34): Any amino acid
  MOD_RES (44)..(67): Any amino acid
  MOD_RES (81)..(99): Any amino acid
XSQLTEVETPXXXXXXXXXXXXXXXXXXXXXXXXGILHLVLWIXXXXXXXXXXXXXXXXXXXXXXXXGMPESMREEYREEXXXXXXXXXXXXXXXXXXX

SEQ ID NO: 419142 - protein, 99 aa, Influenza virus
  MOD_RES (1)..(9): Any amino acid
  MOD_RES (19)..(71): Any amino acid
  MOD_RES (81)..(99): Any amino acid
XXXXXXXXXRPTRNGWGCXXXXXXXXXXXXXXXXXXXXXXXXXXXXXXXXXXXXXXXXXXXXXXXXXXXXXSMREEYRQKXXXXXXXXXXXXXXXXXXX

SEQ ID NO: 419143 - protein, 527 aa, Influenza virus
  MOD_RES (34)..(37): Any amino acid
  MOD_RES (116)..(130): Any amino acid
  MOD_RES (146)..(146): Any amino acid
  MOD_RES (305)..(305): Any amino acid
  MOD_RES (328)..(335): Any amino acid
  MOD_RES (367)..(375): Any amino acid
  MOD_RES (393)..(399): Any amino acid
  MOD_RES (421)..(422): Any amino acid
  MOD_RES (445)..(452): Any amino acid
  MOD_RES (478)..(480): Any amino acid
  MOD_RES (495)..(497): Any amino acid
SKSRVDNHSMSDIEAMASQGTKRSYEQMETGGEXXXXATEIRASVGRMVGGIGRFYIQMCTELKLSDYEGRLIQNSITIERMVLSAFDERRNKYLEEHPSAGKDPKKTGGPIYRRXXXXXXXXXXXXXXXEIRRIWRQANNGEDAXAGLTHIMIWHSNLNDATYQRTRALVRTGMDPRMCSLMQGSTLPRRSGAAGAAVKGVGTMVMELIRMIKRGINDRNFWRGENGRRTRIAYERMCNILKGKFQTAAAQRAMMDQVRESRNPGNAEIEDLIFLARSALILRGSGSVAHKSCLPACVYGLAVXSGYDFEREGYSLVGIDPFKLLQXXXXXXXXSLIRPNENPAHKSQLVWMACHSAAFEDLRVSXXXXXXXXXPRGKLSTRGVQIASNENXXXXXXXTLELRSRYWAIRTRSGGNTNQXXASAGQISVQPTFSVQRNLPFERXXXXXXXXGNTEGRTSDMRTEIIRIIIRMMENAXXXDVSFQGRGVFELSDXXXATNPIVPSFDMSNEGSYFFGDNAEEYRRLR

SEQ ID NO: 419144 - protein, 527 aa, Influenza virus
  MOD_RES (1)..(9): Any amino acid
  MOD_RES (34)..(37): Any amino acid
  MOD_RES (116)..(130): Any amino acid
  MOD_RES (146)..(146): Any amino acid
  MOD_RES (182)..(190): Any amino acid
  MOD_RES (242)..(242): Any amino acid
  MOD_RES (265)..(265): Any amino acid
  MOD_RES (305)..(305): Any amino acid
  MOD_RES (328)..(335): Any amino acid
  MOD_RES (367)..(375): Any amino acid
  MOD_RES (393)..(399): Any amino acid
  MOD_RES (421)..(422): Any amino acid
  MOD_RES (445)..(452): Any amino acid
  MOD_RES (469)..(480): Any amino acid
  MOD_RES (495)..(497): Any amino acid
  MOD_RES (524)..(527): Any amino acid
XXXXXXXXXMSDINIMASQGTKRPYEQMETDGDXXXXATEIRSSVGKMIDGIGRFYIQMCTELQLSDYDGRLIQNSITIEKMVLSAFDERRNRYLEEHPSAGRDPKKTGGPIYKRXXXXXXXXXXXXXXXEIRRVWRQANNGEEAXAGLTHLMIWHSNLNDTTYQRTRALVRSGMDPRMCSXXXXXXXXXRSGAAGAAIKGVGTMAMELIRMIKRGVNDRNFWRGDNGRRTRVAYERMCNIXSKGSSKQQHQRAMVDQVRESRNXGNAEIEDLTFLARSALILRGAGSIAHKSCLPACAYGPAVXSGHDFEREGYSLVGVDPFKLLQXXXXXXXXSLMRPNENPVHKSQLIWMACHSAAFEDLRLLXXXXXXXXXPRGQLSTRGVQVASNENXXXXXXXTLELRSGYWAIRTRSGGNTSQXXASAGQTSVQPAFSVQRNLPFDKXXXXXXXXGNNEGRTSDMRAEIIRXXXXXXXXXXXXDLSFQGRGVFEFSDXXXAANPIVPSFDMNNEGSYFFGDNAKEYXXXX

SEQ ID NO: 419145 - protein, 527 aa, Influenza virus
  MOD_RES (1)..(9): Any amino acid
  MOD_RES (34)..(37): Any amino acid
  MOD_RES (83)..(91): Any amino acid
  MOD_RES (116)..(130): Any amino acid
  MOD_RES (146)..(146): Any amino acid
  MOD_RES (161)..(193): Any amino acid
  MOD_RES (242)..(243): Any amino acid
  MOD_RES (305)..(305): Any amino acid
  MOD_RES (328)..(335): Any amino acid
  MOD_RES (367)..(375): Any amino acid
  MOD_RES (390)..(399): Any amino acid
  MOD_RES (421)..(422): Any amino acid
  MOD_RES (445)..(452): Any amino acid
  MOD_RES (469)..(480): Any amino acid
  MOD_RES (494)..(497): Any amino acid
  MOD_RES (523)..(527): Any amino acid
XXXXXXXXXMSDIEAMATQGTKRSHEQMETGGEXXXXTTEIRASVGKMISGIGRFYIQMCTELKLNDHEGRLIQNSLTIEKMXXXXXXXXXNKYLEEHPNAGKDPKKTGGPIYKKXXXXXXXXXXXXXXXEIMRIWRQANNGDDAXAGLTHMMIWHSNLNXXXXXXXXXXXXXXXXXXXXXXXXXXXXXXXXXAAGAAVKGIGTMVMELIRMVKRGINDRNFWRGENGRKTRSAYERMCNIXXKGKFQTAAQRAMMDQVREGRNPGNAEIEDLIFSARSALILRLRGSVAHKSCLPACIYGLVVXSGYDFEKEGYSLVGIDPFRLLQXXXXXXXXSLIRPKENPAHKSQLIWMACNSAAFEDLRISXXXXXXXXXPRGQLATRGVQIASXXXXXXXXXXTLELRSKYWAIRTRSGGNNNQXXASAGQISTQPTFSVQRSLPFERXXXXXXXXGNAEGRTSDMRTEVIRXXXXXXXXXXXXEVSFRGRGVFELSXXXXATSPIVPSFDMSKEGSYFFGDSAEEXXXXX

SEQ ID NO: 419146 - protein, 527 aa, Influenza virus
  MOD_RES (1)..(9): Any amino acid
  MOD_RES (37)..(37): Any amino acid
  MOD_RES (83)..(91): Any amino acid
  MOD_RES (107)..(130): Any amino acid
  MOD_RES (146)..(146): Any amino acid
  MOD_RES (156)..(196): Any amino acid
  MOD_RES (216)..(230): Any amino acid
  MOD_RES (242)..(244): Any amino acid
  MOD_RES (305)..(305): Any amino acid
  MOD_RES (328)..(335): Any amino acid
  MOD_RES (367)..(375): Any amino acid
  MOD_RES (393)..(409): Any amino acid
  MOD_RES (420)..(422): Any amino acid
  MOD_RES (445)..(452): Any amino acid
  MOD_RES (469)..(480): Any amino acid
  MOD_RES (524)..(527): Any amino acid
XXXXXXXXXMSDIGAMASQGTKRSHEEQMETGGERQXANEIRASVGRMIGGIGRFYVQMCTELKLSEQEGRLIQNSMTIERMXXXXXXXXXNRYLEENPSAGKDPKXXXXXXXXXXXXXXXXXXXXXXXXEVRRIWRQANNGEDSXSGLTHIMIWXXXXXXXXXXXXXXXXXXXXXXXXXXXXXXXXXXXXXXXXXAAVKGVGTIVLELIRMIKRXXXXXXXXXXXXXXXTRTAYERMCNIXXXGKFQTAAQKAMMDQVRESRSPGNAEIEDLIFMARSALILRLRGSIAHKSCLPACVYGPAVXSGYNFEKEGYSLVGVDPFRLLQXXXXXXXXSLIRSNENPAHKSQLVWMACNSAAFEDLRVLXXXXXXXXXPRGRLSTRGIQIASNENXXXXXXXXXXXXXXXXXIRTKSGGNTNXXXASAGQISIQPTFSVQRNLPFEKXXXXXXXXGNSEGRTSDMRAEIIKXXXXXXXXXXXXEVSFQGRGVVFELSDEKATNPVVPSFDMSNDGSYFFGDNAEEFXXXX

SEQ ID NO: 419147 - protein, 527 aa, Influenza virus
  MOD_RES (1)..(11): Any amino acid
  MOD_RES (22)..(22): Any amino acid
  MOD_RES (34)..(37): Any amino acid
  MOD_RES (63)..(67): Any amino acid
  MOD_RES (83)..(92): Any amino acid
  MOD_RES (110)..(130): Any amino acid
  MOD_RES (146)..(196): Any amino acid
  MOD_RES (219)..(230): Any amino acid
  MOD_RES (242)..(247): Any amino acid
  MOD_RES (260)..(268): Any amino acid
  MOD_RES (293)..(294): Any amino acid
  MOD_RES (305)..(305): Any amino acid
  MOD_RES (315)..(320): Any amino acid
  MOD_RES (334)..(375): Any amino acid
  MOD_RES (389)..(411): Any amino acid
  MOD_RES (421)..(422): Any amino acid
  MOD_RES (433)..(452): Any amino acid
  MOD_RES (469)..(480): Any amino acid
  MOD_RES (515)..(527): Any amino acid
XXXXXXXXXXXDIEIMASQGTXRSYEQMETDGEXXXXATEIRTSVGRMVGGIGKFYIQMCTEXXXXXNEGRLIQNSLTIERMXXXXXXXXXXKYLEEHPSTGKDPKKTGXXXXXXXXXXXXXXXXXXXXXELRRIWRQANSGEDAXXXXXXXXXXXXXXXXXXXXXXXXXXXXXXXXXXXXXXXXXXXXXXXXXXXAAIKGIGTMVMELVRMIKRGINXXXXXXXXXXXXTRGAYERMCNIXXXXXXQTAAQRAMVDQVXXXXXXXXXEIEDLIFLTRSASALILRGSVAHKXXLPACVYGLVVXGGYDFEREGXXXXXXDPDPFRLLQNSQVXXXXXXXXXXXXXXXXXXXXXXXXXXXXXXXXXXXXXXXXXXPRGQLTTRGVQIAXXXXXXXXXXXXXXXXXXXXXXXTRSGGNTNHXXASAGQVSVQPXXXXXXXXXXXXXXXXXXXXGNPEGRTSDMRTEIIKXXXXXXXXXXXXEMSFQGRGVFFELSDERATNPIVPSFEMSNEGSYXXXXXXXXXXXXX

SEQ ID NO: 419148 - protein, 527 aa, Influenza virus
  MOD_RES (1)..(15): Any amino acid
  MOD_RES (34)..(70): Any amino acid
  MOD_RES (81)..(132): Any amino acid
  MOD_RES (144)..(280): Any amino acid
  MOD_RES (293)..(322): Any amino acid
  MOD_RES (334)..(462): Any amino acid
  MOD_RES (472)..(486): Any amino acid
  MOD_RES (496)..(499): Any amino acid
  MOD_RES (509)..(527): Any amino acid
XXXXXXXXXXXXXXXMALQGTKRSYEQMETSGEXXXXXXXXXXXXXXXXXXXXXXXXXXXXXXXXXXXXXRLVQNSITIEXXXXXXXXXXXXXXXXXXXXXXXXXXXXXXXXXXXXXXXXXXXXXXXXXXXXRRNWRQANNGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSALILRGSIAHKXXXXXXXXXXXXXXXXXXXXXXXXXXXXXXDPFKLLQNSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRAEIIKMEXXXXXXXXXXXXXXXRRGQGHLDEXXXXTPIVPSFDMXXXXXXXXXXXXXXXXXXX

SEQ ID NO: 419149 - protein, 527 aa, Influenza virus
  MOD_RES (1)..(23): Any amino acid
  MOD_RES (33)..(77): Any amino acid
  MOD_RES (88)..(280): Any amino acid
  MOD_RES (293)..(322): Any amino acid
  MOD_RES (334)..(466): Any amino acid
  MOD_RES (477)..(487): Any amino acid
  MOD_RES (500)..(507): Any amino acid
  MOD_RES (517)..(527): Any amino acid
XXXXXXXXXXXXXXXXXXXXXXXSYEQMETGEXXXXXXXXXXXXXXXXXXXXXXXXXXXXXXXXXXXXXXXXXXXXXTVERMVLSAFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSALILRGAVAHKXXXXXXXXXXXXXXXXXXXXXXXXXXXXXXDPFKLLQTSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTEIIIRMMENXXXXXXXXXXXRGVFELSDEKAAXXXXXXXXISNEGSYFFXXXXXXXXXXX

SEQ ID NO: 419150 - protein, 527 aa, Influenza virus
  MOD_RES (1)..(25): Any amino acid
  MOD_RES (35)..(322): Any amino acid
  MOD_RES (334)..(487): Any amino acid
  MOD_RES (500)..(527): Any amino acid
XXXXXXXXXXXXXXXXXXXXXXXXXSEQMETGGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPFRLLQSSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGVFEFSDERAAXXXXXXXXXXXXXXXXXXXXXXXXXXXX

SEQ ID NO: 419151 - protein, 527 aa, Influenza virus
  MOD_RES (1)..(26): Any amino acid
  MOD_RES (37)..(324): Any amino acid
  MOD_RES (334)..(488): Any amino acid
  MOD_RES (500)..(527): Any amino acid
XXXXXXXXXXXXXXXXXXXXXXXXXXEQMETDGDRQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFKLLQNSQIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVFELSDERAAXXXXXXXXXXXXXXXXXXXXXXXXXXXX

SEQ ID NO: 419152 - protein, 527 aa, Influenza virus
  MOD_RES (1)..(26): Any amino acid
  MOD_RES (37)..(325): Any amino acid
  MOD_RES (335)..(527): Any amino acid
XXXXXXXXXXXXXXXXXXXXXXXXXXEQMETDGERQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRLLQNSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419153 - protein, 527 aa, Influenza virus
  MOD_RES (1)..(26): Any amino acid
  MOD_RES (37)..(527): Any amino acid
XXXXXXXXXXXXXXXXXXXXXXXXXXEQMETSGERQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419154 - protein, 527 aa, Influenza virus
  MOD_RES (1)..(27): Any amino acid
  MOD_RES (37)..(527): Any amino acid
XXXXXXXXXXXXXXXXXXXXXXXXXXXQMETGERQNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419155 - protein, 308 aa, Influenza virus
  MOD_RES (37)..(44): Any amino acid
  MOD_RES (58)..(58): Any amino acid
  MOD_RES (72)..(74): Any amino acid
  MOD_RES (91)..(123): Any amino acid
  MOD_RES (137)..(183): Any amino acid
  MOD_RES (194)..(222): Any amino acid
  MOD_RES (232)..(262): Any amino acid
  MOD_RES (281)..(285): Any amino acid
MLFVQSYFQLFLVCVSLLQSAILSLFQVDCFLWHVRXXXXXXXXGDAPFLDRLRRDQXDRLRRDQKSLRGRXXXPMRTPIAFLTSSIVCPXXXXXXXXXXXXXXXXXXXXXXXXXXXXXXXXXIASVPASRYLIDMXXXXXXXXXXXXXXXXXXXXXXXXXXXXXXXXXXXXXXXXXXXXXXXAGVETMVILSXXXXXXXXXXXXXXXXXXXXXXXXXXXXXNWPSSSGGLXXXXXXXXXXXXXXXXXXXXXXXXXXXXXXXSRNGKWREQLSQKFEEIRXXXXXVRGDQMAHCNSFEQITFMQALQL

SEQ ID NO: 419156 - protein, 308 aa, Influenza virus
  MOD_RES (1)..(23): Any amino acid
  MOD_RES (37)..(44): Any amino acid
  MOD_RES (66)..(124): Any amino acid
  MOD_RES (137)..(285): Any amino acid
  MOD_RES (297)..(308): Any amino acid
XXXXXXXXXXXXXXXXXXXXXXXSSFQVDCFLWHIRXXXXXXXXSDAPFLDRLLQANLCRFLETRXXXXXXXXXXXXXXXXXXXXXXXXXXXXXXXXXXXXXXXXXXXXXXXXXXXXXXXXXXXLKMPASRYLTDMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVRRDQMAHCRMXXXXXXXXXXXX

SEQ ID NO: 419157 - protein, 308 aa, Influenza virus
  MOD_RES (1)..(23): Any amino acid
  MOD_RES (37)..(44): Any amino acid
  MOD_RES (58)..(58): Any amino acid
  MOD_RES (72)..(125): Any amino acid
  MOD_RES (137)..(285): Any amino acid
  MOD_RES (303)..(308): Any amino acid
XXXXXXXXXXXXXXXXXXXXXXXTSFQVDCYLWHIRXXXXXXXXCDAPFDDRLRRDQXDRLRRDQRSLRGRXXXXXXXXXXXXXXXXXXXXXXXXXXXXXXXXXXXXXXXXXXXXXXXXXXXXXXSKITLKFAFNMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVRHRLKITENSFEQITFXXXXXX

SEQ ID NO: 419158 - protein, 308 aa, Influenza virus
  MOD_RES (1)..(23): Any amino acid
  MOD_RES (37)..(44): Any amino acid
  MOD_RES (58)..(58): Any amino acid
  MOD_RES (72)..(125): Any amino acid
  MOD_RES (136)..(308): Any amino acid
XXXXXXXXXXXXXXXXXXXXXXXLSFQVDCFLWYVRXXXXXXXXGDAPFLDRIRRDQXDRLRRDQKALKGRXXXXXXXXXXXXXXXXXXXXXXXXXXXXXXXXXXXXXXXXXXXXXXXXXXXXXXSVPASRYLTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419159 - protein, 308 aa, Influenza virus
  MOD_RES (1)..(23): Any amino acid
  MOD_RES (37)..(44): Any amino acid
  MOD_RES (58)..(58): Any amino acid
  MOD_RES (72)..(308): Any amino acid
XXXXXXXXXXXXXXXXXXXXXXXSSFQVDCFIWHIRXXXXXXXXGDAPFIDRLRRDQXDRLRRDQRALKGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419160 - protein, 308 aa, Influenza virus
  MOD_RES (1)..(49): Any amino acid
  MOD_RES (72)..(308): Any amino acid
XXXXXXXXXXXXXXXXXXXXXXXXXXXXXXXXXXXXXXXXXXXXXXXXXSLLLLQANLCRIRRDQKSLKGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419161 - protein, 308 aa, Influenza virus
  MOD_RES (1)..(49): Any amino acid
  MOD_RES (60)..(308): Any amino acid
XXXXXXXXXXXXXXXXXXXXXXXXXXXXXXXXXXXXXXXXXXXXXXXXXSSLLLQANLCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419162 - protein, 308 aa, Influenza virus
  MOD_RES (1)..(58): Any amino acid
  MOD_RES (68)..(308): Any amino acid
XXXXXXXXXXXXXXXXXXXXXXXXXXXXXXXXXXXXXXXXXXXXXXXXXXXXXXXXXXDRIRRDQKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419163 - protein, 205 aa, Influenza virus
  MOD_RES (96)..(100): Any amino acid
  MOD_RES (110)..(149): Any amino acid
  MOD_RES (160)..(168): Any amino acid
TAFSGMSANGDILFQYLLFQDILMRMFADQELGDAPFLDRLRRDQKSLRGRGSTLGLDIRTATREGKHIVERILEEESDEALKMTIASDILTRMSXXXXXRPHPEDLNGXXXXXXXXXXXXXXXXXXXXXXXXXXXXXXXXXXXXXXXXQKFEEIRWLIXXXXXXXXXTENSFEQITFMQALQLLLEVEQEIRTFSFQLINNKKP

SEQ ID NO: 419164 - protein, 205 aa, Influenza virus
  MOD_RES (1)..(13): Any amino acid
  MOD_RES (35)..(83): Any amino acid
  MOD_RES (96)..(149): Any amino acid
  MOD_RES (160)..(168): Any amino acid
  MOD_RES (201)..(205): Any amino acid
XXXXXXXXXXXXXFQVDCFLWHVRKRFADQELGDXXXXXXXXXXXXXXXXXXXXXXXXXXXXXXXXXXXXXXXXXXXXXXXXXMTIASDILKRMSXXXXXXXXXXXXXXXXXXXXXXXXXXXXXXXXXXXXXXXXXXXXXXXXXXXXXXQKFEEVRWLIXXXXXXXXXTESSFEQITFMQALQLLFEVEQEIRAFSFQLIXXXXX

SEQ ID NO: 419165 - protein, 205 aa, Influenza virus
  MOD_RES (1)..(149): Any amino acid
  MOD_RES (160)..(170): Any amino acid
  MOD_RES (201)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQKFEEIKWLIXXXXXXXXXXXNSFEQITFLQALQLLLEVESEIRTFSFQFIXXXXX

SEQ ID NO: 419166 - protein, 205 aa, Influenza virus
  MOD_RES (1)..(149): Any amino acid
  MOD_RES (160)..(170): Any amino acid
  MOD_RES (203)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQKFEEMRWLIXXXXXXXXXXXNSFEQITFIQALQLLLEVENEIRTFSFQLILIXXX

SEQ ID NO: 419167 - protein, 205 aa, Influenza virus
  MOD_RES (1)..(149): Any amino acid
  MOD_RES (160)..(186): Any amino acid
  MOD_RES (203)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQKFEEIRWMIXXXXXXXXXXXXXXXXXXXXXXXXXXXEVEQEMRTFSFQLILLXXX

SEQ ID NO: 419168 - protein, 734 aa, Influenza virus
  MOD_RES (27)..(30): Any amino acid
  MOD_RES (58)..(66): Any amino acid
  MOD_RES (86)..(86): Any amino acid
  MOD_RES (96)..(101): Any amino acid
  MOD_RES (159)..(159): Any amino acid
  MOD_RES (209)..(215): Any amino acid
  MOD_RES (228)..(229): Any amino acid
  MOD_RES (256)..(277): Any amino acid
  MOD_RES (325)..(352): Any amino acid
  MOD_RES (362)..(370): Any amino acid
  MOD_RES (388)..(410): Any amino acid
  MOD_RES (427)..(428): Any amino acid
  MOD_RES (466)..(467): Any amino acid
  MOD_RES (543)..(544): Any amino acid
  MOD_RES (554)..(568): Any amino acid
  MOD_RES (623)..(625): Any amino acid
  MOD_RES (728)..(734): Any amino acid
MEDFVRQCFNPMIVELAEKAMKEYGEXXXXETNKFAAICTHLEVCFMYSDFHFIDERXXXXXXXXXDPNALLKHRFEIIEGRDRTXAWTVVNSICXXXXXXKPKFLPDLYDYKENRFIEIGVTRREVHIYYLEKANKIKSEKTHIHIFSFTGEEMATKXDYTLDEESRARIIKTRLFTIRQEMASRGLWDSFRQSERGEETIEERFEIXXXXXXXLADQSLPPNFSSXXNFRAYVDGFEPNGCIEGKLSQMSKEVXXXXXXXXXXXXXXXXXXXXXXCSQRSKFLLMDALKLSIEDPSHEHEGEGIPLYDAIKCMKTFFGWKEPXXXXXXXXXXXXXXXXXXXXXXXXXXXXLKDEEKIPKXXXXXXXXXLKWALGENMAPEKVDFDXXXXXXXXXXXXXXXXXXXXXXXWIQSEFNKACELTDSSXXWIELDEIGEDVAPIEHIASMRRNYFTAEVSHCRATEYXXMKGVYINTALLNASCAAMDDFQLIPMISKCRTKEGRRKTNLYGFIIKGRSHLRNDTDVVNFVSMEEFSLTDPRLEXXKWEKYCVLEXXXXXXXXXXXXXXXPMFLYVRTNGTSKIKMKWGMEMRRCLLQSLQQIESMIEAESSVKEKDMTKEFFEXXXETWPIGESPKGVEEGSIGKVCRTLLAKSVFNSLYASPQLEGFSAESRKLLLIVQALRDNLEPGTFDLGGLYEAIEECLINDPWVLLNASWFNSFLTHALRFLXXXXXXX

SEQ ID NO: 419169 - protein, 734 aa, Influenza virus
  MOD_RES (27)..(30): Any amino acid
  MOD_RES (58)..(66): Any amino acid
  MOD_RES (86)..(86): Any amino acid
  MOD_RES (96)..(101): Any amino acid
  MOD_RES (159)..(159): Any amino acid
  MOD_RES (172)..(174): Any amino acid
  MOD_RES (209)..(215): Any amino acid
  MOD_RES (228)..(229): Any amino acid
  MOD_RES (256)..(277): Any amino acid
  MOD_RES (323)..(370): Any amino acid
  MOD_RES (388)..(410): Any amino acid
  MOD_RES (427)..(428): Any amino acid
  MOD_RES (466)..(467): Any amino acid
  MOD_RES (514)..(519): Any amino acid
  MOD_RES (543)..(544): Any amino acid
  MOD_RES (554)..(568): Any amino acid
  MOD_RES (623)..(625): Any amino acid
  MOD_RES (707)..(712): Any amino acid
  MOD_RES (732)..(734): Any amino acid
MENFVRQCFNPMVVELAEKTMKEYGEXXXXETNKLAAICTHLEICFMYSDFHFINEQXXXXXXXXXDSNALLKHRFEIIEGRDRIXAWTVVNSLCXXXXXXKPRFLPDLYDYKEDRFVEIGVTRREIHIYYLEKASKIKSENTHIHIFSFNGEEMATKXDYTIDEESRARIXXXRLFTIRQELASRSLWDSFRQSERGEDTIEERFEIXXXXXXXLANQSLPPNFSCXXNFRVYVDGFEPNGYIEGKLSQMSREVXXXXXXXXXXXXXXXXXXXXXXCHQRSKFLLMDSLKLSIEDPNHEHEGEGIPLHDAIKCIKTFFGWKXXXXXXXXXXXXXXXXXXXXXXXXXXXXXXXXXXXXXXXXXXXXXXXXLRWALGENMAPEKMDFEXXXXXXXXXXXXXXXXXXXXXXXWIQNEFNKACELTDSIXXWLELDEIGEDIAPIEHVASMRRNYFTAEISHCRATEYXXMKGVYVNTALLNASCAAMEDFQLIPMISKCKTKEGRRRTNLYGFIIXXXXXXRNDTDVVNYVSMEEFSLTDPRFEXXKWEKYCILEXXXXXXXXXXXXXXXPMFLYIRTNGTSKIKMKWGMELRRCLLQSLQQIESIIEAESSVKEKDLTKEFFEXXXEAWPIGESPRGVEESSIGKVCRTLLAKSVFNCLYASPQLEGFSAESRKMLLIVQAFRDNLEPGTFDIGGLYESIEECLINDXXXXXXASWFNSFLAHALKLVVAMLXXX

SEQ ID NO: 419170 - protein, 734 aa, Influenza virus
  MOD_RES (27)..(30): Any amino acid
  MOD_RES (46)..(48): Any amino acid
  MOD_RES (58)..(66): Any amino acid
  MOD_RES (86)..(86): Any amino acid
  MOD_RES (96)..(101): Any amino acid
  MOD_RES (159)..(159): Any amino acid
  MOD_RES (209)..(215): Any amino acid
  MOD_RES (228)..(229): Any amino acid
  MOD_RES (256)..(277): Any amino acid
  MOD_RES (288)..(289): Any amino acid
  MOD_RES (301)..(303): Any amino acid
  MOD_RES (325)..(370): Any amino acid
  MOD_RES (388)..(410): Any amino acid
  MOD_RES (427)..(428): Any amino acid
  MOD_RES (543)..(544): Any amino acid
  MOD_RES (554)..(568): Any amino acid
  MOD_RES (591)..(596): Any amino acid
  MOD_RES (623)..(625): Any amino acid
  MOD_RES (706)..(712): Any amino acid
  MOD_RES (727)..(734): Any amino acid
MEGFVRQCFNPMTVELAEKAMKEHGEXXXXETNKFASICTHLEVCXXXSDFHFINERXXXXXXXXXDPNVLLKHRFEIIEGRDRNXAWTMVNSICXXXXXXKPRYLPDLYDYKESRFLEIGVTRREVHTYYLEKANKIKTEETHIHIFSFTGEEMASKXEYTLDEESRRARIKTRLFTIRQEMANRGLWDPFRQSERGEETVEERFEIXXXXXXXLANYSLPPNFSSXXNFRTYVDGFEPNGCIESKLSQMSKKVXXXXXXXXXXXXXXXXXXXXXXCYQRSKFLLMXXLKLSIEDPDHEXXXEGIPLYDAVRCMKTFFGWREPXXXXXXXXXXXXXXXXXXXXXXXXXXXXXXXXXXXXXXXXXXXXXXLKWVLGENMAPEKIDFEXXXXXXXXXXXXXXXXXXXXXXXWVQNEFNKACELTDSVXXWMELDEIGEDLAPIEYIASMRRDYFTAEVSYCRATTEYIMKGVYMNTALLNASCAAMDEFQLIPMISKSRTKEGRRRTNLYGFIVKGRSHLRNDTDVVNFLSMEEFSLTDPKLEXXKWERYCVLEXXXXXXXXXXXXXXXPIFLYVRTNGTSKVKMKWGMEMXXXXXXSLQQIESMVEAESSVKEKDMTREFFEXXXEKWPIGESPEGVEDGSIGKVCRALLAKSVFNNLYASSQLEGFSAESRKLLLVVQALRDSLEPGTFDLEGLYDAIEECLINXXXXXXXASWFNSFLVHALKSXXXXXXXX

SEQ ID NO: 419171 - protein, 734 aa, Influenza virus
  MOD_RES (23)..(31): Any amino acid
  MOD_RES (58)..(66): Any amino acid
  MOD_RES (76)..(76): Any amino acid
  MOD_RES (86)..(86): Any amino acid
  MOD_RES (96)..(101): Any amino acid
  MOD_RES (159)..(159): Any amino acid
  MOD_RES (169)..(176): Any amino acid
  MOD_RES (187)..(196): Any amino acid
  MOD_RES (209)..(217): Any amino acid
  MOD_RES (228)..(229): Any amino acid
  MOD_RES (256)..(277): Any amino acid
  MOD_RES (288)..(289): Any amino acid
  MOD_RES (301)..(304): Any amino acid
  MOD_RES (325)..(370): Any amino acid
  MOD_RES (388)..(410): Any amino acid
  MOD_RES (427)..(428): Any amino acid
  MOD_RES (486)..(491): Any amino acid
  MOD_RES (514)..(524): Any amino acid
  MOD_RES (541)..(544): Any amino acid
  MOD_RES (554)..(568): Any amino acid
  MOD_RES (579)..(599): Any amino acid
  MOD_RES (623)..(625): Any amino acid
  MOD_RES (645)..(650): Any amino acid
  MOD_RES (666)..(669): Any amino acid
  MOD_RES (684)..(684): Any amino acid
  MOD_RES (706)..(712): Any amino acid
MEEFVRQCFNPMIIELAEKAMKXXXXXXXXXTNKFAAVCTHMEVCFMYSDFHFIDEQXXXXXXXXXDPNTLLKHRXEIIEGRDRAXAWTVINSICXXXXXXKPKYLPDLYDYKKNRFTEIGVTRREVHVYYLEKANKIKAERTHIHIFSFIGEEMATKXDYILDEESRXXXXXXXXFTIRQEMAIRXXXXXXXXXXRGEETIEEKFEIXXXXXXXXXDQSLPPNFPSXXSFRAYVDGFKPNGCIEGKLSQMPKEVXXXXXXXXXXXXXXXXXXXXXXCFQRSKFLLMXXLKLSIENPSHEXXXXGIPLYDAVKCMRTFFGWKEPXXXXXXXXXXXXXXXXXXXXXXXXXXXXXXXXXXXXXXXXXXXXXXLKWTLGENMAPEKVDFEXXXXXXXXXXXXXXXXXXXXXXXWVQSEFNKACELTDSTXXWVELDEIGEDVAPIEYVASMRRSYFTAEVSSHCRATEYIMKGVYINTAMLNASCAAMXXXXXXPMISKCRTREGRRKTNLYGFIVXXXXXXXXXXXGSLNFVSMEFSLTDPRXXXXKWEKYCVIEXXXXXXXXXXXXXXXPLFLYVRTNGXXXXXXXXXXXXXXXXXXXXXQVESMIEAESSIKEKDMTKEFFVXXXEMWPIGESPKRVEEGSIGKXXXXXXAKSVFNSIYASPQLEXXXXESRKLLLIAQALRDXLEPGTFDIEGLYGAIEECLINXXXXXXXASWFNSFLIHALRELWQCYYLL

SEQ ID NO: 419172 - protein, 734 aa, Influenza virus
  MOD_RES (1)..(1): Any amino acid
  MOD_RES (23)..(33): Any amino acid
  MOD_RES (47)..(48): Any amino acid
  MOD_RES (58)..(86): Any amino acid
  MOD_RES (96)..(101): Any amino acid
  MOD_RES (114)..(120): Any amino acid
  MOD_RES (136)..(140): Any amino acid
  MOD_RES (159)..(163): Any amino acid
  MOD_RES (195)..(200): Any amino acid
  MOD_RES (210)..(231): Any amino acid
  MOD_RES (241)..(246): Any amino acid
  MOD_RES (256)..(291): Any amino acid
  MOD_RES (301)..(312): Any amino acid
  MOD_RES (323)..(370): Any amino acid
  MOD_RES (381)..(417): Any amino acid
  MOD_RES (427)..(429): Any amino acid
  MOD_RES (473)..(478): Any amino acid
  MOD_RES (489)..(496): Any amino acid
  MOD_RES (506)..(525): Any amino acid
  MOD_RES (541)..(568): Any amino acid
  MOD_RES (578)..(603): Any amino acid
  MOD_RES (621)..(625): Any amino acid
  MOD_RES (646)..(651): Any amino acid
  MOD_RES (668)..(669): Any amino acid
  MOD_RES (684)..(696): Any amino acid
  MOD_RES (708)..(712): Any amino acid
  MOD_RES (723)..(734): Any amino acid
XGDFVRQCFNPMIAELAEKAMKXXXXXXXXXXXKFAAICTHMEVCFXXSDFHFINELXXXXXXXXXXXXXXXXXXXXXXXXXXXXXAWTAVNSICXXXXXXKPKSLPDLYDYKXXXXXXXGVTRREVHMYYLEKAXXXXXEDTHIHIFSFTGEEMATRXXXXXASSKSRARIKTRLFTIRQEMAGKGLWDSFRQXXXXXXRSIEEKFEIXXXXXXXXXXXXXXXXXXXXXXRTYVDGFKPXXXXXXKLSQMSKNVXXXXXXXXXXXXXXXXXXXXXXXXXXXXXXXXXXXXLSIEEPSHEXXXXXXXXXXXXKCIRTFFGWKXXXXXXXXXXXXXXXXXXXXXXXXXXXXXXXXXXXXXXXXXXXXXXXXLMWALGENMAXXXXXXXXXXXXXXXXXXXXXXXXXXXXXXXXXXXXXKACELTGSSXXXIEFDEIGEDVAPIEHIASIRRNYFTTEVSHCRATTEYMMKGVYXXXXXXNSSCAAMDDFXXXXXXXXCRTKEGRRRXXXXXXXXXXXXXXXXXXXXVVNFVSMEFSLTDPKXXXXXXXXXXXXXXXXXXXXXXXXXXXXSMFLYVRTNXXXXXXXXXXXXXXXXXXXXXXXXXXMIEAESSVREKDMTKEFXXXXXETWPVGESPKGMEEGSIGKVXXXXXXKSVFNSLYSSPQLEGFXXESRKLLLITQALRDXXXXXXXXXXXXXEAVEECLINDPXXXXXASWFNSFLKHXXXXXXXXXXXX

SEQ ID NO: 419173 - protein, 734 aa, Influenza virus
  MOD_RES (1)..(13): Any amino acid
  MOD_RES (25)..(131): Any amino acid
  MOD_RES (141)..(164): Any amino acid
  MOD_RES (176)..(177): Any amino acid
  MOD_RES (187)..(234): Any amino acid
  MOD_RES (244)..(292): Any amino acid
  MOD_RES (303)..(376): Any amino acid
  MOD_RES (388)..(418): Any amino acid
  MOD_RES (429)..(435): Any amino acid
  MOD_RES (454)..(457): Any amino acid
  MOD_RES (472)..(525): Any amino acid
  MOD_RES (538)..(613): Any amino acid
  MOD_RES (623)..(636): Any amino acid
  MOD_RES (646)..(653): Any amino acid
  MOD_RES (666)..(678): Any amino acid
  MOD_RES (691)..(717): Any amino acid
  MOD_RES (730)..(734): Any amino acid
XXXXXXXXXXXXXVELAERAMKEYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMEKANKIKSXXXXXXXXXXXXXXXXXXXXXXXXDEESRARIKTRXXTIRQEMASKXXXXXXXXXXXXXXXXXXXXXXXXXXXXXXXXXXXXXXXXXXXXXXXXIDGFEPNGCXXXXXXXXXXXXXXXXXXXXXXXXXXXXXXXXXXXXXXXXXXXXXXXXXKASKEPEVHEXXXXXXXXXXXXXXXXXXXXXXXXXXXXXXXXXXXXXXXXXXXXXXXXXXXXXXXXXXXXXXXXXXXXXXXXXXENIAPEKVDFEXXXXXXXXXXXXXXXXXXXXXXXXXXXXXXXKTAYELTDSSXXXXXXXGEDIAPIEYIASMRRSYFXXXXISKSRATEYMMKGVXXXXXXXXXXXXXXXXXXXXXXXXXXXXXXXXXXXXXXXXXXXXXXXXXXXXXXVVNYVSMEFSLTXXXXXXXXXXXXXXXXXXXXXXXXXXXXXXXXXXXXXXXXXXXXXXXXXXXXXXXXXXXXXXXXXXXXXXXXXXXXKDMTKDFFEXXXXXXXXXXXXXXIEEGSIGKVXXXXXXXXVFNSLYASSQLEXXXXXXXXXXXXXQALKDNLEPGTFXXXXXXXXXXXXXXXXXXXXXXXXXXXSSLTHALRELWQXXXXX

SEQ ID NO: 419174 - protein, 734 aa, Influenza virus
  MOD_RES (1)..(132): Any amino acid
  MOD_RES (142)..(237): Any amino acid
  MOD_RES (248)..(294): Any amino acid
  MOD_RES (309)..(420): Any amino acid
  MOD_RES (430)..(458): Any amino acid
  MOD_RES (469)..(525): Any amino acid
  MOD_RES (539)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKSNKIKSEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFEPNGSIEGKXXXXXXXXXXXXXXXXXXXXXXXXXXXXXXXXXXXXXXXXXXXXXXXSIEDPSHEGEGIPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXACELTDSSWXXXXXXXXXXXXXXXXXXXXXXXXXXXXXSYCRATEYIMXXXXXXXXXXXXXXXXXXXXXXXXXXXXXXXXXXXXXXXXXXXXXXXXXXXXXXXXXVVNFLSMEFSLTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419175 - protein, 734 aa, Influenza virus
  MOD_RES (1)..(294): Any amino acid
  MOD_RES (309)..(420): Any amino acid
  MOD_RES (430)..(459): Any amino acid
  MOD_RES (470)..(533): Any amino acid
  MOD_RES (543)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPNHEGEGIPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXACELTDSIWXXXXXXXXXXXXXXXXXXXXXXXXXXXXXXHCRATEYMMKXXXXXXXXXXXXXXXXXXXXXXXXXXXXXXXXXXXXXXXXXXXXXXXXXXXXXXXXXXXXXXXXFSLVDPRLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419176 - protein, 734 aa, Influenza virus
  MOD_RES (1)..(294): Any amino acid
  MOD_RES (309)..(420): Any amino acid
  MOD_RES (430)..(463): Any amino acid
  MOD_RES (477)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPDHEGEGIPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXACELTDSVWXXXXXXXXXXXXXXXXXXXXXXXXXXXXXXXXXXTEYIIKGVYINTAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419177 - protein, 734 aa, Influenza virus
  MOD_RES (1)..(294): Any amino acid
  MOD_RES (307)..(420): Any amino acid
  MOD_RES (430)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIENPSHEGEGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXACELTDSTWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419178 - protein, 734 aa, Influenza virus
  MOD_RES (1)..(294): Any amino acid
  MOD_RES (304)..(420): Any amino acid
  MOD_RES (430)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEEPSHEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXACELTGSSWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419179 - protein, 829 aa, Influenza virus
  MOD_RES (12)..(12): Any amino acid
  MOD_RES (58)..(59): Any amino acid
  MOD_RES (113)..(115): Any amino acid
  MOD_RES (156)..(159): Any amino acid
  MOD_RES (174)..(181): Any amino acid
  MOD_RES (213)..(217): Any amino acid
  MOD_RES (332)..(332): Any amino acid
  MOD_RES (367)..(391): Any amino acid
  MOD_RES (403)..(405): Any amino acid
  MOD_RES (440)..(440): Any amino acid
  MOD_RES (462)..(464): Any amino acid
  MOD_RES (585)..(594): Any amino acid
  MOD_RES (625)..(626): Any amino acid
  MOD_RES (666)..(684): Any amino acid
  MOD_RES (802)..(808): Any amino acid
MDVNPTLLFLKXKVPAQNAISTTFPYTGDPPYSHGTGTGYTMDTVNRTHQYSEKGKWXXNTETGAPQLNPIDGPLPEDNEPSGYAQTDCVLEAMAFLEESHPGIFENSCLETXXXVQQTRVDKLTQGRQTYDWTLNRNQPAATALANTIEVFRSNXXXXNESGRLIDFLKDVMXXXXXXXXEITTHFQRKRRVRDNMTKKMVTQRTIGKKKQXXXXXSYLIRALTLNTMTKDAERGKLKRRAIATPGMQIRGFVYFVETLARSICEKLEQSGLPVGGNEKKAKLANVVRKMMTNSQDTELSFTITGDNTKWNENQNPRMFLFLAMITYITRXQPEWFRNILSMAPIMFSNKMARLGKGYMFESKSMXXXXXXXXXXXXXXXXXXXXXXXXXKIEKIEKIRPLXXXGTASLSPGMMMGMFNMLSTVLGVSILNLGQKRYTXTTYWWDGLQSSDDFALIVNAPXXXGIQAGVDRFYRTCKLVGINMSKKKSYINRTGTFEFTSFFYRYGFVANFSMELPSFGVSGINESADMSIGVTVIKNNMINNDLGPATAQMALQLFIKDYRYTYRCHRGDTQIQTRRSFELKXXXXXXXXXXGLLVSDGGPNLYNIRNLHIPEVCLKWELMDXXYQGRLCNPLNPFVSHVGTRWMKIIRVGCVILLNPFVSHKXXXXXXXXXXXXXXXXXXXMEYDAVATTHSWIPKRNRSILNTSQRGRSGQNHGICAVATTHSWVPILNTSQRGILEDEQMYQKCCNLFEKFFPSSSYRRPVGISSMVEAMVSRARIDARIDFESGRIGKKEEFSEIXXXXXXXEELRRQKSLIWLWLVLREKMP

SEQ ID NO: 419180 - protein, 829 aa, Influenza virus
  MOD_RES (1)..(2): Any amino acid
  MOD_RES (12)..(12): Any amino acid
  MOD_RES (23)..(37): Any amino acid
  MOD_RES (58)..(59): Any amino acid
  MOD_RES (73)..(77): Any amino acid
  MOD_RES (113)..(115): Any amino acid
  MOD_RES (140)..(142): Any amino acid
  MOD_RES (156)..(159): Any amino acid
  MOD_RES (174)..(181): Any amino acid
  MOD_RES (213)..(217): Any amino acid
  MOD_RES (227)..(246): Any amino acid
  MOD_RES (266)..(285): Any amino acid
  MOD_RES (309)..(310): Any amino acid
  MOD_RES (332)..(332): Any amino acid
  MOD_RES (367)..(405): Any amino acid
  MOD_RES (416)..(424): Any amino acid
  MOD_RES (440)..(440): Any amino acid
  MOD_RES (462)..(464): Any amino acid
  MOD_RES (502)..(515): Any amino acid
  MOD_RES (543)..(561): Any amino acid
  MOD_RES (585)..(594): Any amino acid
  MOD_RES (607)..(607): Any amino acid
  MOD_RES (624)..(626): Any amino acid
  MOD_RES (642)..(684): Any amino acid
  MOD_RES (720)..(730): Any amino acid
  MOD_RES (757)..(757): Any amino acid
  MOD_RES (802)..(808): Any amino acid
  MOD_RES (827)..(829): Any amino acid
XXVNPTLLFLEXKIPAQNAISTXXXXXXXXXXXXXXXTGYTMDTVSRTHQYSEKGRWXXNSETGAPQLNPVDXXXXXDNEPTGYAQTDCVLEAMALLEESHPGLFENSCLETXXXIQQTRVDKLTQGRQTFDWTLNRNQXXXTALANTIEIFRSNXXXXSESGRLIDFLKDVIXXXXXXXXEVTTHFQRKRRIRDNMTKKMITQRTIGKKKHXXXXXGYLIRALTLXXXXXXXXXXXXXXXXXXXXGMQIRGFVHFVEALARSICXXXXXXXXXXXXXXXXXXXXNVVRKMMTSSQDTELSFTVTGDNXXWNENQNPRVFLFLTMITYITRXQPEWFRNVLSIAPIMFSNKVARLGKGYMFESKRMXXXXXXXXXXXXXXXXXXXXXXXXXXXXXXXXXXXXXXXGAASLSPGMMXXXXXXXXXVLGVSVLNLGQKKYTXTIYWWDGLQSSDDFALILNAPXXXGIQAGVNRFYRTCKLLGINMSKKKSYINKTGTFEFTSXXXXXXXXXXXXXXLPSFGVSGVNESADMSIGITVIKNNMIXXXXXXXXXXXXXXXXXXXYRYTYRCHKGDTQIQTKRSFELKXXXXXXXXXXGLLISDGGPNLYXIRNLHIPEAGLKWELMXXXYRGRLCNPLNPFVNHXXXXXXXXXXXXXXXXXXXXXXXXXXXXXXXXXXXXXXXXXXXIEYDAVATTHSWVPKRNRSILNSNAITRSGQNHGIXXXXXXXXXXXILNTSQRGVLEDEQMYQRCCNLFEKFXPSSSYRRPIGISSMVEAMISRARIDARVDFESGRIGKKEFSEIMXXXXXXXEELRRQKWWVWLWLVLREXXX

SEQ ID NO: 419181 - protein, 829 aa, Influenza virus
  MOD_RES (1)..(3): Any amino acid
  MOD_RES (17)..(45): Any amino acid
  MOD_RES (58)..(59): Any amino acid
  MOD_RES (87)..(90): Any amino acid
  MOD_RES (113)..(115): Any amino acid
  MOD_RES (132)..(145): Any amino acid
  MOD_RES (156)..(159): Any amino acid
  MOD_RES (174)..(181): Any amino acid
  MOD_RES (213)..(217): Any amino acid
  MOD_RES (227)..(250): Any amino acid
  MOD_RES (272)..(287): Any amino acid
  MOD_RES (309)..(310): Any amino acid
  MOD_RES (322)..(322): Any amino acid
  MOD_RES (332)..(332): Any amino acid
  MOD_RES (367)..(405): Any amino acid
  MOD_RES (417)..(427): Any amino acid
  MOD_RES (440)..(440): Any amino acid
  MOD_RES (451)..(452): Any amino acid
  MOD_RES (462)..(464): Any amino acid
  MOD_RES (493)..(527): Any amino acid
  MOD_RES (545)..(564): Any amino acid
  MOD_RES (585)..(594): Any amino acid
  MOD_RES (608)..(612): Any amino acid
  MOD_RES (625)..(626): Any amino acid
  MOD_RES (642)..(684): Any amino acid
  MOD_RES (706)..(736): Any amino acid
  MOD_RES (760)..(763): Any amino acid
  MOD_RES (793)..(829): Any amino acid
XXXINPTLLFLKVPAQXXXXXXXXXXXXXXXXXXXXXXXXXXXXXNRTHQYSERGRWXXNTEIGAPQLNPIDGPLPKNNEPSGYAQXXXXLEAMAFLEKSHPGIFESSCLETXXXVQQTRVDRLTQGRQTYXXXXXXXXXXXXXXANTIEVFRLNXXXXNESGRLMDFLKDVMXXXXXXXXEIVTHFQRKRRVRDNVTKRMVTQRTIGKRKQXXXXXNYLIRALTLXXXXXXXXXXXXXXXXXXXXXXXXRGFVYFVEALARRICEKLEQSXXXXXXXXXXXXXXXXVRKMMTNSHDTEISFTITGDNXXWNENQNPRIFLXLAMITYITKXQPGWFRNVLSVAPIMFSNKMARLGRGYMFESKNMXXXXXXXXXXXXXXXXXXXXXXXXXXXXXXXXXXXXXXXGTVSLSPGMMMXXXXXXXXXXXVSILNLGQRKYTXTSYWWDGLQSXXDFALIVNASXXXGVQAGVDRFYRICKLVGINMSKRKSYINXXXXXXXXXXXXXXXXXXXXXXXXXXXXXXXXXXXADMSIGVAVIKNNMVNNXXXXXXXXXXXXXXXXXXXXTYRCHRGDMQIQTRRAFELKXXXXXXXXXXGLLVADGGPNLYNXXXXXIPEVCLKWDLMDXXYKGRLCNPLNPFVTHXXXXXXXXXXXXXXXXXXXXXXXXXXXXXXXXXXXXXXXXXXXVEYDAVATTHSWTPKRNRSILXXXXXXXXXXXXXXXXXXXXXXXXXXXXXXXKGILEDEQMYQKCCSLFEKFFPSXXXXRPVGISSMGEAMVSRARIDARVDSESGRIXXXXXXXXXXXXXXXXXXXXXXXXXXXXXXXXXXXXX

SEQ ID NO: 419182 - protein, 829 aa, Influenza virus
  MOD_RES (1)..(4): Any amino acid
  MOD_RES (17)..(47): Any amino acid
  MOD_RES (58)..(59): Any amino acid
  MOD_RES (89)..(90): Any amino acid
  MOD_RES (113)..(145): Any amino acid
  MOD_RES (156)..(164): Any amino acid
  MOD_RES (174)..(181): Any amino acid
  MOD_RES (213)..(217): Any amino acid
  MOD_RES (231)..(250): Any amino acid
  MOD_RES (272)..(292): Any amino acid
  MOD_RES (305)..(313): Any amino acid
  MOD_RES (330)..(332): Any amino acid
  MOD_RES (343)..(357): Any amino acid
  MOD_RES (367)..(405): Any amino acid
  MOD_RES (415)..(430): Any amino acid
  MOD_RES (440)..(440): Any amino acid
  MOD_RES (451)..(452): Any amino acid
  MOD_RES (462)..(529): Any amino acid
  MOD_RES (547)..(565): Any amino acid
  MOD_RES (585)..(626): Any amino acid
  MOD_RES (642)..(703): Any amino acid
  MOD_RES (714)..(742): Any amino acid
  MOD_RES (760)..(763): Any amino acid
  MOD_RES (781)..(783): Any amino acid
  MOD_RES (793)..(829): Any amino acid
XXXXNPTLLFLKIPAQXXXXXXXXXXXXXXXXXXXXXXXXXXXXXXXTHQYSERGKWXXNTETKAPQLNPIDGPLPDDNDPSGYAQTDXXLEAMAFLENSHPGIFENSCIETXXXXXXXXXXXXXXXXXXXXXXXXXXXXXXXXXANTIEVFKSNXXXXXXXXXLIDFLKDVVXXXXXXXXEIITHFQRKRRVRDNITRKMVTQRTVGKKKQXXXXXSYLIRTLTLNTMTXXXXXXXXXXXXXXXXXXXXRGFVYFVEILARCICEKLEQSXXXXXXXXXXXXXXXXXXXXXTNSQDTEISFTIXXXXXXXXXNQNQNPRMFLAMITYIXXXQPKWFRNVLSXXXXXXXXXXXXXXXGYMFESKKMXXXXXXXXXXXXXXXXXXXXXXXXXXXXXXXXXXXXXXXGTAALSPGMXXXXXXXXXXXXXXXXLNLGQKEYTXTVYWWDGLQSXXDFALIVNALXXXXXXXXXXXXXXXXXXXXXXXXXXXXXXXXXXXXXXXXXXXXXXXXXXXXXXXXXXXXXXXXXXXXMSIGVTVIRNNMINNDLXXXXXXXXXXXXXXXXXXXYRCHRGDTHIQTRRSFEIKXXXXXXXXXXXXXXXXXXXXXXXXXXXXXXXXXXXXXXXXXXYQGRLCNPMNPFVSHXXXXXXXXXXXXXXXXXXXXXXXXXXXXXXXXXXXXXXXXXXXXXXXXXXXXXXXXXXXXXXICNSNAITRSXXXXXXXXXXXXXXXXXXXXXXXXXXXXXEQMYQKCCTLFEKFFPSXXXXRPVGISSMMEAMVSRARXXXRIDFESGRMXXXXXXXXXXXXXXXXXXXXXXXXXXXXXXXXXXXXX

SEQ ID NO: 419183 - protein, 829 aa, Influenza virus
  MOD_RES (1)..(4): Any amino acid
  MOD_RES (17)..(59): Any amino acid
  MOD_RES (87)..(90): Any amino acid
  MOD_RES (113)..(164): Any amino acid
  MOD_RES (174)..(181): Any amino acid
  MOD_RES (199)..(199): Any amino acid
  MOD_RES (209)..(217): Any amino acid
  MOD_RES (229)..(253): Any amino acid
  MOD_RES (272)..(292): Any amino acid
  MOD_RES (305)..(315): Any amino acid
  MOD_RES (330)..(333): Any amino acid
  MOD_RES (343)..(430): Any amino acid
  MOD_RES (440)..(440): Any amino acid
  MOD_RES (451)..(533): Any amino acid
  MOD_RES (544)..(565): Any amino acid
  MOD_RES (585)..(632): Any amino acid
  MOD_RES (642)..(742): Any amino acid
  MOD_RES (753)..(767): Any amino acid
  MOD_RES (793)..(829): Any amino acid
XXXXHPTLLFLKVPVQXXXXXXXXXXXXXXXXXXXXXXXXXXXXXXXXXXXXXXXXXXXNTETGALQLNPIDGPLPVDNEPNGYAQXXXXLEAMAFLEDSHPGIFGNSCLETXXXXXXXXXXXXXXXXXXXXXXXXXXXXXXXXXXXXXXXXXXXXXXXXXXXXLIDFLKDVTXXXXXXXXGITTHFQRKRRVRDSMTXRMITQRTIGXXXXXXXXXSYIIRALTLNTXXXXXXXXXXXXXXXXXXXXXXXXXVYFVETLAKNICEKLEQSXXXXXXXXXXXXXXXXXXXXXTNSQDTEVSFTIXXXXXXXXXXXNQNPRIFLAMITYIXXXXPDWFRNVLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXLNLGQKRHTXTAYWWDGLQSXXXXXXXXXXXXXXXXXXXXXXXXXXXXXXXXXXXXXXXXXXXXXXXXXXXXXXXXXXXXXXXXXXXXXXXXXXXXXXXXXXXVTVIKNNMVNXXXXXXXXXXXXXXXXXXXXXXYRCHRGDAQIQTRRSFELRXXXXXXXXXXXXXXXXXXXXXXXXXXXXXXXXXXXXXXXXXXXXXXXXNPLNPFVGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXERMYQKCCNLXXXXXXXXXXXXXXXISSMVEAMMSRARIDARIDFESGRVXXXXXXXXXXXXXXXXXXXXXXXXXXXXXXXXXXXXX

SEQ ID NO: 419184 - protein, 829 aa, Influenza virus
  MOD_RES (1)..(4): Any amino acid
  MOD_RES (25)..(97): Any amino acid
  MOD_RES (107)..(186): Any amino acid
  MOD_RES (197)..(200): Any amino acid
  MOD_RES (213)..(256): Any amino acid
  MOD_RES (266)..(292): Any amino acid
  MOD_RES (302)..(315): Any amino acid
  MOD_RES (330)..(335): Any amino acid
  MOD_RES (349)..(634): Any amino acid
  MOD_RES (650)..(829): Any amino acid
XXXXNPTLLFLKMPPVQNAISTTFXXXXXXXXXXXXXXXXXXXXXXXXXXXXXXXXXXXXXXXXXXXXXXXXXXXXXXXXXXXXXXXXXXXXXXXXXEESHPGIFGXXXXXXXXXXXXXXXXXXXXXXXXXXXXXXXXXXXXXXXXXXXXXXXXXXXXXXXXXXXXXXXXXXXXXXXXXXXXXXXXFHRKRRVRDNXXXXMVTQRTMGKKKQXXXXXXXXXXXXXXXXXXXXXXXXXXXXXXXXXXXXXXXXXXXXVETLARRICXXXXXXXXXXXXXXXXXXXXXXXXXXXTSSQDTEISXXXXXXXXXXXXXXNQNPRVFLAMITYIXXXXXXWFRNILSIAPIMFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHPRGLLEVGTRWMKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419185 - protein, 829 aa, Influenza virus
  MOD_RES (1)..(4): Any amino acid
  MOD_RES (17)..(256): Any amino acid
  MOD_RES (266)..(315): Any amino acid
  MOD_RES (330)..(337): Any amino acid
  MOD_RES (349)..(829): Any amino acid
XXXXNPTLLFLEVPAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVETLARCICXXXXXXXXXXXXXXXXXXXXXXXXXXXXXXXXXXXXXXXXXXXXXXXXXXNQNPRVFLTMITYIXXXXXXXXRNALSIAPIMFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419186 - protein, 829 aa, Influenza virus
  MOD_RES (1)..(7): Any amino acid
  MOD_RES (17)..(256): Any amino acid
  MOD_RES (271)..(316): Any amino acid
  MOD_RES (327)..(829): Any amino acid
XXXXXXXLLFLKIPVQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVETLARNICEKLEQXXXXXXXXXXXXXXXXXXXXXXXXXXXXXXXXXXXXXXXXXXXXXXQSPRMFLAMIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419187 - protein, 829 aa, Influenza virus
  MOD_RES (1)..(8): Any amino acid
  MOD_RES (23)..(320): Any amino acid
  MOD_RES (330)..(829): Any amino acid
XXXXXXXXYFFLKVPVQNAISTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFLAMITYIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419188 - protein, 829 aa, Influenza virus
  MOD_RES (1)..(12): Any amino acid
  MOD_RES (23)..(829): Any amino acid
XXXXXXXXXXXXKIPVQNAISTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419189 - protein, 829 aa, Influenza virus
  MOD_RES (1)..(12): Any amino acid
  MOD_RES (25)..(829): Any amino acid
XXXXXXXXXXXXEVPAQNAISITFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419190 - protein, 780 aa, Influenza virus
  MOD_RES (18)..(18): Any amino acid
  MOD_RES (73)..(78): Any amino acid
  MOD_RES (91)..(101): Any amino acid
  MOD_RES (117)..(121): Any amino acid
  MOD_RES (132)..(139): Any amino acid
  MOD_RES (166)..(168): Any amino acid
  MOD_RES (197)..(210): Any amino acid
  MOD_RES (305)..(308): Any amino acid
  MOD_RES (351)..(353): Any amino acid
  MOD_RES (368)..(370): Any amino acid
  MOD_RES (381)..(381): Any amino acid
  MOD_RES (403)..(411): Any amino acid
  MOD_RES (459)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (674)..(674): Any amino acid
  MOD_RES (695)..(698): Any amino acid
  MOD_RES (778)..(780): Any amino acid
SKSRSNIFNMERIKELRXLMSQSRTREILTKTTVDHMAIIKKYTSGRQGRQEKNPALRMKWMMAMKYPITADXXXXXXIPERNEQGQTLWXXXXXXXXXXXMVSPLAVTWWNRNGPXXXXXHYPKVYKTYFXXXXXXXXGTFGPVHFRNQVKIRRRVDINPGHADXXXAKEAQDVIMEVVFPNEVGARILTSESQLXXXXXXXXXXXXXXIAPLMVAYMLERELVRKTRFLPVAGGTSSVYIEVLHLTQGTCWEQMYTPGGEVRNDDVDQSLIIAARNIVRRAAVSADPLASLLEMCHSTQIGGXXXXDILRQNPTEEQAVDICKAAMGLRISSSFSFGGFTFKRTSGSSXXXEEEVLTGNLQTLKIXXXEGYEEFTMVGXRATAILRKATRRLIQLIVSGRXXXXXXXXXIVAMVFSQEDCMIKAVRGDLNFVNRANQRLNPMHQLLRHFQKDAKVLXXXXXXXXXXXXXXXXXXXXXXXXXXXXXXXXXRVSKMGVDEYSSTERXVVSIDRFLRVRDQRGNVLLSPEEVSETQGTEKLTITYSSSMMWEINGPESVLVNTYQWIIRNWEXXKIQWSQDPTXLYNKMEFEPFQSLVPKAXRGQYSGFVRTLFQQMRDVLGTFDTVQIIKLLPFAAAPPEQSRMQFSSLTVNVRGSGMRILVRGNSPVFNYNKXTKRLTVLGKDAGAGALAEDPXXXXAGVESAVLRGFLILGKEDKRYGPPALSINELSNLAKGEKANVLIGQGDVVLVMKRKRDSSILTDSQTATKRIRMAINQCXXX

SEQ ID NO: 419191 - protein, 780 aa, Influenza virus
  MOD_RES (11)..(18): Any amino acid
  MOD_RES (57)..(57): Any amino acid
  MOD_RES (73)..(78): Any amino acid
  MOD_RES (91)..(101): Any amino acid
  MOD_RES (117)..(121): Any amino acid
  MOD_RES (132)..(139): Any amino acid
  MOD_RES (166)..(168): Any amino acid
  MOD_RES (178)..(179): Any amino acid
  MOD_RES (197)..(210): Any amino acid
  MOD_RES (221)..(225): Any amino acid
  MOD_RES (305)..(308): Any amino acid
  MOD_RES (351)..(353): Any amino acid
  MOD_RES (368)..(370): Any amino acid
  MOD_RES (381)..(381): Any amino acid
  MOD_RES (403)..(411): Any amino acid
  MOD_RES (430)..(434): Any amino acid
  MOD_RES (459)..(491): Any amino acid
  MOD_RES (507)..(507): Any amino acid
  MOD_RES (569)..(573): Any amino acid
  MOD_RES (583)..(583): Any amino acid
  MOD_RES (601)..(601): Any amino acid
  MOD_RES (674)..(674): Any amino acid
  MOD_RES (687)..(698): Any amino acid
SESRSNIFNMXXXXXXXXLMLQSRTREILTRTTVDHMAIIKRYTSYTSGRQEKNPAXRMKWMMAMRYPITADXXXXXXVPERNEQGQILWXXXXXXXXXXXMISPLAVTWWNRKGPXXXXXHYPKIYKTYFXXXXXXXXGTFGPVHFQNQVKIRRRVDTNPGHADXXXSKEAQDVIMXXVFPNEVGAKILTSESQLXXXXXXXXXXXXXXISPLMVAYMLXXXXXRKTRFLPVSGGTSSIYIEVLHLTQGACWEQLYTPGGEVKNDDVDQSLVIAARNIVRRATVSADPLASLLEMCHGTQIGGXXXXDILKQNPTEEQAVGICKAAMGLKISSSFSFGGFTFKRTKGSSXXXEEEMLTGNLQTLRIXXXEGYEEFTLVGXRATAILKKATRRLIQLIVSGKXXXXXXXXXVVAMVFSQEECMIKAVRGXXXXXNRANQRLNTMHQLLRHFQKNAKVLXXXXXXXXXXXXXXXXXXXXXXXXXXXXXXXXXRISKMGVDEYSNAERXIVSIDRFLRVKDQQGNVLLSPEEVSEAQGTERLTITYSSSLMWEINGPESVLINTYQWIIRXXXXXKIQWSQNPAXLYNKIEFEPFQSLIPKAXRSRYSGFVRTLFQQMRDILGTFDTTQIIKLLPFASAPPEQSRMQFSSLAVNVRGSGLRILVRGNSPAFNYNKXTKRLTILGKDAGXXXXXXXXXXXXSGVESAVLRGFLIIGKEDRRYGPPALSISELSNLTKGEKANVLIGQGDIVLVMKRKRNSSILTDSQTATKRLRMAINWGRIV

SEQ ID NO: 419192 - protein, 780 aa, Influenza virus
  MOD_RES (15)..(18): Any amino acid
  MOD_RES (34)..(37): Any amino acid
  MOD_RES (73)..(78): Any amino acid
  MOD_RES (91)..(101): Any amino acid
  MOD_RES (117)..(121): Any amino acid
  MOD_RES (132)..(139): Any amino acid
  MOD_RES (166)..(168): Any amino acid
  MOD_RES (178)..(182): Any amino acid
  MOD_RES (197)..(210): Any amino acid
  MOD_RES (221)..(225): Any amino acid
  MOD_RES (305)..(308): Any amino acid
  MOD_RES (336)..(338): Any amino acid
  MOD_RES (349)..(353): Any amino acid
  MOD_RES (368)..(370): Any amino acid
  MOD_RES (381)..(381): Any amino acid
  MOD_RES (403)..(413): Any amino acid
  MOD_RES (433)..(447): Any amino acid
  MOD_RES (459)..(491): Any amino acid
  MOD_RES (507)..(507): Any amino acid
  MOD_RES (572)..(573): Any amino acid
  MOD_RES (583)..(583): Any amino acid
  MOD_RES (601)..(601): Any amino acid
  MOD_RES (611)..(615): Any amino acid
  MOD_RES (674)..(674): Any amino acid
  MOD_RES (686)..(698): Any amino acid
  MOD_RES (742)..(765): Any amino acid
SKSRSIIFNMERIKXXXXLMSQSRTRGILTKTTXXXXAIIKKYTSARQGRQEKNPSLRMKWMMAMKYPITAEXXXXXXIPERNEHGQTLWXXXXXXXXXXXIVSPLAVTWWNRSGPXXXXXHYPKVYRTYFXXXXXXXXGIFGPVHFRNQIKIRRRVDINPGHSDXXXTKEAQDVIMXXXXXNEVGARIITSESQLXXXXXXXXXXXXXXIAPLMMAYMLXXXXXRKTRFLPVTGGTSSVYVEVLHLTQGTCWEQLYTPGGGVRNDDIDQSLIIAARSIVRRATVSADPLLSLLEMCHSTRIGGXXXXDILKHNPTEEQAVNICKAAMGMRISSSXXXGGFTFKRTNGXXXXXEEELLTGNLQTLKLXXXEGYEEFTIVGXRATAIIRKATRRLVQLIVSGRXXXXXXXXXXXAIVFSQEDCMVKAVRGDLNXXXXXXXXXXXXXXXLRHFQKDARVLXXXXXXXXXXXXXXXXXXXXXXXXXXXXXXXXXRVSKVGVDEYSSTEKXVVNIDRFLRVRDQQGNILLSPEEVSETQGIEKLTIIYSSSMMWEVNGPESVLVNTYQWVIRNWEXXKIQWSQNPTXLYNKVEFEPFQSLVPRAXRSQYSGFVRXXXXXMRDVIGTFDTAQIIKLLPFAAAPPKQSRMQFSSLTVSVRGSGMRILIRGNSPVFNYNRXTKRLTIIGKDAXXXXXXXXXXXXXTGVESAVLRGFLILGREDKRYGPPALSINELGNLARGEKANVLXXXXXXXXXXXXXXXXXXXXXXXXATKRIRMATNECRII

SEQ ID NO: 419193 - protein, 780 aa, Influenza virus
  MOD_RES (1)..(23): Any amino acid
  MOD_RES (40)..(40): Any amino acid
  MOD_RES (57)..(63): Any amino acid
  MOD_RES (73)..(81): Any amino acid
  MOD_RES (91)..(101): Any amino acid
  MOD_RES (111)..(121): Any amino acid
  MOD_RES (132)..(139): Any amino acid
  MOD_RES (150)..(150): Any amino acid
  MOD_RES (166)..(168): Any amino acid
  MOD_RES (178)..(184): Any amino acid
  MOD_RES (197)..(229): Any amino acid
  MOD_RES (247)..(253): Any amino acid
  MOD_RES (273)..(275): Any amino acid
  MOD_RES (293)..(308): Any amino acid
  MOD_RES (318)..(319): Any amino acid
  MOD_RES (337)..(340): Any amino acid
  MOD_RES (351)..(355): Any amino acid
  MOD_RES (368)..(370): Any amino acid
  MOD_RES (381)..(381): Any amino acid
  MOD_RES (400)..(414): Any amino acid
  MOD_RES (424)..(448): Any amino acid
  MOD_RES (459)..(491): Any amino acid
  MOD_RES (505)..(507): Any amino acid
  MOD_RES (572)..(573): Any amino acid
  MOD_RES (583)..(583): Any amino acid
  MOD_RES (596)..(601): Any amino acid
  MOD_RES (613)..(620): Any amino acid
  MOD_RES (674)..(674): Any amino acid
  MOD_RES (685)..(698): Any amino acid
  MOD_RES (722)..(722): Any amino acid
  MOD_RES (741)..(765): Any amino acid
  MOD_RES (775)..(780): Any amino acid
XXXXXXXXXXXXXXXXXXXXXXXRTREILTKITVDHMAIXGHNQEYTSGRQEKNPSXXXXXXXAMKYPITANXXXXXXXXXRNEQGQALWXXXXXXXXXXXMVSPLAITWXXXXXXXXXXXHYSKVYKTYFXXXXXXXXGAFGPVHFRNXVKIRRRVDVNPGHADXXXVKEAQDVIMXXXXXXXVGARILASESQLXXXXXXXXXXXXXXXXXXXXXXXXXXXXXXXXXFLPVAGGTGSVYIEVLHXXXXXXXEQMYTPGGGVKNDDIDQSLXXXARNIVRRAIVSADPLASXXXXXXXXXXXXXXXXDILRQNPSEXXAVDICKAAIGLRISSSFXXXXFTFKRTKGFSXXXXXEVLTGNLQALKIXXXEGFEEFTMVGXKATAILRKATKRLIQLIVXXXXXXXXXXXXXXXMVFSQEDCVXXXXXXXXXXXXXXXXXXXXXXXXXRHFQKDAKILXXXXXXXXXXXXXXXXXXXXXXXXXXXXXXXXXRVSKTGVDEYSSTXXXAVSIDRFLRVRDQLGNILLSPEEVSETQGMEKLTITYSSPMMWEINGPDSVLVNTYQWIIKNWEXXKIQWSQNPSXLYNKLEFEPFQSXXXXXXRSLYSGFVRTLXXXXXXXXGTFDTIQIIKLLPFAAAPPVQSRMQFSSLTVNVRGTGMRILVRGNSPIFNYNKXTRRLTVLGKDXXXXXXXXXXXXXXGGVESAVLRGFLILGKENKRYGPXALSINELSSIAKGEKANVXXXXXXXXXXXXXXXXXXXXXXXXXATKRIRLAIXXXXXX

SEQ ID NO: 419194 - protein, 780 aa, Influenza virus
  MOD_RES (1)..(43): Any amino acid
  MOD_RES (54)..(81): Any amino acid
  MOD_RES (91)..(121): Any amino acid
  MOD_RES (132)..(140): Any amino acid
  MOD_RES (166)..(187): Any amino acid
  MOD_RES (197)..(235): Any amino acid
  MOD_RES (247)..(253): Any amino acid
  MOD_RES (275)..(282): Any amino acid
  MOD_RES (296)..(313): Any amino acid
  MOD_RES (337)..(340): Any amino acid
  MOD_RES (351)..(358): Any amino acid
  MOD_RES (368)..(370): Any amino acid
  MOD_RES (380)..(381): Any amino acid
  MOD_RES (403)..(415): Any amino acid
  MOD_RES (432)..(448): Any amino acid
  MOD_RES (459)..(491): Any amino acid
  MOD_RES (507)..(507): Any amino acid
  MOD_RES (524)..(528): Any amino acid
  MOD_RES (539)..(573): Any amino acid
  MOD_RES (583)..(601): Any amino acid
  MOD_RES (611)..(620): Any amino acid
  MOD_RES (671)..(674): Any amino acid
  MOD_RES (685)..(708): Any amino acid
  MOD_RES (732)..(768): Any amino acid
  MOD_RES (778)..(780): Any amino acid
XXXXXXXXXXXXXXXXXXXXXXXXXXXXXXXXXXXXXXXXXXXKKYTSGRQEKXXXXXXXXXXXXXXXXXXXXXXXXXXXXRNEQGQMLWXXXXXXXXXXXXXXXXXXXXXXXXXXXXXXXHYPKVYKPYFXXXXXXXXXTFGPVHFRSQVKIRRRVDMNPGHADXXXXXXXXXXXXXXXXXXXXXXRILTSESQMXXXXXXXXXXXXXXXXXXXXXXXXXXXXXXXXXXXXXXXGTGSIYIEVLHXXXXXXXEQMYTPGGKVRNDEVDQSLIIXXXXXXXXATVSADPLVSLLEXXXXXXXXXXXXXXXXXXNPTEEQAVEICKAALGLRISSSFXXXXFTFKRTSGTSXXXXXXXXTGNLQTLKVXXXEGYEEFTMIXXRATAIFRKATRRMIQLIVSGRXXXXXXXXXXXXXVFSQEDCMMKAVRGDLXXXXXXXXXXXXXXXXXRHFQKDAKMLXXXXXXXXXXXXXXXXXXXXXXXXXXXXXXXXXRVSRMGVDEYSSAERXTVSIDRFLRVRDQMGNXXXXXEEISETQGTEXXXXXXXXXXXXXXXXXXXXXXXXXXXXXXXXXXXKIQWSQEPTXXXXXXXXXXXXXXXXXXXRCQYSGFVRXXXXXXXXXXGTFDTVQVIKLLPFAAAPPVQSKMQFSSLTVNVRGSGLRILIRGNSPIFNXXXXTKRLAVLGKDXXXXXXXXXXXXXXXXXXXXXXXXFLILGKEDRKRYGPALSINELSKXXXXXXXXXXXXXXXXXXXXXXXXXXXXXXXXXXXXXRIRMAINYSXXX

SEQ ID NO: 419195 - protein, 780 aa, Influenza virus
  MOD_RES (1)..(43): Any amino acid
  MOD_RES (58)..(256): Any amino acid
  MOD_RES (267)..(319): Any amino acid
  MOD_RES (330)..(388): Any amino acid
  MOD_RES (402)..(416): Any amino acid
  MOD_RES (431)..(497): Any amino acid
  MOD_RES (507)..(520): Any amino acid
  MOD_RES (530)..(637): Any amino acid
  MOD_RES (649)..(658): Any amino acid
  MOD_RES (668)..(712): Any amino acid
  MOD_RES (722)..(768): Any amino acid
  MOD_RES (778)..(780): Any amino acid
XXXXXXXXXXXXXXXXXXXXXXXXXXXXXXXXXXXXXXXXXXXKKYTSARQEKNPALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYTPGGEVINDXXXXXXXXXXXXXXXXXXXXXXXXXXXXXXXXXXXXXXXXXXXXXXXXXXXXXAVDICKAALGXXXXXXXXXXXXXXXXXXXXXXXXXXXXXXXXXXXXXXXXXXXXXXXXXXXXXXXXXXXKATRKLIQLIVSGXXXXXXXXXXXXXXXFSQEDRMIKAVRGDXXXXXXXXXXXXXXXXXXXXXXXXXXXXXXXXXXXXXXXXXXXXXXXXXXXXXXXXXXXXXXXXXXXVDEYSNAEKXXXXXXXXXXXXXXRGNILLSPEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPPEQSKMQFSSXXXXXXXXXXRVLIRGNSPXXXXXXXXXXXXXXXXXXXXXXXXXXXXXXXXXXXXXXXXXXXXXGKENKKYGPXXXXXXXXXXXXXXXXXXXXXXXXXXXXXXXXXXXXXXXXXXXXXXXRIRMAINLVXXX

SEQ ID NO: 419196 - protein, 780 aa, Influenza virus
  MOD_RES (1)..(262): Any amino acid
  MOD_RES (273)..(393): Any amino acid
  MOD_RES (403)..(640): Any amino acid
  MOD_RES (651)..(713): Any amino acid
  MOD_RES (730)..(768): Any amino acid
  MOD_RES (779)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKNDEVDQSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLVQLIVSGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQNRMQFSSLTXXXXXXXXXXXXXXXXXXXXXXXXXXXXXXXXXXXXXXXXXXXXXXXXXXXXXXXXXXXXXXXQKKDKRYGPALSISELXXXXXXXXXXXXXXXXXXXXXXXXXXXXXXXXXXXXXXXRIRMAINWGRXX

SEQ ID NO: 419197 - protein, 780 aa, Influenza virus
  MOD_RES (1)..(714): Any amino acid
  MOD_RES (725)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEDKRYGPALXXXXXXXXXXXXXXXXXXXXXXXXXXXXXXXXXXXXXXXXXXXXXXXXXXXXXXXX

SEQ ID NO: 419198 - protein, 780 aa, Influenza virus
  MOD_RES (1)..(714): Any amino acid
  MOD_RES (727)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEDRRYGPALSIXXXXXXXXXXXXXXXXXXXXXXXXXXXXXXXXXXXXXXXXXXXXXXXXXXXXXX

SEQ ID NO: 419199 - protein, 780 aa, Influenza virus
  MOD_RES (1)..(714): Any amino acid
  MOD_RES (724)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXREDKRYGPAXXXXXXXXXXXXXXXXXXXXXXXXXXXXXXXXXXXXXXXXXXXXXXXXXXXXXXXXX

SEQ ID NO: 419200 - protein, 780 aa, Influenza virus
  MOD_RES (1)..(714): Any amino acid
  MOD_RES (726)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKENKRYGPALSXXXXXXXXXXXXXXXXXXXXXXXXXXXXXXXXXXXXXXXXXXXXXXXXXXXXXXX

SEQ ID NO: 419201 - protein, 780 aa, Influenza virus
  MOD_RES (1)..(714): Any amino acid
  MOD_RES (728)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKENKKYGPALSINXXXXXXXXXXXXXXXXXXXXXXXXXXXXXXXXXXXXXXXXXXXXXXXXXXXXX

SEQ ID NO: 419202 - protein, 742 aa, Influenza virus
  MOD_RES (12)..(14): Any amino acid
  MOD_RES (26)..(31): Any amino acid
  MOD_RES (48)..(74): Any amino acid
  MOD_RES (96)..(154): Any amino acid
  MOD_RES (166)..(223): Any amino acid
  MOD_RES (244)..(280): Any amino acid
  MOD_RES (291)..(298): Any amino acid
  MOD_RES (313)..(341): Any amino acid
  MOD_RES (359)..(369): Any amino acid
  MOD_RES (389)..(393): Any amino acid
  MOD_RES (404)..(422): Any amino acid
  MOD_RES (472)..(477): Any amino acid
  MOD_RES (491)..(496): Any amino acid
  MOD_RES (508)..(641): Any amino acid
  MOD_RES (660)..(681): Any amino acid
  MOD_RES (697)..(716): Any amino acid
  MOD_RES (727)..(731): Any amino acid
KQGKTKATKMKXXXIFIFILLTHWAXXXXXXSQITNGTTGNPIICLGXXXXXXXXXXXXXXXXXXXXXXXXXXXGVIPLTTTPTKSYFANLKGTRXXXXXXXXXXXXXXXXXXXXXXXXXXXXXXXXXXXXXXXXXXXXXXXXXXXXXXXXXXXIMHDRTKIRQLXXXXXXXXXXXXXXXXXXXXXXXXXXXXXXXXXXXXXXXXXXXXXXXXXXXXXXXXXXEKENSYPMINLTVEVPYVCTXXXXXXXXXXXXXXXXXXXXXXXXXXXXXXXXXXXXXGVTTHYVSQIXXXXXXXXDEGLPQSGRIVVDYXXXXXXXXXXXXXXXXXXXXXXXXXXXXXAPSGIEYNGKSLGIQSDXXXXXXXXXXXPSVKLPMGAIGAIDSSMPFXXXXXGEHAKAIGNCXXXXXXXXXXXXXXXXXXXPAKLLKERGFFGARRQKRGLFGAIAHMRKKRGLFGAIRMTRGLFGAIAGXXXXXXLFGAIAGFIEGGWXXXXXXGRLVRFRHQNSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPTFDSLNITAASLNDDGXXXXXXXXXXXXXXXXXXXXXXVTTRQASPSCLVVRKXXXXXXXXXXXXXXXXXXXXSGSLQCRICIXXXXXILDQNFRNIRK

SEQ ID NO: 419203 - protein, 742 aa, Influenza virus
  MOD_RES (1)..(1): Any amino acid
  MOD_RES (12)..(14): Any amino acid
  MOD_RES (26)..(40): Any amino acid
  MOD_RES (51)..(223): Any amino acid
  MOD_RES (234)..(341): Any amino acid
  MOD_RES (356)..(378): Any amino acid
  MOD_RES (389)..(422): Any amino acid
  MOD_RES (471)..(477): Any amino acid
  MOD_RES (491)..(688): Any amino acid
  MOD_RES (705)..(716): Any amino acid
  MOD_RES (727)..(731): Any amino acid
XQGKTKATKMEXXXIFIFLLLTHWAXXXXXXXXXXXXXXXNNNNNTATLCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKENSYPKINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAPSGVEYNGKSLGIXXXXXXXXXXXXXXXXXXXXXXXYGGLNKSKPYXXXXXXXXXXXXXXXXXXXXXXXXXXXXXXXXXXIPIGERGLFGKKKRGLFGAIKQLTHHMRKKRGLFGAKRETRGLFGAIAXXXXXXXIFGAIAGFIENGWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPSTGNHGSLVLSLWXXXXXXXXXXXXHSCLQCRICIXXXXXIDFRDMRKNTL

SEQ ID NO: 419204 - protein, 742 aa, Influenza virus
  MOD_RES (1)..(14): Any amino acid
  MOD_RES (26)..(43): Any amino acid
  MOD_RES (54)..(223): Any amino acid
  MOD_RES (234)..(341): Any amino acid
  MOD_RES (352)..(383): Any amino acid
  MOD_RES (396)..(424): Any amino acid
  MOD_RES (452)..(459): Any amino acid
  MOD_RES (471)..(716): Any amino acid
  MOD_RES (727)..(731): Any amino acid
  MOD_RES (742)..(742): Any amino acid
XXXXXXXXXXXXXXIFNFILLTHWAXXXXXXXXXXXXXXXXXXNNSTATLCLGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNNKNATNPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNNNKGAVFKSXXXXXXXXXXXXXXXXXXXXXXXXXXXXXXXXTSLTSLPFQNIHXXXXXXXXXXXXXXXXXXXXXXXXXXXXXREREGGRRRKRGLFGATHKQLTHHMRKXXXXXXXXRKTRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHGSLQCRICIXXXXXIRFVNSDCSKX

SEQ ID NO: 419205 - protein, 742 aa, Influenza virus
  MOD_RES (1)..(17): Any amino acid
  MOD_RES (28)..(43): Any amino acid
  MOD_RES (54)..(430): Any amino acid
  MOD_RES (451)..(459): Any amino acid
  MOD_RES (480)..(716): Any amino acid
  MOD_RES (727)..(742): Any amino acid
XXXXXXXXXXXXXXXXXRFSYVFCLALXXXXXXXXXXXXXXXXSDNADKICLGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRKKRGLFGAAHKQLTHHMRXXXXXXXXXQMTRGLFGAIGLFGAIAGFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMVLLQCRICIXXXXXXXXXXXXXXXX

SEQ ID NO: 419206 - protein, 742 aa, Influenza virus
  MOD_RES (1)..(17): Any amino acid
  MOD_RES (28)..(430): Any amino acid
  MOD_RES (451)..(461): Any amino acid
  MOD_RES (472)..(718): Any amino acid
  MOD_RES (734)..(742): Any amino acid
XXXXXXXXXXXXXXXXXVLSCIFCLAFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRKRGLFGAIIHKQLTHHMRXXXXXXXXXXXPRGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLCSVEYASKTRISEIXXXXXXXXX

SEQ ID NO: 419207 - protein, 742 aa, Influenza virus
  MOD_RES (1)..(430): Any amino acid
  MOD_RES (441)..(461): Any amino acid
  MOD_RES (472)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRKKRGLFGAXXXXXXXXXXXXXXXXXXXXXKRGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419208 - protein, 742 aa, Influenza virus
  MOD_RES (1)..(430): Any amino acid
  MOD_RES (441)..(461): Any amino acid
  MOD_RES (472)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRKRRGLFGAXXXXXXXXXXXXXXXXXXXXXARGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419209 - protein, 742 aa, Influenza virus
  MOD_RES (1)..(434): Any amino acid
  MOD_RES (448)..(462): Any amino acid
  MOD_RES (479)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRRKKRGLFGAIAXXXXXXXXXXXXXXXTKPRPRRGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419210 - protein, 742 aa, Influenza virus
  MOD_RES (1)..(434): Any amino acid
  MOD_RES (445)..(468): Any amino acid
  MOD_RES (480)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRRQKRGLFGXXXXXXXXXXXXXXXXXXXXXXXXRGIFGAIAGFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419211 - protein, 742 aa, Influenza virus
  MOD_RES (1)..(468): Any amino acid
  MOD_RES (479)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419212 - protein, 694 aa, Influenza virus
  MOD_RES (32)..(76): Any amino acid
  MOD_RES (89)..(410): Any amino acid
  MOD_RES (422)..(425): Any amino acid
  MOD_RES (436)..(441): Any amino acid
  MOD_RES (452)..(453): Any amino acid
  MOD_RES (464)..(473): Any amino acid
  MOD_RES (484)..(546): Any amino acid
  MOD_RES (558)..(659): Any amino acid
  MOD_RES (688)..(694): Any amino acid
IGLREQKQEFKMNPNKKIITRDITIGSICMVXXXXXXXXXXXXXXXXXXXXXXXXXXXXXXXXXXXXXXXXXXXXXVPLVPCEPIIIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRKGLILEYYSXXXXGKKGKWLNQSXXXXXXIQHLEECSCYXXSYPNVRCVCRXXXXXXXXXXKLDINMADYSXXXXXXXXXXXXXXXXXXXXXXXXXXXXXXXXXXXXXXXXXXXXXXXXXXXXXXXXXXXXXXXNNYGVKGFGFRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFLWCKIVTTVGWSWPDGRTSISCLYKLXXXXXXX

SEQ ID NO: 419213 - protein, 694 aa, Influenza virus
  MOD_RES (21)..(410): Any amino acid
  MOD_RES (422)..(425): Any amino acid
  MOD_RES (436)..(441): Any amino acid
  MOD_RES (452)..(453): Any amino acid
  MOD_RES (464)..(546): Any amino acid
  MOD_RES (557)..(683): Any amino acid
LVFREQKQEFKMNPNQKIITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIREGLILEYYFXXXXGKRGKWVKSVXXXXXXIKHLEECSCYXXSYLNVRCVCRXXXXXXXXXXXXXXXXXXXXXXXXXXXXXXXXXXXXXXXXXXXXXXXXXXXXXXXXXXXXXXXXXXXXXXXXXXXXXXXXXXXDNYGVKGFGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLHAYISFRNL

SEQ ID NO: 419214 - protein, 694 aa, Influenza virus
  MOD_RES (1)..(1): Any amino acid
  MOD_RES (28)..(411): Any amino acid
  MOD_RES (422)..(425): Any amino acid
  MOD_RES (436)..(441): Any amino acid
  MOD_RES (452)..(694): Any amino acid
XFSGSQKQEFKMNPNQKIIIAIGSVSRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMGQASYKIFXXXXEKGKVVKSVEXXXXXXVQHLEECSCYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419215 - protein, 694 aa, Influenza virus
  MOD_RES (1)..(5): Any amino acid
  MOD_RES (21)..(417): Any amino acid
  MOD_RES (429)..(441): Any amino acid
  MOD_RES (452)..(694): Any amino acid
XXXXXQKQEIKMNPNQKIMTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYKYKIFKNGKKXXXXXXXXXXXXXIRHLEECSCYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419216 - protein, 694 aa, Influenza virus
  MOD_RES (1)..(5): Any amino acid
  MOD_RES (30)..(694): Any amino acid
XXXXXAKAGVKMNPNQKIINRDITIGSICXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419217 - protein, 694 aa, Influenza virus
  MOD_RES (1)..(9): Any amino acid
  MOD_RES (20)..(694): Any amino acid
XXXXXXXXXIKMNPNQKIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419218 - protein, 502 aa, Influenza virus
  MOD_RES (31)..(43): Any amino acid
  MOD_RES (54)..(115): Any amino acid
  MOD_RES (141)..(141): Any amino acid
  MOD_RES (165)..(165): Any amino acid
  MOD_RES (229)..(237): Any amino acid
  MOD_RES (249)..(249): Any amino acid
  MOD_RES (273)..(276): Any amino acid
  MOD_RES (287)..(289): Any amino acid
  MOD_RES (305)..(308): Any amino acid
  MOD_RES (326)..(333): Any amino acid
  MOD_RES (347)..(371): Any amino acid
  MOD_RES (385)..(389): Any amino acid
  MOD_RES (401)..(416): Any amino acid
  MOD_RES (452)..(454): Any amino acid
  MOD_RES (471)..(472): Any amino acid
  MOD_RES (496)..(502): Any amino acid
IGLREQKQEFKMNPNKKIITDITIGSICMVXXXXXXXXXXXXXDLNMGQPFYSXXXXXXXXXXXXXXXXXXXXXXXXXXXXXXXXXXXXXXXXXXXXXXXXXXXXXXXXXXXXXXSKDNSIRIGSKGDVFVIREPFISCSXLECRTFFLTQGALLNDKHSNGTIXDRSPYRTLMSCPIGEVPSPYNSRFESVAWSASACHDGINWLTIGISGPDNGAVAVLKYNGIITXXXXXXXXXILRTQESECACXNGSCFTVMTDGPSVMGQASYKIFXXXXGKKGKWLNQSXXXAPNYHYEECSCYPDSXXXXCVCRDNWHGSNRPWVSFXXXXXXXXGYICSGVFGDNPRXXXXXXXXXXXXXXXXXXXXXXXXXKYGNGVWIGRTKSXXXXXGFEMIWDPNGWXXXXXXXXXXXXXXXXTDWSGYSGSFVQHPELTGLDCIRPCFWVELIRGRPXXXTTIWTSGSSISFCGVNXXIFLWCKIVTTVGWSWPDGAELPFXXXXXXX

SEQ ID NO: 419219 - protein, 502 aa, Influenza virus
  MOD_RES (21)..(43): Any amino acid
  MOD_RES (54)..(115): Any amino acid
  MOD_RES (141)..(141): Any amino acid
  MOD_RES (165)..(165): Any amino acid
  MOD_RES (191)..(193): Any amino acid
  MOD_RES (229)..(237): Any amino acid
  MOD_RES (249)..(249): Any amino acid
  MOD_RES (263)..(268): Any amino acid
  MOD_RES (280)..(289): Any amino acid
  MOD_RES (305)..(308): Any amino acid
  MOD_RES (326)..(333): Any amino acid
  MOD_RES (347)..(371): Any amino acid
  MOD_RES (385)..(389): Any amino acid
  MOD_RES (401)..(416): Any amino acid
  MOD_RES (452)..(454): Any amino acid
  MOD_RES (471)..(484): Any amino acid
  MOD_RES (496)..(502): Any amino acid
LVFREQKQEFKMNPNQKIITXXXXXXXXXXXXXXXXXXXXXXXASQYGPSHSIXXXXXXXXXXXXXXXXXXXXXXXXXXXXXXXXXXXXXXXXXXXXXXXXXXXXXXXXXXXXXXTKDNSIRIGSRGDVFVMREPFISCSXLECKTFFLTQGALLNDRHSNGTVXDRSPYRALMSCPVGEAPSPYNSRFEXXXWSASACHDGMSWLTIGISGPDDGAVAVLKYKGIITXXXXXXXXXILRTQESECVCXNGSCFTIMTDGPSXXXXXXYKYKIFKNGKKXXXXXXXXXXAPNFHYEECSCYPESXXXXCVCRDNWHASNRPWVSFXXXXXXXXGYICSGIFGDNPRXXXXXXXXXXXXXXXXXXXXXXXXXRYGNGVWIGRTKNXXXXXGFEMIWDPDGWXXXXXXXXXXXXXXXXNEWSGYSGSFVQHPELTGMNCIRPCFWVELVRGLPXXXATIWTSGSSISFCGVDXXXXXXXXXXXXXXWSWPDGADLPFXXXXXXX

SEQ ID NO: 419220 - protein, 502 aa, Influenza virus
  MOD_RES (1)..(1): Any amino acid
  MOD_RES (21)..(115): Any amino acid
  MOD_RES (141)..(141): Any amino acid
  MOD_RES (152)..(152): Any amino acid
  MOD_RES (165)..(165): Any amino acid
  MOD_RES (229)..(237): Any amino acid
  MOD_RES (249)..(249): Any amino acid
  MOD_RES (263)..(276): Any amino acid
  MOD_RES (287)..(289): Any amino acid
  MOD_RES (305)..(313): Any amino acid
  MOD_RES (326)..(334): Any amino acid
  MOD_RES (347)..(371): Any amino acid
  MOD_RES (384)..(389): Any amino acid
  MOD_RES (401)..(416): Any amino acid
  MOD_RES (452)..(455): Any amino acid
  MOD_RES (471)..(484): Any amino acid
  MOD_RES (496)..(502): Any amino acid
XFSGSQKQEFKMNPNQKIIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKDNSVRIGSKGDVFVVREPFISCSXMECRTFFLTQXSLLNDKHSNGTVXDRSPHRTLMSCPLGEAPSPYNSKFESVAWSASACHDGTGWLTIGISGPDNEAVAVLKYNGMITXXXXXXXXXIMRTQESECACXNGSCFTVLTDGPSXXXXXXXXXXXXXXGKRGKWVKSVXXXAPNFYYEECSCYPDTXXXXXXXXXNWHASNRPWISFXXXXXXXXXYICSGVFGDSPRXXXXXXXXXXXXXXXXXXXXXXXXXKYDNGVWIGRTKXXXXXXGFEMVWDPNGWXXXXXXXXXXXXXXXXNDWSGYSGSFIQHPELTGLNCMRPCFWVELIRGQPXXXXTIWASGSSISFCGVSXXXXXXXXXXXXXXWSWPDGAEVPFXXXXXXX

SEQ ID NO: 419221 - protein, 502 aa, Influenza virus
  MOD_RES (1)..(5): Any amino acid
  MOD_RES (21)..(115): Any amino acid
  MOD_RES (137)..(141): Any amino acid
  MOD_RES (152)..(154): Any amino acid
  MOD_RES (165)..(165): Any amino acid
  MOD_RES (188)..(193): Any amino acid
  MOD_RES (226)..(249): Any amino acid
  MOD_RES (263)..(276): Any amino acid
  MOD_RES (287)..(289): Any amino acid
  MOD_RES (305)..(313): Any amino acid
  MOD_RES (326)..(334): Any amino acid
  MOD_RES (347)..(371): Any amino acid
  MOD_RES (385)..(416): Any amino acid
  MOD_RES (427)..(427): Any amino acid
  MOD_RES (452)..(455): Any amino acid
  MOD_RES (467)..(484): Any amino acid
  MOD_RES (496)..(502): Any amino acid
XXXXXQKQEIKMNPNQKIMTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKDNGIRIGSKGDIFVIREPFXXXXXSECRTFFLTQXXXLNDKHSNGTAXDRSPHRALMSCPIGEAPSPYNSXXXXXXWSASACHDGLGWITIGISGPDSGAVAVLKYNDXXXXXXXXXXXXXXXXXXXXXXXXNGFCFTVMTDGPNXXXXXXXXXXXXXXEKGKVVKSVEXXXAPNSHYEECSCYPDAXXXXXXXXXNWHGANRPWVSFXXXXXXXXXYICSGVLGDNPRXXXXXXXXXXXXXXXXXXXXXXXXXKYGNGVWMGRTKSXXXXXXXXXXXXXXXXXXXXXXXXXXXXXXXXTNWSGYSGSFXQHPELTGMDCMRPCFWVELVRGRPXXXXTVWTSGSSISFXXXXXXXXXXXXXXXXXXWSWPDDAELPFXXXXXXX

SEQ ID NO: 419222 - protein, 502 aa, Influenza virus
  MOD_RES (1)..(9): Any amino acid
  MOD_RES (30)..(115): Any amino acid
  MOD_RES (137)..(141): Any amino acid
  MOD_RES (152)..(154): Any amino acid
  MOD_RES (165)..(165): Any amino acid
  MOD_RES (176)..(177): Any amino acid
  MOD_RES (188)..(193): Any amino acid
  MOD_RES (229)..(249): Any amino acid
  MOD_RES (262)..(289): Any amino acid
  MOD_RES (303)..(371): Any amino acid
  MOD_RES (385)..(435): Any amino acid
  MOD_RES (449)..(455): Any amino acid
  MOD_RES (471)..(485): Any amino acid
  MOD_RES (496)..(502): Any amino acid
XXXXXXXXXIKMNPNQKIIRDITIGSICMXXXXXXXXXXXXXXXXXXXXXXXXXXXXXXXXXXXXXXXXXXXXXXXXXXXXXXXXXXXXXXXXXXXXXXXXXXXXXXXXXXXXXXSKDNNIRIGSKGDIFVMREPFXXXXXFECRTFFLTQXXXLNDRHSNGTIXDRSPFRALMSXXVGEVPSPYNSXXXXXXWSASACHDGVSWLTIGVSGPDNGAVAVVKYNGIITXXXXXXXXXXXXXXXXXXXXXNGSCFTLMTDGPXXXXXXXXXXXXXXXXXXXXXXXXXXXXAPNYYYEECSCYPXXXXXXXXXXXXXXXXXXXXXXXXXXXXXXXXXXXXXXXXXXXXXXXXXXXXXXXXXXXXXXXXXXXXXKYGDGVWIGRTKSXXXXXXXXXXXXXXXXXXXXXXXXXXXXXXXXXXXXXXXXXXXXXXXXXXXNCIKPCFWVELIRXXXXXXXTIWTSGSIISFCGVNXXXXXXXXXXXXXXXSWPDGAKLPFXXXXXXX

SEQ ID NO: 419223 - protein, 502 aa, Influenza virus
  MOD_RES (1)..(18): Any amino acid
  MOD_RES (29)..(129): Any amino acid
  MOD_RES (140)..(218): Any amino acid
  MOD_RES (229)..(252): Any amino acid
  MOD_RES (263)..(455): Any amino acid
  MOD_RES (471)..(502): Any amino acid
XXXXXXXXXXXXXXXXXXNRDITIGSICXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFIIREPFISCXXXXXXXXXXXXXXXXXXXXXXXXXXXXXXXXXXXXXXXXXXXXXXXXXXXXXXXXXXXXXXXXXXXXXXXXXXXXXXXAVLKYNGVITXXXXXXXXXXXXXXXXXXXXXXXXCFTIMTDGPNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTIWTSASSISFCGVNXXXXXXXXXXXXXXXXXXXXXXXXXXXXXXXX

SEQ ID NO: 419224 - protein, 494 aa, Influenza virus
  MOD_RES (16)..(53): Any amino acid
  MOD_RES (64)..(71): Any amino acid
  MOD_RES (82)..(85): Any amino acid
  MOD_RES (97)..(109): Any amino acid
  MOD_RES (127)..(127): Any amino acid
  MOD_RES (139)..(141): Any amino acid
  MOD_RES (155)..(167): Any amino acid
  MOD_RES (206)..(234): Any amino acid
  MOD_RES (249)..(250): Any amino acid
  MOD_RES (272)..(285): Any amino acid
  MOD_RES (330)..(333): Any amino acid
  MOD_RES (347)..(421): Any amino acid
  MOD_RES (432)..(434): Any amino acid
  MOD_RES (449)..(455): Any amino acid
AKAGVKMNPNQKIITXXXXXXXXXXXXXXXXXXXXXXXXXXXXXXXXXXXXXXKNNQVILCEPXXXXXXXXKTVVHLNSTTXXXXEKEKEICSVVLXXXXXXXXXXXXXGFAPFSKDNSIRLSAGGXIWVTREPYVSCXXXKCYQFALGQGTTLXXXXXXXXXXXXXPYRTLLMNELGVPFHLGTKQVCIAWSSSSCHDGKAWLHXXXXXXXXXXXXXXXXXXXXXXXXXXXXXNILRTQESECVCINXXCTVVMTDGSASRKGLILEYYSXXXXXXXXXXXXXXGSAQHVEECSCYPRSYPNVRCVCRDNWKGSNRPIKLDINMADYSXXXXYVCSGLVGDTPRKXXXXXXXXXXXXXXXXXXXXXXXXXXXXXXXXXXXXXXXXXXXXXXXXXXXXXXXXXXXXXXXXXXXXXXXXXXXSGYSGIFSVEXXXCINRCFYVELIRGRXXXXXXXWTSNSIVVFCGTSGTYGTGSWPDGAADINLHAYISFRNL

SEQ ID NO: 419225 - protein, 494 aa, Influenza virus
  MOD_RES (1)..(12): Any amino acid
  MOD_RES (23)..(53): Any amino acid
  MOD_RES (64)..(109): Any amino acid
  MOD_RES (127)..(127): Any amino acid
  MOD_RES (139)..(141): Any amino acid
  MOD_RES (152)..(167): Any amino acid
  MOD_RES (206)..(234): Any amino acid
  MOD_RES (249)..(250): Any amino acid
  MOD_RES (272)..(285): Any amino acid
  MOD_RES (320)..(333): Any amino acid
  MOD_RES (347)..(421): Any amino acid
  MOD_RES (432)..(434): Any amino acid
  MOD_RES (449)..(455): Any amino acid
  MOD_RES (493)..(494): Any amino acid
XXXXXXXXXXXXIIIAIGSVSRXXXXXXXXXXXXXXXXXXXXXXXXXXXXXXXKNNQVILCGPXXXXXXXXXXXXXXXXXXXXXXXXXXXXXXXXXXXXXXXXXXXXXXGFAPFAKDNSIRLSASGXIWITREPYVSCXXXRCYQFALGQGXXXXXXXXXXXXXXXXPHRTLLMNELGIPFHLGTKQVCMAWSSSSCHDGRAWLHXXXXXXXXXXXXXXXXXXXXXXXXXXXXXKILRTQESECICINXXCAVVMTDGSASREGLILEYYFXXXXXXXXXXXXXXGSAQHIEECSCYPRSYLNVRCVCRDNWRGSNRPVXXXXXXXXXXXXXXYLCSGLVGDTPRNXXXXXXXXXXXXXXXXXXXXXXXXXXXXXXXXXXXXXXXXXXXXXXXXXXXXXXXXXXXXXXXXXXXXXXXXXXXSGYSGVFSVEXXXCVNRCFYVELIRGSXXXXXXXWTSNSIIVFCGTSGTYGSGSWPDGATSISCLYKLSQFXX

SEQ ID NO: 419226 - protein, 494 aa, Influenza virus
  MOD_RES (1)..(53): Any amino acid
  MOD_RES (64)..(109): Any amino acid
  MOD_RES (127)..(127): Any amino acid
  MOD_RES (139)..(141): Any amino acid
  MOD_RES (152)..(167): Any amino acid
  MOD_RES (206)..(234): Any amino acid
  MOD_RES (249)..(250): Any amino acid
  MOD_RES (262)..(285): Any amino acid
  MOD_RES (300)..(303): Any amino acid
  MOD_RES (320)..(333): Any amino acid
  MOD_RES (347)..(421): Any amino acid
  MOD_RES (432)..(438): Any amino acid
  MOD_RES (449)..(455): Any amino acid
  MOD_RES (492)..(494): Any amino acid
XXXXXXXXXXXXXXXXXXXXXXXXXXXXXXXXXXXXXXXXXXXXXXXXXXXXXKNNQVILCEQXXXXXXXXXXXXXXXXXXXXXXXXXXXXXXXXXXXXXXXXXXXXXXGFVPFSKDNSVRLSAGGXIWVTRELYVSCXXXNCYQFALGQGXXXXXXXXXXXXXXXXPHRTLLMSELGVPFHLGTRQVCIAWSSSSCYDGKAWLHXXXXXXXXXXXXXXXXXXXXXXXXXXXXXEILRTQESECVCISXXCTVVMTDGNASXXXXXXXXXXXXXXXXXXXXXXXXGNAQHVEECSCYPQXXXXVRCICRDNWKGSNRPVXXXXXXXXXXXXXXYMCSGLVGDTPRSXXXXXXXXXXXXXXXXXXXXXXXXXXXXXXXXXXXXXXXXXXXXXXXXXXXXXXXXXXXXXXXXXXXXXXXXXXXSGYSGIFSIEXXXXXXXCFYVELVRGRXXXXXXXWTSNSIVAFCGTSGTYGAGSWPDGAADIKSHAYISFXXX

SEQ ID NO: 419227 - protein, 494 aa, Influenza virus
  MOD_RES (1)..(58): Any amino acid
  MOD_RES (71)..(109): Any amino acid
  MOD_RES (125)..(127): Any amino acid
  MOD_RES (138)..(167): Any amino acid
  MOD_RES (206)..(234): Any amino acid
  MOD_RES (245)..(250): Any amino acid
  MOD_RES (262)..(289): Any amino acid
  MOD_RES (300)..(303): Any amino acid
  MOD_RES (314)..(336): Any amino acid
  MOD_RES (347)..(455): Any amino acid
  MOD_RES (491)..(494): Any amino acid
XXXXXXXXXXXXXXXXXXXXXXXXXXXXXXXXXXXXXXXXXXXXXXXXXXXXXXXXXXVPLVPCEPIIIEXXXXXXXXXXXXXXXXXXXXXXXXXXXXXXXXXXXXXXXGFAPFTKDNSIRLSAXXXVWVTREPYVSXXXXXXXXXXXXXXXXXXXXXXXXXXXXXXPYRTLLMSELGVPFHLATKQVCVAWSSSSCHDGNAWLHXXXXXXXXXXXXXXXXXXXXXXXXXXXXXDILRTQESECXXXXXXCTVIMTDGSASXXXXXXXXXXXXXXXXXXXXXXXXXXXXHIEECSCYPQXXXXIRCVCRDNWKXXXXXXXXXXXXXXXXXXXXXXXSGLVGDTPRDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWTSNSIIAFCGTSGTYGTGTWPDGAADINLMPIYSXXXX

SEQ ID NO: 419228 - protein, 494 aa, Influenza virus
  MOD_RES (1)..(109): Any amino acid
  MOD_RES (127)..(167): Any amino acid
  MOD_RES (196)..(234): Any amino acid
  MOD_RES (245)..(260): Any amino acid
  MOD_RES (271)..(289): Any amino acid
  MOD_RES (300)..(303): Any amino acid
  MOD_RES (315)..(336): Any amino acid
  MOD_RES (347)..(455): Any amino acid
  MOD_RES (478)..(479): Any amino acid
  MOD_RES (490)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFAPLSKDNSIRLAAGGXXXXXXXXXXXXXXXXXXXXXXXXXXXXXXXXXXXXXXXXXSHRTLLMNELGVPFHLATRQVCMAWSSSXXXXXXXXXXXXXXXXXXXXXXXXXXXXXXXXXXXXXXXSILRTQESECXXXXXXXXXXXXXXXXIRKGLILEYYXXXXXXXXXXXXXXXXXXXHVEECSCYPSXXXXVKCVCRDNWKGXXXXXXXXXXXXXXXXXXXXXXSGLVGDTPREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWTANSIIVFCGTSGTYGKGSWPXXRTSISCLYKLXXXXX

SEQ ID NO: 419229 - protein, 494 aa, Influenza virus
  MOD_RES (1)..(115): Any amino acid
  MOD_RES (126)..(176): Any amino acid
  MOD_RES (190)..(260): Any amino acid
  MOD_RES (271)..(309): Any amino acid
  MOD_RES (320)..(458): Any amino acid
  MOD_RES (469)..(480): Any amino acid
  MOD_RES (493)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKDNSIQLSAGXXXXXXXXXXXXXXXXXXXXXXXXXXXXXXXXXXXXXXXXXXXXXXXXXXXLGVPFYLGTKQVCXXXXXXXXXXXXXXXXXXXXXXXXXXXXXXXXXXXXXXXXXXXXXXXXXXXXXXXXXXXXXXXXXXXXXXXIREGLILEYYXXXXXXXXXXXXXXXXXXXXXXXXXXXXXXXXXXXXXXXDNWRGSNRPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSIVVFCGTSXXXXXXXXXXXXANINFMPYISFAXX

SEQ ID NO: 419230 - protein, 494 aa, Influenza virus
  MOD_RES (1)..(459): Any amino acid
  MOD_RES (471)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSVVVFCGTSGTXXXXXXXXXXXXXXXXXXXXXXXX

SEQ ID NO: 419231 - protein, 515 aa, Influenza virus
  MOD_RES (1)..(26): Any amino acid
  MOD_RES (37)..(88): Any amino acid
  MOD_RES (112)..(114): Any amino acid
  MOD_RES (127)..(127): Any amino acid
  MOD_RES (165)..(175): Any amino acid
  MOD_RES (195)..(266): Any amino acid
  MOD_RES (281)..(318): Any amino acid
  MOD_RES (332)..(332): Any amino acid
  MOD_RES (379)..(401): Any amino acid
  MOD_RES (413)..(438): Any amino acid
  MOD_RES (458)..(460): Any amino acid
  MOD_RES (476)..(481): Any amino acid
XXXXXXXXXXXXXXXXXXXXXXXXXXGNLVFNTVIHXXXXXXXXXXXXXXXXXXXXXXXXXXXXXXXXXXXXXXXXXXXXXXXXXXXXLPLCPFRGFFPFHKDNAIRLGENXXXIVTREPYVSCDNXNCWSFALAQGALLGTKHSNGTIKDRTPYRSLIRFPIGXXXXXXXXXXXCIAWSSSSCFDGKEWMHVCXXXXXXXXXXXXXXXXXXXXXXXXXXXXXXXXXXXXXXXXXXXXXXXXXXXXXXXXXXXXXXXXXXXXXXXXKDILRTQESECQCIXXXXXXXXXXXXXXXXXXXXXXXXXXXXXXXXXXXXXXKIQHLEECSCYVDXDVYCICRDNWKGSNRPWMRINNETILETGYVCSKFHSDTPRPADPSXXXXXXXXXXXXXXXXXXXXXXXGNDVWLGRTVSXXXXXXXXXXXXXXXXXXXXXXXXXXTQTLVSNNDWSGYSGSFIVXXXDCFQPCFYVELIRGRXXXXXXVSWTSNSIVTFCGLDNEPGSGNWPDGSNIGFMPK

SEQ ID NO: 419232 - protein, 515 aa, Influenza virus
  MOD_RES (1)..(26): Any amino acid
  MOD_RES (37)..(88): Any amino acid
  MOD_RES (112)..(114): Any amino acid
  MOD_RES (127)..(127): Any amino acid
  MOD_RES (165)..(175): Any amino acid
  MOD_RES (195)..(266): Any amino acid
  MOD_RES (281)..(318): Any amino acid
  MOD_RES (331)..(332): Any amino acid
  MOD_RES (379)..(401): Any amino acid
  MOD_RES (413)..(438): Any amino acid
  MOD_RES (458)..(460): Any amino acid
  MOD_RES (476)..(481): Any amino acid
  MOD_RES (503)..(503): Any amino acid
XXXXXXXXXXXXXXXXXXXXXXXXXXGNLIFNTVIHXXXXXXXXXXXXXXXXXXXXXXXXXXXXXXXXXXXXXXXXXXXXXXXXXXXXLPLCPFKGFFPFHKDNALRLAENXXXIVTREPYISCDNXDCWSFALAQGTLLGTNHSNGTNKDRTSYRSLIRFPVGXXXXXXXXXXXCVAWSSSSCFDGREWMHVCXXXXXXXXXXXXXXXXXXXXXXXXXXXXXXXXXXXXXXXXXXXXXXXXXXXXXXXXXXXXXXXXXXXXXXXXRDILRTQESECQCLXXXXXXXXXXXXXXXXXXXXXXXXXXXXXXXXXXXXXXKIKHLEECSCYVXXDVYCVCRDNWKGSNRPWVRMNNETILETGYICSKFHSDTPRPDDPSXXXXXXXXXXXXXXXXXXXXXXXGDDVWLGRTVSXXXXXXXXXXXXXXXXXXXXXXXXXXTQTLVSNSDWSGYSGSFVIXXXGCFQPCFYIELIRGRXXXXXXVSWTSNSMVTFCGLDNEPGSEXWPDGANIGFMPK

SEQ ID NO: 419233 - protein, 515 aa, Influenza virus
  MOD_RES (1)..(26): Any amino acid
  MOD_RES (37)..(88): Any amino acid
  MOD_RES (112)..(114): Any amino acid
  MOD_RES (125)..(127): Any amino acid
  MOD_RES (165)..(175): Any amino acid
  MOD_RES (195)..(266): Any amino acid
  MOD_RES (278)..(318): Any amino acid
  MOD_RES (332)..(332): Any amino acid
  MOD_RES (379)..(401): Any amino acid
  MOD_RES (413)..(438): Any amino acid
  MOD_RES (458)..(460): Any amino acid
  MOD_RES (476)..(481): Any amino acid
  MOD_RES (515)..(515): Any amino acid
XXXXXXXXXXXXXXXXXXXXXXXXXXGNLAFNAVIHXXXXXXXXXXXXXXXXXXXXXXXXXXXXXXXXXXXXXXXXXXXXXXXXXXXXLPLCPFQGFFPFHKDNAVRLGENXXXLVTREPYISCXXXGCWSFALAQGVLLGTRHSNGTVKDRTPYRSLIQFPIGXXXXXXXXXXXCAAWSSSSCFDGKEWLHVCXXXXXXXXXXXXXXXXXXXXXXXXXXXXXXXXXXXXXXXXXXXXXXXXXXXXXXXXXXXXXXXXXXXXXXXXNNILRTQESECXXXXXXXXXXXXXXXXXXXXXXXXXXXXXXXXXXXXXXXXXRIQHLEECSCYTDXDIYCICRDNWKGSNRPWIRINNETIIETGYVCSKFHSDTPRPVDPSXXXXXXXXXXXXXXXXXXXXXXXQNDVWLGRTISXXXXXXXXXXXXXXXXXXXXXXXXXXIQTLVSNNDWSGYSGSFSVXXXGCFQPCFYVELTRGVXXXXXXVSWASNSIVTFCGLNNEPGSGNWPDGANIGLCPX

SEQ ID NO: 419234 - protein, 515 aa, Influenza virus
  MOD_RES (1)..(26): Any amino acid
  MOD_RES (37)..(101): Any amino acid
  MOD_RES (112)..(114): Any amino acid
  MOD_RES (127)..(127): Any amino acid
  MOD_RES (165)..(183): Any amino acid
  MOD_RES (195)..(266): Any amino acid
  MOD_RES (277)..(318): Any amino acid
  MOD_RES (332)..(332): Any amino acid
  MOD_RES (379)..(401): Any amino acid
  MOD_RES (413)..(438): Any amino acid
  MOD_RES (458)..(460): Any amino acid
  MOD_RES (471)..(481): Any amino acid
XXXXXXXXXXXXXXXXXXXXXXXXXXGNLIFNAVIHXXXXXXXXXXXXXXXXXXXXXXXXXXXXXXXXXXXXXXXXXXXXXXXXXXXXXXXXXXXXXXXXXKDNAIRLGETXXXIITREPYVSCDYXHCWSFALAQGALVGTKHSNGTIEDRTPYRSLIKFPIGXXXXXXXXXXXXXXXXXXXCFDGKEWMHICXXXXXXXXXXXXXXXXXXXXXXXXXXXXXXXXXXXXXXXXXXXXXXXXXXXXXXXXXXXXXXXXXXXXXXXXKNILRTQESEXXXXXXXXXXXXXXXXXXXXXXXXXXXXXXXXXXXXXXXXXXKVQHLEECSCYMDXDIYCVCRDNWKGSNRPWVRINNETIVETGYVCSKFHSDTPRPSDPSXXXXXXXXXXXXXXXXXXXXXXXGSDVWLGRTVSXXXXXXXXXXXXXXXXXXXXXXXXXXTQTLVANNDWSGYSGSFIIXXXACFQPCFYVEXXXXXXXXXXXVSWTGNSIVTFCGLDBEPGSGDWPDGSDIGFMPK

SEQ ID NO: 419235 - protein, 515 aa, Influenza virus
  MOD_RES (1)..(114): Any amino acid
  MOD_RES (125)..(127): Any amino acid
  MOD_RES (138)..(143): Any amino acid
  MOD_RES (163)..(266): Any amino acid
  MOD_RES (277)..(318): Any amino acid
  MOD_RES (331)..(342): Any amino acid
  MOD_RES (379)..(401): Any amino acid
  MOD_RES (413)..(438): Any amino acid
  MOD_RES (449)..(465): Any amino acid
  MOD_RES (476)..(482): Any amino acid
  MOD_RES (514)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVTREPCVSCXXXVCWSFALAQGXXXXXXHSNGTIKDRAPYRSLIRFPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNILRTQESEXXXXXXXXXXXXXXXXXXXXXXXXXXXXXXXXXXXXXXXXXXKIRHLEECSCYVXXXXXXXXXXXXKGSNRPWMKISNETILETGYVCGKFHSDTPRPTDPSXXXXXXXXXXXXXXXXXXXXXXXSNDVWLGRTVTXXXXXXXXXXXXXXXXXXXXXXXXXXNQTLVSNNDWXXXXXXXXXXXXXXXXXCFYIELIRGKXXXXXXXSWTSNSIITFCGLDNEPGSGDWPDGYNIGFMXX

SEQ ID NO: 419236 - protein, 515 aa, Influenza virus
  MOD_RES (1)..(116): Any amino acid
  MOD_RES (127)..(129): Any amino acid
  MOD_RES (143)..(149): Any amino acid
  MOD_RES (165)..(343): Any amino acid
  MOD_RES (358)..(495): Any amino acid
  MOD_RES (515)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTREPYVSCDSXXXWSFALSQGALLGTXXXXXXXRDRTPYRSLIQFPMGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSNRPWMRISNETIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNEPGSGSWPDGSKIGFMPX

SEQ ID NO: 419237 - protein, 515 aa, Influenza virus
  MOD_RES (1)..(498): Any amino acid
  MOD_RES (509)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPGSGNWPDGPXXXXXXX

SEQ ID NO: 419238 - protein, 470 aa, Influenza virus
  MOD_RES (13)..(16): Any amino acid
  MOD_RES (44)..(47): Any amino acid
  MOD_RES (74)..(89): Any amino acid
  MOD_RES (264)..(269): Any amino acid
  MOD_RES (335)..(335): Any amino acid
MNPNQKIITIGSXXXXLTTVGLLLQITSLCSIWFSHYNQVTQTXXXXCSNNTTNYYNETFVNVTNVQNNYTTVXXXXXXXXXXXXXXXXLCPIRGWAPLSKDNGIRIGSRGEVFVIREPFISCSISECRTFFLTQGALLNDKHSNGTVKDRSPFRTLMSCPIGVAPSPSNSRFESVAWSATACSDGPGWLTLGITGPDATAVAVLKYNGIITDTLKSWKGNIMRTQESECVCQDEFCYTLITDGPSDAQAFYKILKIRKGKIVXXXXXXATGFHFEECSCYPSGTDIECVCRDNWRGSNRPWIRFNSDLDYQIGYVCSGIFGDNPRPVDGTGSCXSPVNNGKGRYGVKGFSFRYGDGVWIGRTKSLESRSGFEMVWDANGWVSTDKDSNGVQDIIDNDNWSGYSGSFSIRGETTGRNCTVPCFWVEMIRGQPKEKTIWTSGSSIAFCGVNSDTTGWSWPDGALLPFDIDK

SEQ ID NO: 419239 - protein, 470 aa, Influenza virus
  MOD_RES (12)..(16): Any amino acid
  MOD_RES (30)..(30): Any amino acid
  MOD_RES (44)..(47): Any amino acid
  MOD_RES (74)..(89): Any amino acid
  MOD_RES (104)..(110): Any amino acid
  MOD_RES (135)..(152): Any amino acid
  MOD_RES (172)..(177): Any amino acid
  MOD_RES (225)..(231): Any amino acid
  MOD_RES (264)..(269): Any amino acid
  MOD_RES (335)..(335): Any amino acid
  MOD_RES (348)..(355): Any amino acid
  MOD_RES (421)..(425): Any amino acid
  MOD_RES (468)..(470): Any amino acid
MNPNQMIITIGXXXXXLTTIGLLLQITSLXSIWFSHYNQMTQAXXXXCSNDTINYYNETFVNITNVQNNYTTIXXXXXXXXXXXXXXXXLCPVKGWAPLSKDNXXXXXXXGEVSVIREPFISCSVSECRTFFLTXXXXXXXXXXXXXXXXXXPFRTLMSCPMGVAPSPSNSXXXXXXWSATACSDGSGWLTLGITGPDSTAVAVIKYNGIITDTFKSWKGNIMRXXXXXXXCQDEFCYTLMTDGPSDAQAFYKLLKIRKGKIVXXXXXXATGYHFEECSCYPSRENVECVCRDNWRGSNRPWVRFNSDLDYQIGYICSGVFGDNPRPADGTGSCXGPINNGKGRYGVXXXXXXXXDGVWIGRTKNLESRSGFEMIWDANGWVSTDKNSNGVQDIIDNNNWSGYSGSFSIRWETTGRNCTVXXXXXEMIRGQPKERTIWTSGSSIAFCGVDSDTTGWPWPDGALLPLTXXX

SEQ ID NO: 419240 - protein, 470 aa, Influenza virus
  MOD_RES (13)..(16): Any amino acid
  MOD_RES (44)..(54): Any amino acid
  MOD_RES (71)..(89): Any amino acid
  MOD_RES (103)..(111): Any amino acid
  MOD_RES (136)..(152): Any amino acid
  MOD_RES (172)..(182): Any amino acid
  MOD_RES (220)..(231): Any amino acid
  MOD_RES (264)..(269): Any amino acid
  MOD_RES (335)..(335): Any amino acid
  MOD_RES (346)..(356): Any amino acid
  MOD_RES (393)..(410): Any amino acid
  MOD_RES (467)..(470): Any amino acid
MNPNQSIITIGSXXXXLTTIGPLLQITSLCSIWFSHYNQMKQAXXXXXXXXXXXYYNETFVNMTNVQNNYXXXXXXXXXXXXXXXXXXXLCPIKGWAPLSKDXXXXXXXXXEVFVIREPCISCSINECRTFFLTQXXXXXXXXXXXXXXXXXPFRTLMSCPVGVAPSPSNSXXXXXXXXXXXCSDGPGWLTIGITGPDATAVAVIKYNGVITDTLKSWKXXXXXXXXXXXXCQDEFCYTLVTDGPSDAQAFYKILKIKKGKIVXXXXXXAPGFHFEECSCYPSGENIECVCRDNWQGSNRPWIRFNSNLDYQIGYVCSGVFGDNPRPMDSTGSCXSPINNGKGRYXXXXXXXXXXXEVWIGRTKSLESRRGFEMVWDANGWVTADKDSNGVQXXXXXXXXXXXXXXXXXXGETTGRNCTIPCFWVEMIRGQPKEKAIWTSGSSIAFCGVNSNTTGWSWPDGALFPLXXXX

SEQ ID NO: 419241 - protein, 470 aa, Influenza virus
  MOD_RES (1)..(1): Any amino acid
  MOD_RES (13)..(17): Any amino acid
  MOD_RES (44)..(55): Any amino acid
  MOD_RES (74)..(112): Any amino acid
  MOD_RES (136)..(155): Any amino acid
  MOD_RES (169)..(189): Any amino acid
  MOD_RES (215)..(237): Any amino acid
  MOD_RES (263)..(269): Any amino acid
  MOD_RES (296)..(299): Any amino acid
  MOD_RES (335)..(368): Any amino acid
  MOD_RES (388)..(426): Any amino acid
  MOD_RES (443)..(445): Any amino acid
  MOD_RES (467)..(470): Any amino acid
XNPNQKIVTIGSXXXXXTTVGLLLQIISLCSIWFSHYNQITQTXXXXXXXXXXXXYNETFVNVTHVQNNYTTVXXXXXXXXXXXXXXXXXXXXXXXXXXXXXXXXXXXXXXXVFVIREPFVSCSIDECRTFFLTQXXXXXXXXXXXXXXXXXXXXTLMSCPIGVVPSPXXXXXXXXXXXXXXXXXXXXXLTLGITGPDTTAVAVLKYNGVITDTXXXXXXXXXXXXXXXXXXXXXXXYTLITDGPSNAQAFYKILKIKKGKLXXXXXXXATGFHLEECSCYPSGESVECVCRDNWXXXXRPWIRFNSDPDYQIGYVCSGIFGDSPRPVDGIGSCXXXXXXXXXXXXXXXXXXXXXXXXXXXXXXXXXXRSGFEMVWDDNGWVSTDKDXXXXXXXXXXXXXXXXXXXXXXXXXXXXXXXXXXXXXXXMIRGQPNERTIWTSGSXXXFCGVDSDTTSWSWPDGALLPLXXXX

SEQ ID NO: 419242 - protein, 470 aa, Influenza virus
  MOD_RES (1)..(17): Any amino acid
  MOD_RES (30)..(32): Any amino acid
  MOD_RES (43)..(59): Any amino acid
  MOD_RES (74)..(120): Any amino acid
  MOD_RES (131)..(156): Any amino acid
  MOD_RES (171)..(196): Any amino acid
  MOD_RES (207)..(246): Any amino acid
  MOD_RES (264)..(269): Any amino acid
  MOD_RES (281)..(285): Any amino acid
  MOD_RES (296)..(300): Any amino acid
  MOD_RES (331)..(377): Any amino acid
  MOD_RES (394)..(445): Any amino acid
  MOD_RES (457)..(460): Any amino acid
XXXXXXXXXXXXXXXXXTTIGLLLQIISLXXXWFSHYNQVAQXXXXXXXXXXXXXXXXXFVNVTNVQNDYTTVXXXXXXXXXXXXXXXXXXXXXXXXXXXXXXXXXXXXXXXXXXXXXXXISCSIDECRTXXXXXXXXXXXXXXXXXXXXXXXXXXLMSCHIGVAPSPSNXXXXXXXXXXXXXXXXXXXXXXXXXXPDATAVVVLKXXXXXXXXXXXXXXXXXXXXXXXXXXXXXXXXXXXXXXXXDGQAFYKILKIRKGKIMXXXXXXAAGFHFEECSCXXXXXDVECVCRDNWXXXXXPWIRFNSDLNYQIGYICSGIFGDNPRPMDGXXXXXXXXXXXXXXXXXXXXXXXXXXXXXXXXXXXXXXXXXXXXXXXANGWVSTDKSSNGVQDXXXXXXXXXXXXXXXXXXXXXXXXXXXXXXXXXXXXXXXXXXXXXXXXXXXXFCGVNSDTTSWXXXXGALLPFDIDR

SEQ ID NO: 419243 - protein, 470 aa, Influenza virus
  MOD_RES (1)..(19): Any amino acid
  MOD_RES (30)..(33): Any amino acid
  MOD_RES (44)..(63): Any amino acid
  MOD_RES (74)..(120): Any amino acid
  MOD_RES (136)..(253): Any amino acid
  MOD_RES (264)..(270): Any amino acid
  MOD_RES (281)..(320): Any amino acid
  MOD_RES (335)..(446): Any amino acid
  MOD_RES (465)..(470): Any amino acid
XXXXXXXXXXXXXXXXXXXVGLLLQVTSLXXXXFSHYNQVTQPXXXXXXXXXXXXXXXXXXXXTHVQNNYTTIXXXXXXXXXXXXXXXXXXXXXXXXXXXXXXXXXXXXXXXXXXXXXXXISCSIHECRTFFLTQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILKIKKGKIMXXXXXXXIGFHFEECSCXXXXXXXXXXXXXXXXXXXXXXXXXXXXXXXXXXXXXXXXFGDNPRSVDGTGSCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCGVNSDTTCWSWPDGALLXXXXXX

SEQ ID NO: 419244 - protein, 473 aa, Influenza virus
  MOD_RES (17)..(47): Any amino acid
  MOD_RES (59)..(79): Any amino acid
  MOD_RES (189)..(190): Any amino acid
  MOD_RES (234)..(234): Any amino acid
  MOD_RES (257)..(264): Any amino acid
  MOD_RES (302)..(308): Any amino acid
  MOD_RES (329)..(336): Any amino acid
  MOD_RES (366)..(367): Any amino acid
  MOD_RES (383)..(393): Any amino acid
  MOD_RES (413)..(418): Any amino acid
MNPNQKIITIGSVSLAXXXXXXXXXXXXXXXXXXXXXXXXXXXXXXXTTEVYNETVRLXXXXXXXXXXXXXXXXXXXXXEFLNNTEPLCNVSGFAIVSKDNGIRIGSRGHVFVIREPFVACGPTECRTFFLTQGALLNDKHSNNTVKDRSPYRALMSVPLGSSPNAYQAKFESVAWSATACHDGKEWLXXGISGADDDAYAVIHYGGMPTDVVRSWRKQILRTQESSCVCMKGXCYWVMTDGPANNQASYKIFKSHXXXXXXXXEVSFQGGHIEECSCYPNLGKVECVCRDNWNGMNRPILXXXXXXXYEVGYLCAGIPTDTPRVQDSXXXXXXXXAVGGSGTNNYGVKGFGFRQGNSVWAGRTVXXSSRSGFEILLIEDGWXXXXXXXXXXXEVLNNKNWSGYSGAFTIPIXXXXXXCLVPCFWLEMIRGKPEERTSIWTSSSSTVFCGVSSEVPGWSWDDGAILPFDIDKM

SEQ ID NO: 419245 - protein, 473 aa, Influenza virus
  MOD_RES (1)..(3): Any amino acid
  MOD_RES (17)..(47): Any amino acid
  MOD_RES (59)..(79): Any amino acid
  MOD_RES (149)..(150): Any amino acid
  MOD_RES (189)..(190): Any amino acid
  MOD_RES (234)..(235): Any amino acid
  MOD_RES (257)..(264): Any amino acid
  MOD_RES (302)..(308): Any amino acid
  MOD_RES (329)..(336): Any amino acid
  MOD_RES (366)..(367): Any amino acid
  MOD_RES (383)..(393): Any amino acid
  MOD_RES (413)..(418): Any amino acid
  MOD_RES (471)..(473): Any amino acid
XXXNQKIITIGSISLGXXXXXXXXXXXXXXXXXXXXXXXXXXXXXXXTTEIYNETVRLXXXXXXXXXXXXXXXXXXXXXDFLNNTEPLCEVSGFAIISKDNGIRIGSRGHIFVIREPFVACSPSECRTFFLTQGALLNDRHSNNTVKDXXPYRALMSVPMGSSPNAYQARFESVGWSATACHDGKKWLXXGVSGADDDAYAVIHYGGVPTDVVRSWKKQILRTQESSCVCVKGXXYWVMTDGPASNQASYKIFKSQXXXXXXXXEISFQGGHIEECSCYPNMGKVECVCRDNWNGMNRPVLXXXXXXXYNVGYLCAGIPTDTPRIQDSXXXXXXXXAIGGSGTNNYGVKGFGFRQGTSVWAGRTIXXSSRSGFEVLLIEDGWXXXXXXXXXXXEVLNNMNWSGYSGSFTIPTXXXXXXCIVPCFWLEMIRGRPEERPSIWTSSSSTVFCGVSGEVPGWSWDDGAILPLTSXXX

SEQ ID NO: 419246 - protein, 473 aa, Influenza virus
  MOD_RES (1)..(3): Any amino acid
  MOD_RES (17)..(47): Any amino acid
  MOD_RES (58)..(79): Any amino acid
  MOD_RES (150)..(152): Any amino acid
  MOD_RES (189)..(190): Any amino acid
  MOD_RES (234)..(236): Any amino acid
  MOD_RES (257)..(264): Any amino acid
  MOD_RES (292)..(308): Any amino acid
  MOD_RES (329)..(336): Any amino acid
  MOD_RES (364)..(367): Any amino acid
  MOD_RES (383)..(393): Any amino acid
  MOD_RES (408)..(424): Any amino acid
  MOD_RES (447)..(447): Any amino acid
  MOD_RES (473)..(473): Any amino acid
XXXNQKIITIGSASLGXXXXXXXXXXXXXXXXXXXXXXXXXXXXXXXITEIYNETVRXXXXXXXXXXXXXXXXXXXXXXEFFNNTEPLCEVSGFVIVSKDNGIRVGSRGHVFVIREPFVSCGPSECRTFFLTPCVLLNDKHSNNTVRDRXXXRALMSVLLGSSPNAYQAQFESVEWSATACHDGKGWLXXGVSGADNDAYAVIHYGGIPTDVVRSWRRQILRTQESSCVCIKGXXXWVMTDGPANSQASYKIFKSYXXXXXXXXEVLFQGGHIEECSCYPNSGKVECVCRDXXXXXXXXXXXXXXXXXYDVGYLCAGIPTDTPRVQDNXXXXXXXXAVGGSGTDNYGVKGFGFRQGNNVWAGRXXXXSSRSGFEVLFIEDGWXXXXXXXXXXXEVLNNRNWSGYSGSXXXXXXXXXXXXXXXXXWLEMIRGKPKERTSIWTSSSSMXFCGVSSEVPEWSWDDGAILPFGIDKX

SEQ ID NO: 419247 - protein, 473 aa, Influenza virus
  MOD_RES (1)..(3): Any amino acid
  MOD_RES (17)..(47): Any amino acid
  MOD_RES (59)..(79): Any amino acid
  MOD_RES (107)..(114): Any amino acid
  MOD_RES (130)..(154): Any amino acid
  MOD_RES (189)..(190): Any amino acid
  MOD_RES (202)..(203): Any amino acid
  MOD_RES (234)..(236): Any amino acid
  MOD_RES (257)..(264): Any amino acid
  MOD_RES (294)..(308): Any amino acid
  MOD_RES (329)..(336): Any amino acid
  MOD_RES (348)..(348): Any amino acid
  MOD_RES (366)..(367): Any amino acid
  MOD_RES (383)..(393): Any amino acid
  MOD_RES (409)..(426): Any amino acid
  MOD_RES (465)..(473): Any amino acid
XXXNQKIMTIGSVSLAXXXXXXXXXXXXXXXXXXXXXXXXXXXXXXXTTEVYSETVRVXXXXXXXXXXXXXXXXXXXXXKFLNNTEPLCDVSGFAIFSKDNGIRIGXXXXXXXXREPFVACGPSECRTFXXXXXXXXXXXXXXXXXXXXXXXXXLMSVPLGSSSNAYQAKFESIAWSATACHDGKEWMXXGVSGTDDDAYAXXHYGGVPTDVIRSWRKQILRTQESSCVCMNGXXXWVMTDGPANKQASYKIFKSRXXXXXXXXEISFQSGHIEECSCYPNLGQVECVCRDNWXXXXXXXXXXXXXXXYKVGYLCAGIPTDTPRVQDDXXXXXXXXAIGGSGTDNYGXKGFAFKQGNSVWAGRTIXXSSRNGFEILLIEEGWXXXXXXXXXXXEILNNKNWSGYSGSFXXXXXXXXXXXXXXXXXXEMIRGKPEEGTSIWTSSSSTVFCGVSSEAPGWSWDDGAXXXXXXXXX

SEQ ID NO: 419248 - protein, 473 aa, Influenza virus
  MOD_RES (1)..(4): Any amino acid
  MOD_RES (17)..(47): Any amino acid
  MOD_RES (59)..(86): Any amino acid
  MOD_RES (106)..(114): Any amino acid
  MOD_RES (134)..(178): Any amino acid
  MOD_RES (189)..(192): Any amino acid
  MOD_RES (229)..(241): Any amino acid
  MOD_RES (257)..(265): Any amino acid
  MOD_RES (291)..(318): Any amino acid
  MOD_RES (329)..(355): Any amino acid
  MOD_RES (366)..(370): Any amino acid
  MOD_RES (381)..(393): Any amino acid
  MOD_RES (409)..(432): Any amino acid
  MOD_RES (446)..(448): Any amino acid
  MOD_RES (461)..(473): Any amino acid
XXXXQKIITIGSMSLAXXXXXXXXXXXXXXXXXXXXXXXXXXXXXXXTTEMYNETVRVXXXXXXXXXXXXXXXXXXXXXXXXXXXXPLCEISGFAIASKDNGIRIXXXXXXXXXREPFVACGPAECRTFFLTQXXXXXXXXXXXXXXXXXXXXXXXXXXXXXXXXXXXXXXXXXXXXXTACHDGKKWMXXXXSGADDEAYAVIHYGGIPTDVIRSWRKKILRTQESSCXXXXXXXXXXXXXGPANNQASYRIFKSHXXXXXXXXXVSFRGGHIEECSCYPNLGIVECVCRXXXXXXXXXXXXXXXXXXXXXXXXXXXXPTDTPRVQDGXXXXXXXXXXXXXXXXXXXXXXXXXXXGNSVWAGRTMXXXXXSGFEILLIEEXXXXXXXXXXXXXEVLNNKHWSGYSGSFXXXXXXXXXXXXXXXXXXXXXXXXPEEKTSIWTSSSSXXXCGVSSEVPGCTMXXXXXXXXXXXXX

SEQ ID NO: 419249 - protein, 473 aa, Influenza virus
  MOD_RES (1)..(48): Any amino acid
  MOD_RES (59)..(86): Any amino acid
  MOD_RES (103)..(204): Any amino acid
  MOD_RES (216)..(276): Any amino acid
  MOD_RES (293)..(355): Any amino acid
  MOD_RES (366)..(370): Any amino acid
  MOD_RES (382)..(394): Any amino acid
  MOD_RES (413)..(433): Any amino acid
  MOD_RES (447)..(451): Any amino acid
  MOD_RES (470)..(473): Any amino acid
XXXXXXXXXXXXXXXXXXXXXXXXXXXXXXXXXXXXXXXXXXXXXXXXTEVYNETVRVXXXXXXXXXXXXXXXXXXXXXXXXXXXXPLCEVSGFAVVSKDNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYGGVPTDVMRSXXXXXXXXXXXXXXXXXXXXXXXXXXXXXXXXXXXXXXXXXXXXXXXXXXXXXXXXXXXXXSCYPNLCQVECVCRDNXXXXXXXXXXXXXXXXXXXXXXXXXXXXXXXXXXXXXXXXXXXXXXXXXXXXXXXXXXXXXXXGTSVWAGRTVXXXXXSGFEVLLIENGXXXXXXXXXXXXXVLDNKNWSGYSGAFTVPIXXXXXXXXXXXXXXXXXXXXXEERNSIWTSSSSTXXXXXSSEVPGWSWGDGAILPFDXXXX

SEQ ID NO: 419250 - protein, 473 aa, Influenza virus
  MOD_RES (1)..(209): Any amino acid
  MOD_RES (223)..(402): Any amino acid
  MOD_RES (413)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDVVRSWRKKILRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYSGAFTIPTXXXXXXXXXXXXXXXXXXXXXXXXXXXXXXXXXXXXXXXXXXXXXXXXXXXXXXXXXXXXX

SEQ ID NO: 419251 - protein, 473 aa, Influenza virus
  MOD_RES (1)..(402): Any amino acid
  MOD_RES (413)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYSGAFTIPVXXXXXXXXXXXXXXXXXXXXXXXXXXXXXXXXXXXXXXXXXXXXXXXXXXXXXXXXXXXXX

SEQ ID NO: 419252 - protein, 471 aa, Influenza virus
  MOD_RES (24)..(24): Any amino acid
  MOD_RES (37)..(55): Any amino acid
  MOD_RES (66)..(89): Any amino acid
  MOD_RES (128)..(128): Any amino acid
  MOD_RES (173)..(174): Any amino acid
  MOD_RES (210)..(214): Any amino acid
  MOD_RES (250)..(271): Any amino acid
  MOD_RES (286)..(288): Any amino acid
  MOD_RES (309)..(311): Any amino acid
  MOD_RES (334)..(343): Any amino acid
  MOD_RES (360)..(360): Any amino acid
  MOD_RES (386)..(397): Any amino acid
  MOD_RES (416)..(417): Any amino acid
  MOD_RES (438)..(438): Any amino acid
MNPNQKIICISATGMTLSVVSLLXGLANLGLNIGLHXXXXXXXXXXXXXXXXXXXTTTTIINNNTXXXXXXXXXXXXXXXXXXXXXXXXKPLCEVNSWHILSKDNAIRIGEDAHILVTREPYLSCGPXECRMFALSQGTTLRGRHANGTIHDRSPFRALISWEMGQAPSPYNXXVECVGWSSTSCHDGISRMSICMSGPNNNASAVVWYXXXXXTEIASWAGNILRTQESECVCHNGICPVVMTDGPANXXXXXXXXXXXXXXXXXXXXXXGSAQHIEECSCYGAXXXIKCICRDNWKGANRPVITINXXXMTHTSKYLCSKILTDTSRPNDPXXXXXXXXXXGGSPDPGVKGFAFLDGXNSWLGRTISKDSRSGYEMLKVPNAEXXXXXXXXXXXXIVNNQNWSGYSGAFIDYWXXRECFNPCFYVELIRGRPKESXVLWTSNSIVALCGSKERLGSWSWHDGAEIIYFK

SEQ ID NO: 419253 - protein, 471 aa, Influenza virus
  MOD_RES (24)..(24): Any amino acid
  MOD_RES (37)..(89): Any amino acid
  MOD_RES (128)..(128): Any amino acid
  MOD_RES (173)..(174): Any amino acid
  MOD_RES (210)..(214): Any amino acid
  MOD_RES (250)..(271): Any amino acid
  MOD_RES (286)..(288): Any amino acid
  MOD_RES (309)..(311): Any amino acid
  MOD_RES (334)..(343): Any amino acid
  MOD_RES (360)..(360): Any amino acid
  MOD_RES (386)..(397): Any amino acid
  MOD_RES (413)..(417): Any amino acid
  MOD_RES (438)..(438): Any amino acid
MNPNQKITCISATGVTLSVVSLLXGIANLGLNIGIHXXXXXXXXXXXXXXXXXXXXXXXXXXXXXXXXXXXXXXXXXXXXXXXXXXXXXKPLCEVSSWHILSKDNAVRIGEDAHVLVTREPYLSCDPXGCRMFALSQGTTLKGRHANGTIHDRSQFRALISWEMGLAPSPYNXXVECIGWSSTSCHDGMSRMSICISGPNNNASAVIWYXXXXXTEIPSWAGNILRTQESECVCHKGICPVVMTDGPASXXXXXXXXXXXXXXXXXXXXXXGNAQHIEECSCYGSXXXVKCICRDNWKGANRPIITINXXXMTHMSKYLCSKVLTDTSRPSDPXXXXXXXXXXGGGPDPGVKGFAFLNGXNSWLGRTTSKDSRSGYEVLKVPNAEXXXXXXXXXXXXIVNNQDWSGYSGAFIXXXXXKECFNPCFYVELIRGMPKESXVFWTSNSIVALCGSRERLGSWSWHDGAEITYFK

SEQ ID NO: 419254 - protein, 471 aa, Influenza virus
  MOD_RES (24)..(24): Any amino acid
  MOD_RES (35)..(89): Any amino acid
  MOD_RES (122)..(128): Any amino acid
  MOD_RES (173)..(174): Any amino acid
  MOD_RES (204)..(214): Any amino acid
  MOD_RES (250)..(271): Any amino acid
  MOD_RES (283)..(288): Any amino acid
  MOD_RES (309)..(311): Any amino acid
  MOD_RES (334)..(343): Any amino acid
  MOD_RES (360)..(362): Any amino acid
  MOD_RES (386)..(397): Any amino acid
  MOD_RES (416)..(417): Any amino acid
  MOD_RES (438)..(438): Any amino acid
MNPNQKIMCISATGMALSVVSLLXGVANLGLNIGXXXXXXXXXXXXXXXXXXXXXXXXXXXXXXXXXXXXXXXXXXXXXXXXXXXXXXXKPLCAVNSWHILSKDNAIRIGENAHILVTREPXXXXXXXECRIFALSQGTTLRGQHANGTIHDRSPYRALISWEMGQAPSPYTXXIECIGWSSTSCHDGVSRMSVCMSGPNNNAXXXXXXXXXXXTEIPSWEGNILRTQESECVCHKGVCPVVMTDGPADXXXXXXXXXXXXXXXXXXXXXXGSAEHIEECSCXXXXXXIKCVCRDNWKGANRPVIIIDXXXMTHTSRYLCSRILTDTSRPTDPXXXXXXXXXXGGTPDPGVKGFAFLDEXXXWLGRTISKDLRSGYEMLKVPDAEXXXXXXXXXXXXIINNQNWSGYSGSFIDYWXXKKCFNPCFYVELIRGRPRESXVLWTSNSMVALCGSKEQLGSWSWHDGAEIIYFE

SEQ ID NO: 419255 - protein, 471 aa, Influenza virus
  MOD_RES (1)..(2): Any amino acid
  MOD_RES (23)..(24): Any amino acid
  MOD_RES (37)..(89): Any amino acid
  MOD_RES (122)..(140): Any amino acid
  MOD_RES (170)..(174): Any amino acid
  MOD_RES (210)..(214): Any amino acid
  MOD_RES (225)..(228): Any amino acid
  MOD_RES (243)..(271): Any amino acid
  MOD_RES (282)..(288): Any amino acid
  MOD_RES (309)..(311): Any amino acid
  MOD_RES (331)..(343): Any amino acid
  MOD_RES (360)..(362): Any amino acid
  MOD_RES (382)..(397): Any amino acid
  MOD_RES (411)..(425): Any amino acid
  MOD_RES (436)..(438): Any amino acid
  MOD_RES (464)..(471): Any amino acid
XXPNQKIICISTTGMTLSVVNLXXGLANLGLNVGLHXXXXXXXXXXXXXXXXXXXXXXXXXXXXXXXXXXXXXXXXXXXXXXXXXXXXXKSLCEVNSWHIFSKDNAIRIGEEAHILVTREPXXXXXXXXXXXXXXXXXXXLRGRHANGTMHDRSPFRALVSWEMGQAPSXXXXXIECVGWSSTSCHDGRSRMSICMSGPNDNASAVVWYXXXXXTEIPTWAGNIXXXXESECVCHNGVCPVVXXXXXXXXXXXXXXXXXXXXXXXXXXXXXGTAQHIEECSXXXXXXXIKCICRDNWRGANRPVITIDXXXMTHSSKYLCSRVLTDTSRPXXXXXXXXXXXXXGGNPDPGVKGFAFLDRXXXWLGRTISKDTRSGYEMLKVXXXXXXXXXXXXXXXXIVDNQNWSGYSGVXXXXXXXXXXXXXXXYVELIRGRPEXXXVWWTSNSIVALCGSKKRLGSWSWHDXXXXXXXX

SEQ ID NO: 419256 - protein, 471 aa, Influenza virus
  MOD_RES (1)..(8): Any amino acid
  MOD_RES (24)..(24): Any amino acid
  MOD_RES (37)..(102): Any amino acid
  MOD_RES (122)..(141): Any amino acid
  MOD_RES (173)..(179): Any amino acid
  MOD_RES (206)..(214): Any amino acid
  MOD_RES (229)..(232): Any amino acid
  MOD_RES (250)..(272): Any amino acid
  MOD_RES (283)..(298): Any amino acid
  MOD_RES (309)..(311): Any amino acid
  MOD_RES (331)..(348): Any amino acid
  MOD_RES (360)..(370): Any amino acid
  MOD_RES (386)..(401): Any amino acid
  MOD_RES (416)..(426): Any amino acid
  MOD_RES (438)..(445): Any amino acid
  MOD_RES (456)..(471): Any amino acid
XXXXXXXXCISATGMILSVVSLLXGLVNLGLNIGLHXXXXXXXXXXXXXXXXXXXXXXXXXXXXXXXXXXXXXXXXXXXXXXXXXXXXXXXXXXXXXXXXXXKDNAIRIGEGAHILVTREPXXXXXXXXXXXXXXXXXXXXRGRHANGTINDRSPFRALVSWGMGQAPSPYNXXXXXXXWSSTSCHDGKSRMSICVSGPNNNASAXXXXXXXXXTEIPSWAGNVLRTQXXXXVCHKGVCPVIMTDGPANXXXXXXXXXXXXXXXXXXXXXXXKAQHIEECSCXXXXXXXXXXXXXXXXGANRPVIIINXXXMTHISKYLCSKTLTDTSRPXXXXXXXXXXXXXXXXXXPGIKGFAFLDGXXXXXXXXXXXDSRSGYEILKVPNAEXXXXXXXXXXXXXXXXQKWSGYSGAFMDYWXXXXXXXXXXXAELIRGRPKENXXXXXXXXIVALCGSKEQXXXXXXXXXXXXXXXX

SEQ ID NO: 419257 - protein, 471 aa, Influenza virus
  MOD_RES (1)..(13): Any amino acid
  MOD_RES (24)..(153): Any amino acid
  MOD_RES (170)..(373): Any amino acid
  MOD_RES (386)..(402): Any amino acid
  MOD_RES (413)..(427): Any amino acid
  MOD_RES (438)..(471): Any amino acid
XXXXXXXXXXXXXGMTLSVVSLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSPFRALISWGMGQAPSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGYEVLKVPDAEXXXXXXXXXXXXXXXXXNWSGYSGAFMXXXXXXXXXXXXXXXELVRGRPKESXXXXXXXXXXXXXXXXXXXXXXXXXXXXXXXXXX

SEQ ID NO: 419258 - protein, 471 aa, Influenza virus
  MOD_RES (1)..(156): Any amino acid
  MOD_RES (168)..(402): Any amino acid
  MOD_RES (416)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTLISWEMGQAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNWSGYSGAFVDYWXXXXXXXXXXXXXXXXXXXXXXXXXXXXXXXXXXXXXXXXXXXXXXXXXXXXXXXX

SEQ ID NO: 419259 - protein, 471 aa, Influenza virus
  MOD_RES (1)..(162): Any amino acid
  MOD_RES (173)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEMGHAPSPYNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419260 - protein, 471 aa, Influenza virus
  MOD_RES (16)..(20): Any amino acid
  MOD_RES (38)..(61): Any amino acid
  MOD_RES (73)..(82): Any amino acid
  MOD_RES (94)..(94): Any amino acid
  MOD_RES (164)..(168): Any amino acid
  MOD_RES (251)..(267): Any amino acid
  MOD_RES (285)..(285): Any amino acid
  MOD_RES (308)..(317): Any amino acid
  MOD_RES (332)..(333): Any amino acid
  MOD_RES (357)..(357): Any amino acid
  MOD_RES (387)..(400): Any amino acid
  MOD_RES (416)..(416): Any amino acid
MNPNQKLFALSGVAIXXXXXNLLIGISNVGLNVSLHLXXXXXXXXXXXXXXXXXXXXXXXXENTYVNNTTVIXXXXXXXXXXYLMLNKSLCKVXGWVVVAKDNAIRFGESEQIIVTREPYVSCDPLGCKMYALHQGTTIRNKHSNGTIHDRTAFRGLISTPLGXXXXXSNSDFLCVGWSSTSCHDGIGRMTICVQGNNDNATATVYYDRRLTTTIKTWAGNILRTQESECVCHNGTCVVIMTDGSASSQAXXXXXXXXXXXXXXXXXLKGSARHIEECSCYGHNXKVTCVCRDNWQGANRPVIEIDMXXXXXXXXXXCTGVLTDTSRPSDKXXGDCNNPITGSPGAPGVKGFGFLDXGNTWLGRTISPRSRSGFEMLKIPNAGTDPXXXXXXXXXXXXXXNWSGYSGSFIDYWDEXSECYNPCFYVELIRGRPEEAKYVWWTSNSLVALCGSPISVGSGSFPDGAQIQYFS

SEQ ID NO: 419261 - protein, 471 aa, Influenza virus
  MOD_RES (16)..(20): Any amino acid
  MOD_RES (38)..(61): Any amino acid
  MOD_RES (73)..(82): Any amino acid
  MOD_RES (94)..(94): Any amino acid
  MOD_RES (115)..(116): Any amino acid
  MOD_RES (164)..(168): Any amino acid
  MOD_RES (251)..(267): Any amino acid
  MOD_RES (285)..(285): Any amino acid
  MOD_RES (308)..(317): Any amino acid
  MOD_RES (332)..(333): Any amino acid
  MOD_RES (357)..(357): Any amino acid
  MOD_RES (384)..(400): Any amino acid
  MOD_RES (416)..(416): Any amino acid
  MOD_RES (427)..(428): Any amino acid
MNPNQKLFASSGIAIXXXXXNLIIGISNVGLNMSLHLXXXXXXXXXXXXXXXXXXXXXXXXENTYVNNTTIIXXXXXXXXXXYLLLNKSLCNVXGWVVIAKDNAVRFGESEQIIXXREPYVSCDPTGCRMYALHQGTTIRNRHSNGTIHDRAAFRGLISTHLGXXXXXSNSDFMCVGWSSTTCHDGIARMTICIQGNNNNATATVYYDKRLTTTIKTWARNILRTQESECVCHDGTCVVVMTDGPANNQAXXXXXXXXXXXXXXXXXLKGSAKHIEECSCYGHSXRVTCVCRDNWRGANRPIIEIDMXXXXXXXXXXCTGILTDTSRPGDKXXGDCSNPITGSPGVPGVKGFGFLNXDNTWLGRTISPKLRSGFEMLKIHNAGXXXXXXXXXXXXXXXXXNRSGYSGSFIDYWNDXNECYNPCFYVXXIRGRPEEVKYVWWTSNSLIALCGSPFPVGSGSFPDGAKIQYFS

SEQ ID NO: 419262 - protein, 471 aa, Influenza virus
  MOD_RES (16)..(20): Any amino acid
  MOD_RES (38)..(61): Any amino acid
  MOD_RES (73)..(82): Any amino acid
  MOD_RES (94)..(94): Any amino acid
  MOD_RES (164)..(168): Any amino acid
  MOD_RES (251)..(267): Any amino acid
  MOD_RES (283)..(285): Any amino acid
  MOD_RES (306)..(319): Any amino acid
  MOD_RES (332)..(333): Any amino acid
  MOD_RES (357)..(357): Any amino acid
  MOD_RES (387)..(400): Any amino acid
  MOD_RES (416)..(416): Any amino acid
  MOD_RES (428)..(430): Any amino acid
MNPNQKLFTLSGVAIXXXXXNLLIGISNMSLNISLYSXXXXXXXXXXXXXXXXXXXXXXXXENKYVNNTTIIXXXXXXXXXXYLVLNKSLCKVXGWVAVAKDNAIRFGEGEQIIVTREPYVSCDPSSCKMYALHQGTTIRNKHSNSTTHDRTAFRGLMSTPLGXXXXXSNSDFICVGWSSTSCHDGVGRMTICVQGDNENATATVYYNRRLTTTIKPWARNILRTQESECVCHNSTCVVVMTDGPASSQAXXXXXXXXXXXXXXXXXLRGSARHIEECPCYGXXXKATCVCRDNWQGANRPIIEIXXXXXXXXXXXXXXGVLTDTSRPKDKXXGECFNPITGSPGSPGIKGFGFLNXSNTWLGRTISPHSRSGFEMLKVPNAGTDPXXXXXXXXXXXXXXDWSGYSGSFIDYWDDXSVCYNPCFYVEXXXGRPEEAKYVEWTSNSLIALCGSPIPVGPGSFPDGAQIKYFS

SEQ ID NO: 419263 - protein, 471 aa, Influenza virus
  MOD_RES (16)..(20): Any amino acid
  MOD_RES (38)..(61): Any amino acid
  MOD_RES (72)..(82): Any amino acid
  MOD_RES (94)..(94): Any amino acid
  MOD_RES (137)..(138): Any amino acid
  MOD_RES (161)..(168): Any amino acid
  MOD_RES (194)..(194): Any amino acid
  MOD_RES (251)..(267): Any amino acid
  MOD_RES (285)..(285): Any amino acid
  MOD_RES (308)..(319): Any amino acid
  MOD_RES (332)..(335): Any amino acid
  MOD_RES (356)..(357): Any amino acid
  MOD_RES (387)..(416): Any amino acid
  MOD_RES (428)..(432): Any amino acid
  MOD_RES (471)..(471): Any amino acid
MNPSQKLFALSGVAVXXXXXNLLIGVSNVGLNISLHLXXXXXXXXXXXXXXXXXXXXXXXXKNTYVNNTTIXXXXXXXXXXXYLLLNKSLCSVXGWVVIEKDNAVRFGESEQVIVTREPYVSCDPIECKMYALHQGXXIRNKHSNGTTHDRTTFRGLLSTXXXXXXXXSNSEFICVGWSSTTCHDGVNRMTICXQGNNENATATVYYNKRLTTTIRTWAKNILRTQESECVCHNGTCAVVMTDGSASGQAXXXXXXXXXXXXXXXXXLQGSARHIEECSCYGHDXKITCVCRDNWQGANRPVIKIDMXXXXXXXXXXXXGVLTDTSRPGDRXXXXCSNPITGSPSAPGIKGFGFLXXNNTWLGRTISPRLRSGFEMLKIPNAETDPXXXXXXXXXXXXXXXXXXXXXXXXXXXXXXSACYNPCFYVEXXXXXPEEAKYVWWASNSLIALCGSPVPIGSGFFPDGPQIQYFX

SEQ ID NO: 419264 - protein, 471 aa, Influenza virus
  MOD_RES (11)..(20): Any amino acid
  MOD_RES (38)..(61): Any amino acid
  MOD_RES (72)..(82): Any amino acid
  MOD_RES (94)..(95): Any amino acid
  MOD_RES (115)..(142): Any amino acid
  MOD_RES (164)..(168): Any amino acid
  MOD_RES (182)..(182): Any amino acid
  MOD_RES (194)..(194): Any amino acid
  MOD_RES (226)..(226): Any amino acid
  MOD_RES (239)..(240): Any amino acid
  MOD_RES (251)..(268): Any amino acid
  MOD_RES (285)..(285): Any amino acid
  MOD_RES (308)..(319): Any amino acid
  MOD_RES (332)..(335): Any amino acid
  MOD_RES (349)..(357): Any amino acid
  MOD_RES (387)..(416): Any amino acid
  MOD_RES (427)..(444): Any amino acid
  MOD_RES (455)..(455): Any amino acid
  MOD_RES (471)..(471): Any amino acid
MNPNQNLFTLXXXXXXXXXXNLLIGISNVVLNVSLHLXXXXXXXXXXXXXXXXXXXXXXXXENTYVNKTTVXXXXXXXXXXXYLMLSKSLCKVXXWVVIAKDNAIRFGESEQVIXXXXXXXXXXXXXXXXXXXXXXXXXXXXHSNGTINDRTAFRGLISTQLGXXXXXSNSEFLCVGWSSTXCHDGVSRMTICXQGNNKNATATVYYDGRLTTTIKTWAKNILRTXDSECVSHNGTWAXXMTDGSASSRAXXXXXXXXXXXXXXXXXXKGSARHIEEWSCYGHSXKVSCVCRDNWQGANRPVIEINMXXXXXXXXXXXXGILTDTSRPSDRXXXXCSNPITGSPCAPGXXXXXXXXXDNTWLGGTISPRSRSGFEVLKIPNAGIDPXXXXXXXXXXXXXXXXXXXXXXXXXXXXXXSKCYNPCFYVXXXXXXXXXXXXXXXXXXSLVALCGSPVXVGSGSFPNGAQIQYFX

SEQ ID NO: 419265 - protein, 471 aa, Influenza virus
  MOD_RES (1)..(2): Any amino acid
  MOD_RES (13)..(26): Any amino acid
  MOD_RES (37)..(62): Any amino acid
  MOD_RES (73)..(95): Any amino acid
  MOD_RES (107)..(146): Any amino acid
  MOD_RES (163)..(198): Any amino acid
  MOD_RES (231)..(234): Any amino acid
  MOD_RES (245)..(269): Any amino acid
  MOD_RES (284)..(287): Any amino acid
  MOD_RES (300)..(358): Any amino acid
  MOD_RES (383)..(456): Any amino acid
XXPKSKLFTLSGXXXXXXXXXXXXXXSNIGLNVSLHXXXXXXXXXXXXXXXXXXXXXXXXXXNTYINNTTIIXXXXXXXXXXXXXXXXXXXXXXXWVVVAKDNAVRXXXXXXXXXXXXXXXXXXXXXXXXXXXXXXXXXXXXXXXXTIHDRTTFRGLISTPLXXXXXXXXXXXXXXXXXXXXXXXXXXXXXXXXXXXXDNATATVYYNGRLTTTIKTWAGKILRTQESECXXXXGTCVAVMTDGXXXXXXXXXXXXXXXXXXXXXXXXXGSARHVEECSCYGHXXXXTCICRDNWQGANXXXXXXXXXXXXXXXXXXXXXXXXXXXXXXXXXXXXXXXXXXXXXXXXXXXXXXXXXXXNTWLGRTFSPRSRSGFEMLRIPNAXXXXXXXXXXXXXXXXXXXXXXXXXXXXXXXXXXXXXXXXXXXXXXXXXXXXXXXXXXXXXXXXXXXXXXXXXXGSGSFPDGARIQYFS

SEQ ID NO: 419266 - protein, 471 aa, Influenza virus
  MOD_RES (1)..(3): Any amino acid
  MOD_RES (15)..(62): Any amino acid
  MOD_RES (73)..(97): Any amino acid
  MOD_RES (108)..(146): Any amino acid
  MOD_RES (161)..(205): Any amino acid
  MOD_RES (216)..(269): Any amino acid
  MOD_RES (280)..(288): Any amino acid
  MOD_RES (299)..(358): Any amino acid
  MOD_RES (382)..(456): Any amino acid
  MOD_RES (471)..(471): Any amino acid
XXXNQKLFALSEVAXXXXXXXXXXXXXXXXXXXXXXXXXXXXXXXXXXXXXXXXXXXXXXXXNTYINNATIIXXXXXXXXXXXXXXXXXXXXXXXXXVIAQDNAIRFXXXXXXXXXXXXXXXXXXXXXXXXXXXXXXXXXXXXXXXTIHDGTAFRGLISTXXXXXXXXXXXXXXXXXXXXXXXXXXXXXXXXXXXXXXXXXXXXXYYERRLTTTIXXXXXXXXXXXXXXXXXXXXXXXXXXXXXXXXXXXXXXXXXXXXXXXXXXXXXXGSAMHIEECSXXXXXXXXXCGCRDNWQGAXXXXXXXXXXXXXXXXXXXXXXXXXXXXXXXXXXXXXXXXXXXXXXXXXXXXXXXXXXXXSTWLGRTISPRSRNGFEMLKIPNXXXXXXXXXXXXXXXXXXXXXXXXXXXXXXXXXXXXXXXXXXXXXXXXXXXXXXXXXXXXXXXXXXXXXXXXXXXGSGSLPDGAQIQYFX

SEQ ID NO: 419267 - protein, 471 aa, Influenza virus
  MOD_RES (1)..(149): Any amino acid
  MOD_RES (161)..(208): Any amino acid
  MOD_RES (219)..(361): Any amino acid
  MOD_RES (372)..(373): Any amino acid
  MOD_RES (387)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRNAFRGLISTXXXXXXXXXXXXXXXXXXXXXXXXXXXXXXXXXXXXXXXXXXXXXXXXRRLTTTVKTWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGRTISTRSRXXFEMLKVPNAEKDPXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419268 - protein, 471 aa, Influenza virus
  MOD_RES (1)..(210): Any amino acid
  MOD_RES (221)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPTTTIKTWARXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419269 - protein, 548 aa, Influenza virus
  MOD_RES (1)..(168): Any amino acid
  MOD_RES (201)..(201): Any amino acid
  MOD_RES (267)..(294): Any amino acid
  MOD_RES (326)..(344): Any amino acid
  MOD_RES (382)..(383): Any amino acid
  MOD_RES (408)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGFAPFSKDNGIRIGSRGHVFVIREPFVSCSPXECRTFFLTQGSLLNDKHSNGTVKDRSPYRTLMSVEIGQSPNVYQARFEAVAWSATACHDGKKWMTXXXXXXXXXXXXXXXXXXXXXXXXXXXXGDILRTQESSCTCIQGECYWVMTDGPANRQAXXXXXXXXXXXXXXXXXXXFNGGHIEECSCYPNEGKVECVCRDNWTGTNRPVLVISXXLSYRVGYLCAGLPSDTPRGEDSQFXXXXXXXXXXQGYGVKGFGFRQGNDVWXXXXXXXXXXXXXXXXXXXXXXXXXXXXXXXXXXXXDNLNWSGYSGSFTLPVELXXXNCLVPCFWVEMIRGKPEEXTIWTSSSSIVMCGVDHXXADWSWHDGAILPFDIDKIIT

SEQ ID NO: 419270 - protein, 548 aa, Influenza virus
  MOD_RES (1)..(168): Any amino acid
  MOD_RES (199)..(201): Any amino acid
  MOD_RES (267)..(294): Any amino acid
  MOD_RES (307)..(309): Any amino acid
  MOD_RES (326)..(344): Any amino acid
  MOD_RES (382)..(383): Any amino acid
  MOD_RES (407)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
  MOD_RES (542)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQGFAPFSKDNGIRIGSKGHVFVIREPFISCXXXGCRTFFLTQGSLPNDKHSNGTIKDRSPYRTLMSVKIGQSPNVYQSRFEAVAWSATACHDGRKWMTXXXXXXXXXXXXXXXXXXXXXXXXXXXXGNILRTQESSCSXXXGDCYWVMTDGPANKQAXXXXXXXXXXXXXXXXXXXFSGGHIEECSCYPNDGKVECVCRDNWTGTNRPILVISXXLSYTVGYLCAGIPTDTPRGEDSQXXXXXXXXXXXKGYGVKGFGFRQGTDVWXXXXXXXXXXXXXXXXXXXXXXXXXXXXXXXXXXXXDDPNWSGYSGSFTLPIELXXXDCLVPCFWVEMIRGEPEEXTIWTSSSSVVMCGVDHXXASWSWHDGAILPLXXXXXXX

SEQ ID NO: 419271 - protein, 548 aa, Influenza virus
  MOD_RES (1)..(168): Any amino acid
  MOD_RES (198)..(201): Any amino acid
  MOD_RES (267)..(294): Any amino acid
  MOD_RES (326)..(344): Any amino acid
  MOD_RES (382)..(383): Any amino acid
  MOD_RES (408)..(417): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGFAPFSKDNGIRIGSRGHIFVIREPFVSXXXXECRTFFLTHGSLLNDKHSSGTVKDRSPFRTLMSVEVGQSPNVYQAKFESVAWSATACHDGKKWTTXXXXXXXXXXXXXXXXXXXXXXXXXXXXGDIMRTQESSCTCIKGECFWVMTDGPANSQAXXXXXXXXXXXXXXXXXXXFDGGHIEECSCYPNNGKVECICRDNWTGTNRPVLIISXXLSYKVGYLCAGIPSDTPRGEDAQFXXXXXXXXXXLGYGVKGFGFRQGDDVWXXXXXXXXXXXXXXXXXXXXXXXXXXXXXXXXXXXXDNSNWSGYSGSFTLPVGLXXXGCLVPCFWVEMIRGRPEEXTVWTSSSSIVMCGVNYXXADWSWHDGAVLPFDFDKISQ

SEQ ID NO: 419272 - protein, 548 aa, Influenza virus
  MOD_RES (1)..(168): Any amino acid
  MOD_RES (179)..(186): Any amino acid
  MOD_RES (200)..(201): Any amino acid
  MOD_RES (240)..(240): Any amino acid
  MOD_RES (267)..(294): Any amino acid
  MOD_RES (305)..(309): Any amino acid
  MOD_RES (326)..(344): Any amino acid
  MOD_RES (369)..(369): Any amino acid
  MOD_RES (380)..(383): Any amino acid
  MOD_RES (395)..(395): Any amino acid
  MOD_RES (408)..(423): Any amino acid
  MOD_RES (435)..(470): Any amino acid
  MOD_RES (489)..(491): Any amino acid
  MOD_RES (510)..(510): Any amino acid
  MOD_RES (527)..(528): Any amino acid
  MOD_RES (540)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGFAPFSKDNXXXXXXXXHVFIIREPFVSCSXXDCRTFFLTQGSLVNDRHSNGTVKDRSPFRTLMSVKVGQXPNVYQARFESVAWSATACHDGNKWMTXXXXXXXXXXXXXXXXXXXXXXXXXXXXGDILRTHESSXXXXXGNCYWVMTDGPANNQAXXXXXXXXXXXXXXXXXXXFNEGHIEECSCYPNEGKVECICRDXWTGTNRPVVVXXXXLSYQVGYLCAGXPSDTPRGEDNQFXXXXXXXXXXXXXXXXGFGFRQGSDVWXXXXXXXXXXXXXXXXXXXXXXXXXXXXXXXXXXXXDNPNWSGYSGSFTLPVEMXXXSCLVPCFWVETIRGKPEEXAIWTSSSSIVMCGVDYXXASWSWHDGAVLXXXXXXXXX

SEQ ID NO: 419273 - protein, 548 aa, Influenza virus
  MOD_RES (1)..(170): Any amino acid
  MOD_RES (181)..(204): Any amino acid
  MOD_RES (267)..(294): Any amino acid
  MOD_RES (305)..(344): Any amino acid
  MOD_RES (356)..(370): Any amino acid
  MOD_RES (382)..(383): Any amino acid
  MOD_RES (395)..(395): Any amino acid
  MOD_RES (408)..(491): Any amino acid
  MOD_RES (502)..(516): Any amino acid
  MOD_RES (527)..(528): Any amino acid
  MOD_RES (548)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFAPYSKDNGIXXXXXXXXXXXXXXXXXXXXXXXXTFFITQGSLLNDRHSNGTMKDRSPYRTLMSVGIGQSANVYQAKFEAVAWSATACHDGKKWMAXXXXXXXXXXXXXXXXXXXXXXXXXXXXGDILRTQDSSXXXXXXXXXXXXXXXXXXXXXXXXXXXXXXXXXXXXXXXXFTEGHIEECSCXXXXXXXXXXXXXXXTGTNRPVLVVSXXLSYSVGYLCAGXPSDTPRGEDGQFXXXXXXXXXXXXXXXXXXXXXXXXXXXXXXXXXXXXXXXXXXXXXXXXXXXXXXXXXXXXXXXXXXXXXXXXXXXXXXXXXXXXECLVPCFWVEXXXXXXXXXXXXXXXSSIVMCGVEHXXANWSWHDGAILPFDFDKISX

SEQ ID NO: 419274 - protein, 548 aa, Influenza virus
  MOD_RES (1)..(207): Any amino acid
  MOD_RES (218)..(236): Any amino acid
  MOD_RES (249)..(299): Any amino acid
  MOD_RES (311)..(370): Any amino acid
  MOD_RES (381)..(531): Any amino acid
  MOD_RES (542)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTQGSLLNDRXXXXXXXXXXXXXXXXXXXIGLSPNVYQARFXXXXXXXXXXXXXXXXXXXXXXXXXXXXXXXXXXXXXXXXXXXXXXXXXXXTQESSCTCIRGXXXXXXXXXXXXXXXXXXXXXXXXXXXXXXXXXXXXXXXXXXXXXXXXXXXXXXXXXXXXKGTNRPVLVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWQDGAILPFXXXXXXX

SEQ ID NO: 419275 - protein, 548 aa, Influenza virus
  MOD_RES (1)..(209): Any amino acid
  MOD_RES (221)..(240): Any amino acid
  MOD_RES (251)..(299): Any amino acid
  MOD_RES (311)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQGSLLNDKHFNXXXXXXXXXXXXXXXXXXXXPNVYQAKFEAXXXXXXXXXXXXXXXXXXXXXXXXXXXXXXXXXXXXXXXXXXXXXXXXXTQESSCTCILGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419276 - protein, 548 aa, Influenza virus
  MOD_RES (1)..(214): Any amino acid
  MOD_RES (227)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNDKHSNGTMKDRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419277 - protein, 470 aa, Influenza virus
  MOD_RES (15)..(26): Any amino acid
  MOD_RES (40)..(53): Any amino acid
  MOD_RES (67)..(84): Any amino acid
  MOD_RES (260)..(269): Any amino acid
  MOD_RES (286)..(288): Any amino acid
  MOD_RES (310)..(310): Any amino acid
  MOD_RES (359)..(359): Any amino acid
  MOD_RES (392)..(392): Any amino acid
MNPNQKILCTSATAXXXXXXXXXXXXANLGLNIGLHLKPXXXXXXXXXXXXXXSQTIINNYYNETNXXXXXXXXXXXXXXXXXXFNNLTKGLCTINSWHIYGKDNAVRIGEDSDVLVTREPYVSCDPDECRFYALSQGTTIRGKHSNGTIHDRSQYRALISWPLSSPPTVYNSRVECIGWSSTSCHDGRARMSICISGPNNNASAVIWYNRRPVTEINTWARNILRTQESECVCHNGVCPVVFTDGSATGPAETRVYYFXXXXXXXXXXLTGTAKHIEECSCYGEXXXITCTCRDNWQGSNRPVIQIDPXAMTHTSQYICSPVLTDNPRPNDPAVGKCNDPYPGNNNNGVKGFSYLDGXNTWLGRTISTASRSGYEMLKVPNALTDDRSKPXQGQTIVLNTDWSGYSGSFMDYWAEGECYRACFYVELIRGRPKEDKVWWTSNSIVSMCSSTEFLGQWNWPDGAKIEYFL

SEQ ID NO: 419278 - protein, 470 aa, Influenza virus
  MOD_RES (15)..(26): Any amino acid
  MOD_RES (40)..(53): Any amino acid
  MOD_RES (67)..(84): Any amino acid
  MOD_RES (225)..(226): Any amino acid
  MOD_RES (260)..(269): Any amino acid
  MOD_RES (285)..(288): Any amino acid
  MOD_RES (310)..(310): Any amino acid
  MOD_RES (321)..(324): Any amino acid
  MOD_RES (359)..(359): Any amino acid
  MOD_RES (392)..(392): Any amino acid
  MOD_RES (426)..(426): Any amino acid
  MOD_RES (470)..(470): Any amino acid
MNPNQKILCASATAXXXXXXXXXXXXVNLGLNIGLHLRPXXXXXXXXXXXXXXSQTVINNYYNETNXXXXXXXXXXXXXXXXXXFNNLTRELCTINSWHIFGKDNAIRIGENSDVLVTREPYVSCEPDECRFYALSQGTTIRGRHSNGTIHDRSQYRSLISWPLSSPPTVYNTRIECIGWSSTSCHDGKSRMSICVSGPNNNASAIVWYNRRPVAEINTWARNIXXTQESECVCHSGICPVVFTDGSATGPADTRIYYFXXXXXXXXXXLAGTAKHIEECSSYGXXXXVTCTCRDNWQGSNRPVIRIDPXVMTHTSQYICXXXXTDNPRPNDPTIGKCNDPYPGNNBNGVKGFSYLNGXNTWLGRTISIASRSGYEMLKVPNALIDDRSKPXQGQTVVLNTDWSGYSGSFIDYWAKGECYRACFYXELIRGRPKEEKVWWTSNSIISMCSSTEFLGQWDWPDGAKIEYSX

SEQ ID NO: 419279 - protein, 470 aa, Influenza virus
  MOD_RES (15)..(26): Any amino acid
  MOD_RES (40)..(53): Any amino acid
  MOD_RES (67)..(84): Any amino acid
  MOD_RES (102)..(102): Any amino acid
  MOD_RES (138)..(150): Any amino acid
  MOD_RES (175)..(180): Any amino acid
  MOD_RES (224)..(226): Any amino acid
  MOD_RES (245)..(246): Any amino acid
  MOD_RES (260)..(269): Any amino acid
  MOD_RES (286)..(288): Any amino acid
  MOD_RES (310)..(310): Any amino acid
  MOD_RES (321)..(324): Any amino acid
  MOD_RES (359)..(359): Any amino acid
  MOD_RES (392)..(392): Any amino acid
  MOD_RES (447)..(455): Any amino acid
MNPNQKILFASATAXXXXXXXXXXXXANLGLNVGLHLKPXXXXXXXXXXXXXXSQTIINNYHNETNXXXXXXXXXXXXXXXXXXFNNLTRGLCTINSWHIHXKDNAVRIGENSGVLVTREPYVSCDPNECRFYALSQXXXXXXXXXXXXXHDRSQYRALVSWPLSSPPTVYNNRXXXXXXSSTSCHDGKARMSVCISGPNNNASAVVWYNGRPITEINTWARNXXXTQESECVCQNGVCPVVFTXXSATGPAETRIYYFXXXXXXXXXXLNGTAKHIEECSCYGVXXXIICTCRDNWQGSNRPVIQINPXMMTHTSQYICXXXXTDNPRPNDPNVGKCNEPYPGNNNNGVKGFAYLDGXNTWLGRTLNTASRSGYEMLKVPNALTDNRSKPXQGQTIVLTTDWSGYSGSFVDYWAEGDCYRACFYVELIRGRPKEDRVWWTSNSIVXXXXXXXXXGQWNWPDGAEIEYFL

SEQ ID NO: 419280 - protein, 470 aa, Influenza virus
  MOD_RES (13)..(26): Any amino acid
  MOD_RES (37)..(53): Any amino acid
  MOD_RES (67)..(84): Any amino acid
  MOD_RES (139)..(154): Any amino acid
  MOD_RES (194)..(197): Any amino acid
  MOD_RES (208)..(210): Any amino acid
  MOD_RES (221)..(227): Any amino acid
  MOD_RES (244)..(246): Any amino acid
  MOD_RES (260)..(275): Any amino acid
  MOD_RES (286)..(310): Any amino acid
  MOD_RES (321)..(324): Any amino acid
  MOD_RES (335)..(338): Any amino acid
  MOD_RES (356)..(359): Any amino acid
  MOD_RES (392)..(392): Any amino acid
  MOD_RES (405)..(406): Any amino acid
  MOD_RES (418)..(428): Any amino acid
  MOD_RES (447)..(458): Any amino acid
MNPNQRILCTSAXXXXXXXXXXXXXXTNLGLNIGLHXXXXXXXXXXXXXXXXXSRTIINNYYNKTNXXXXXXXXXXXXXXXXXXFNNLTKRLCTINSWHIFGKDNAVRIGEKSDVLVTREPYVSCDPDGCRFYALSQGXXXXXXXXXXXXXXXXQYRALISWPQSSPPTVYNSKVECIGWSSTSCHDGKFRMSXXXXGPNNNASPVIXXXKRPVTEINTWXXXXXXXQESECVCHDGVCPVVFXXXSATGPADTRVYYFXXXXXXXXXXXXXXXXHIEECSCYGKXXXXXXXXXXXXXXXXXXXXXXXXXTMTHTSQYICXXXXTDNPRPNDPVXXXXNDPYPGNSNNGVKGFSYXXXXNTWVGRTISIASRSGYEILKVPNALTDDKSKPXQGQIIVLNTDWSXXSGSFIDYWAEGXXXXXXXXXXXIRGRPKEDEVWWTSNSIVXXXXXXXXXXXXDWPDGAKIKYFL

SEQ ID NO: 419281 - protein, 470 aa, Influenza virus
  MOD_RES (1)..(1): Any amino acid
  MOD_RES (14)..(54): Any amino acid
  MOD_RES (65)..(84): Any amino acid
  MOD_RES (95)..(97): Any amino acid
  MOD_RES (125)..(164): Any amino acid
  MOD_RES (175)..(180): Any amino acid
  MOD_RES (193)..(198): Any amino acid
  MOD_RES (224)..(228): Any amino acid
  MOD_RES (246)..(310): Any amino acid
  MOD_RES (323)..(324): Any amino acid
  MOD_RES (335)..(338): Any amino acid
  MOD_RES (355)..(360): Any amino acid
  MOD_RES (391)..(393): Any amino acid
  MOD_RES (406)..(407): Any amino acid
  MOD_RES (427)..(459): Any amino acid
  MOD_RES (470)..(470): Any amino acid
XNPNQKIQCTSATXXXXXXXXXXXXXXXXXXXXXXXXXXXXXXXXXXXXXXXXXQTIINNYYNKXXXXXXXXXXXXXXXXXXXXFNNLTKELCTXXXWHIYGKDNAIRIGEDSDILVTREPYVSXXXXXXXXXXXXXXXXXXXXXXXXXXXXXXXXXXXXXXXXSSPPTVYSSRXXXXXXSSTSCHDGKTRMXXXXXXPNNNASTVIWYNGRPTTEINTWARNXXXXXESECVCHNGICPVVFTDXXXXXXXXXXXXXXXXXXXXXXXXXXXXXXXXXXXXXXXXXXXXXXXXXXXXXXXXXXXXXXXXXAMKHTSQYICSPXXTDNPRPNDPSXXXXNDPYPGSNNNGVKGFSXXXXXXTWLGRTTSTASRSGYEVLRVPNALTDDRSTXXXGQTIVLDTDWSGXXGSFIDYWAKEECYRACFYVXXXXXXXXXXXXXXXXXXXXXXXXXXXXXXXXXWPDGAKIETLX

SEQ ID NO: 419282 - protein, 470 aa, Influenza virus
  MOD_RES (1)..(3): Any amino acid
  MOD_RES (15)..(54): Any amino acid
  MOD_RES (67)..(85): Any amino acid
  MOD_RES (122)..(200): Any amino acid
  MOD_RES (211)..(232): Any amino acid
  MOD_RES (244)..(338): Any amino acid
  MOD_RES (354)..(361): Any amino acid
  MOD_RES (377)..(378): Any amino acid
  MOD_RES (392)..(395): Any amino acid
  MOD_RES (408)..(411): Any amino acid
  MOD_RES (426)..(470): Any amino acid
XXXNQKILCTSAIAXXXXXXXXXXXXXXXXXXXXXXXXXXXXXXXXXXXXXXXXQTIINNYYNDTNXXXXXXXXXXXXXXXXXXXNNLTKGLCIINSWHIYGKDNAVRIGESSDVLVTREPXXXXXXXXXXXXXXXXXXXXXXXXXXXXXXXXXXXXXXXXXXXXXXXXXXXXXXXXXXXXXXXXXXXXXXXXXXXXXXXNNASAVIWYKXXXXXXXXXXXXXXXXXXXXXXVCHSGVCPVVFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNDPYPGNNNKGVKGFXXXXXXXXWLGRTINTASRSGYEXXKVPNALTDERSKPXXXXTIVSNTDWSGYSXXXXDYWAKGDCYRACFYXXXXXXXXXXXXXXXXXXXXXXXXXXXXXXXXXXXXXXXXXXXXX

SEQ ID NO: 419283 - protein, 470 aa, Influenza virus
  MOD_RES (1)..(86): Any amino acid
  MOD_RES (100)..(234): Any amino acid
  MOD_RES (246)..(339): Any amino acid
  MOD_RES (351)..(363): Any amino acid
  MOD_RES (391)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXNLTRGLCKINSWHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHNGICPVAFTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPYPGNNNGVKXXXXXXXXXXXXXGRTISTASRAGYEMLKVPNALTNDRSKXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419284 - protein, 470 aa, Influenza virus
  MOD_RES (1)..(364): Any amino acid
  MOD_RES (381)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTISTASRYGYEMLKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419285 - protein, 568 aa, Influenza virus
  MOD_RES (1)..(15): Any amino acid
  MOD_RES (32)..(39): Any amino acid
  MOD_RES (53)..(65): Any amino acid
  MOD_RES (77)..(110): Any amino acid
  MOD_RES (126)..(168): Any amino acid
  MOD_RES (184)..(203): Any amino acid
  MOD_RES (245)..(248): Any amino acid
  MOD_RES (268)..(286): Any amino acid
  MOD_RES (321)..(321): Any amino acid
  MOD_RES (337)..(337): Any amino acid
  MOD_RES (483)..(486): Any amino acid
  MOD_RES (541)..(552): Any amino acid
XXXXXXXXXXXXXXXGLDKICLGHHAVSNGTXXXXXXXXKEEVTNATETVESXXXXXXXXXXXXXKDLGNCHPIGMXXXXXXXXXXXXXXXXXXXXXXXXXXXXXXXXXXNEEALRQKIMESGGIXXXXXXXXXXXXXXXXXXXXXXXXXXXXXXXXXXXXXXXXXXXQNFPQTTNTYRNTDSXXXXXXXXXXXXXXXXXXXXLYGTQSLSISVGSSTYQNNFVPVVGARPQVNGQSGRIDFHWXXXXPGDNITFSHNGGLIAPSRVXXXXXXXXXXXXXXXXXXXCESKCFWKGGSINTKLPFQNLSPRTVGQCPKYVNXKSLLLATGMRNVPEVXQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHXXXXNCMESIRNNTYDHTQYREEALLNRLNINPVKLSSGYKDVILWFSFGASCFVLLAXXXXXXXXXXXXGNMRCTISLVKTTLFL

SEQ ID NO: 419286 - protein, 568 aa, Influenza virus
  MOD_RES (1)..(15): Any amino acid
  MOD_RES (32)..(39): Any amino acid
  MOD_RES (53)..(65): Any amino acid
  MOD_RES (77)..(110): Any amino acid
  MOD_RES (126)..(168): Any amino acid
  MOD_RES (184)..(203): Any amino acid
  MOD_RES (245)..(248): Any amino acid
  MOD_RES (265)..(286): Any amino acid
  MOD_RES (321)..(321): Any amino acid
  MOD_RES (337)..(337): Any amino acid
  MOD_RES (396)..(401): Any amino acid
  MOD_RES (421)..(425): Any amino acid
  MOD_RES (483)..(486): Any amino acid
  MOD_RES (541)..(568): Any amino acid
XXXXXXXXXXXXXXXGIDKICLGHHAVPNGTXXXXXXXXQEEVTNATETVENXXXXXXXXXXXXXKDLGSCHPIGMXXXXXXXXXXXXXXXXXXXXXXXXXXXXXXXXXXNEGALRQKIMESGGVXXXXXXXXXXXXXXXXXXXXXXXXXXXXXXXXXXXXXXXXXXXQNFPQTANTYRNTDSXXXXXXXXXXXXXXXXXXXXLYGTQPLSISVGSSTYQNSFVPVVGARPLVNGQSGRIEFHWXXXXPGDSITFSHNGGLVAPXXXXXXXXXXXXXXXXXXXXXXCESKCFWRGGSINTRLPFQNLSPRTVGQCPKYVSXRSLLLATGMRNVPEIXQERGLFGAIAGFIENGWEGMIDGWYGFRHQNAQGIGQAADYKSTQTAINQITGKLNRLXXXXXXEFESIESEFNEIEHQIGNVXXXXXDSITYIWTYQAELLIAMENQHTIEMTDSEMLNLYDRVRKQLRQNAEEDGRGCFEIYHXXXXSCMESIRNNTYNHTQYREESLLNRLSINPVTLSSGYKDIILWFSFGASSFVLLAXXXXXXXXXXXXXXXXXXXXXXXXXXXX

SEQ ID NO: 419287 - protein, 568 aa, Influenza virus
  MOD_RES (1)..(15): Any amino acid
  MOD_RES (32)..(39): Any amino acid
  MOD_RES (50)..(65): Any amino acid
  MOD_RES (77)..(110): Any amino acid
  MOD_RES (126)..(168): Any amino acid
  MOD_RES (184)..(203): Any amino acid
  MOD_RES (245)..(248): Any amino acid
  MOD_RES (268)..(286): Any amino acid
  MOD_RES (321)..(321): Any amino acid
  MOD_RES (337)..(337): Any amino acid
  MOD_RES (360)..(365): Any amino acid
  MOD_RES (395)..(403): Any amino acid
  MOD_RES (423)..(430): Any amino acid
  MOD_RES (442)..(443): Any amino acid
  MOD_RES (464)..(486): Any amino acid
  MOD_RES (524)..(527): Any amino acid
  MOD_RES (541)..(568): Any amino acid
XXXXXXXXXXXXXXXGLDRICLGHHAVANGTXXXXXXXXHEEVTNATETXXXXXXXXXXXXXXXXKDLGNCHPVGMXXXXXXXXXXXXXXXXXXXXXXXXXXXXXXXXXXSEEALRQKIMKSGGIXXXXXXXXXXXXXXXXXXXXXXXXXXXXXXXXXXXXXXXXXXXQSFPQTTNTYRNTDTXXXXXXXXXXXXXXXXXXXXLYGAQSLSISVGSSIYQNSFVPVIGARPQVNGQRGRIDFHWXXXXPGDNITFLHNGGLIAPDRVXXXXXXXXXXXXXXXXXXXCESKCFWKSGSINTELPFQNLSPRTVGQCPKYVKXKSLMLATGMRNVPETXQGRGLFGAKAGFIENGWEGMVEXXXXXXHQNAQGTGQVADYKSTQAAVDQITGKLNRXXXXXXXXXESIESEFSETEHQIGNVINXXXXXXXXIWTYQEELLVAXXNQHTIDMGDSEMLNLYEGVRXXXXXXXXXXXXXXXXXXXXXXXNCMESIRDNTYDHSQYREEALLNRININPVELSSGYKXXXXWFSFGASCFILLAXXXXXXXXXXXXXXXXXXXXXXXXXXXX

SEQ ID NO: 419288 - protein, 568 aa, Influenza virus
  MOD_RES (1)..(15): Any amino acid
  MOD_RES (29)..(39): Any amino acid
  MOD_RES (50)..(65): Any amino acid
  MOD_RES (77)..(114): Any amino acid
  MOD_RES (125)..(168): Any amino acid
  MOD_RES (184)..(204): Any amino acid
  MOD_RES (245)..(248): Any amino acid
  MOD_RES (267)..(287): Any amino acid
  MOD_RES (309)..(321): Any amino acid
  MOD_RES (332)..(366): Any amino acid
  MOD_RES (396)..(405): Any amino acid
  MOD_RES (425)..(432): Any amino acid
  MOD_RES (443)..(444): Any amino acid
  MOD_RES (461)..(486): Any amino acid
  MOD_RES (523)..(568): Any amino acid
XXXXXXXXXXXXXXXSLDKICLGHHAVAXXXXXXXXXXXMEEVTNATETXXXXXXXXXXXXXXXXKDLDNCHPIGMXXXXXXXXXXXXXXXXXXXXXXXXXXXXXXXXXXXXXXLRQKVMESGGXXXXXXXXXXXXXXXXXXXXXXXXXXXXXXXXXXXXXXXXXXXXQNFPRTTNTYRNTDPXXXXXXXXXXXXXXXXXXXXXYGTQSLSISIGSSTYQNNFVPVIGARPKVNGQSGRINFHWXXXXPGDNITFSDNGGLIAPSRXXXXXXXXXXXXXXXXXXXXXKSKCFWRGGSIITELPFQNLSXXXXXXXXXXXXXRSLMLATGMRXXXXXXXXXXXXXXXXXXXXXXXXXXXXXXXXXXXQNAQGTGLAADYESTQAAIVQITGKLNRLXXXXXXXXXXIESEFNEIEYQIGNVINWTXXXXXXXXTYNAELLVAMXXQHTIDLADSEMLNLYDXXXXXXXXXXXXXXXXXXXXXXXXXXNCMERIRNNTYDHSQYREEALLNRLSINPVRLSSGYXXXXXXXXXXXXXXXXXXXXXXXXXXXXXXXXXXXXXXXXXXXXXX

SEQ ID NO: 419289 - protein, 568 aa, Influenza virus
  MOD_RES (1)..(18): Any amino acid
  MOD_RES (32)..(39): Any amino acid
  MOD_RES (50)..(65): Any amino acid
  MOD_RES (77)..(168): Any amino acid
  MOD_RES (179)..(205): Any amino acid
  MOD_RES (241)..(248): Any amino acid
  MOD_RES (268)..(287): Any amino acid
  MOD_RES (309)..(321): Any amino acid
  MOD_RES (332)..(369): Any amino acid
  MOD_RES (398)..(408): Any amino acid
  MOD_RES (422)..(445): Any amino acid
  MOD_RES (456)..(486): Any amino acid
  MOD_RES (524)..(568): Any amino acid
XXXXXXXXXXXXXXXXXXKICLGHHAVTNGTXXXXXXXXKEEVINATETXXXXXXXXXXXXXXXXRDLGNCHPIGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNFPQTTNTYXXXXXXXXXXXXXXXXXXXXXXXXXXXGTQSLSISVESSTYQNNFVPVMGARPQVNGQSGRVXXXXXXXXPGHNITFSHNGGRIAPSRVXXXXXXXXXXXXXXXXXXXXESKCFWREGSIKTKLPFQNLSXXXXXXXXXXXXXGSLLLATGMRXXXXXXXXXXXXXXXXXXXXXXXXXXXXXXXXXXXXXXQGTGQAADYESTQATIDQVTGKLNRLIEXXXXXXXXXXXEFSEIEHQISNVIXXXXXXXXXXXXXXXXXXXXXXXXHTIDMADSTMXXXXXXXXXXXXXXXXXXXXXXXXXXXXXXXPCMESIRNNTYDHAQYREEALLSRLNINSVKLSSGYKXXXXXXXXXXXXXXXXXXXXXXXXXXXXXXXXXXXXXXXXXXXXX

SEQ ID NO: 419290 - protein, 568 aa, Influenza virus
  MOD_RES (1)..(211): Any amino acid
  MOD_RES (245)..(249): Any amino acid
  MOD_RES (268)..(289): Any amino acid
  MOD_RES (305)..(373): Any amino acid
  MOD_RES (386)..(491): Any amino acid
  MOD_RES (529)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILVGSSTYQNNFVPVVRARPQVNGQSGRIVFHWXXXXXGDHITFSHNGGLIAPNRVXXXXXXXXXXXXXXXXXXXXXXKCFWKGGSIKTKLPFXXXXXXXXXXXXXXXXXXXXXXXXXXXXXXXXXXXXXXXXXXXXXXXXXXXXXXXXXXXXXXXXXXXXXQAADYKSTQKTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRNNTYDHSHYREEALLNRLNINSVKLFSGYKDIILWXXXXXXXXXXXXXXXXXXXXXXXXXXXXXXXXXXXXXXXX

SEQ ID NO: 419291 - protein, 568 aa, Influenza virus
  MOD_RES (1)..(213): Any amino acid
  MOD_RES (238)..(250): Any amino acid
  MOD_RES (264)..(289): Any amino acid
  MOD_RES (305)..(517): Any amino acid
  MOD_RES (528)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGSSTYQSNFVPVVGDRPLVNGQRXXXXXXXXXXXXXDNIIFSHNGGLIAXXXXXXXXXXXXXXXXXXXXXXXXXXKCFWKGGTINTKLPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSSSYKDIILXXXXXXXXXXXXXXXXXXXXXXXXXXXXXXXXXXXXXXXXX

SEQ ID NO: 419292 - protein, 568 aa, Influenza virus
  MOD_RES (1)..(216): Any amino acid
  MOD_RES (235)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSTYHNSFVPVVGARPKVNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419293 - protein, 561 aa, Influenza virus
  MOD_RES (1)..(15): Any amino acid
  MOD_RES (54)..(65): Any amino acid
  MOD_RES (77)..(78): Any amino acid
  MOD_RES (101)..(101): Any amino acid
  MOD_RES (131)..(150): Any amino acid
  MOD_RES (184)..(184): Any amino acid
  MOD_RES (246)..(246): Any amino acid
  MOD_RES (273)..(283): Any amino acid
  MOD_RES (337)..(337): Any amino acid
XXXXXXXXXXXXXXXGLDKICLGHHAVSNGTIVKTLTNEKEEVTNATETVESKXXXXXXXXXXXXKDLGNCHPIGMXXGTPACDLHLTGTWDTLIERDNSXAYCYPGATVNEEALRQKIMESGGIDKISTXXXXXXXXXXXXXXXXXXXXGGNSFYAELKWLVSKSKGQNFPQTTNTYRNTDSXEHLIIWGIHHPSSTQEKNDLYGTQSLSISVGSSTYQNNFVPVVGARPQVNGQSGRIDFHWTXVQPGDNITFSHNGGLIAPSRVSKLKGXXXXXXXXXXXDNDCESKCFWKGGSINTKLPFQNLSPRTVGQCPKYVNKKSLLLATGMRNVPEVXQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDDNCMESIRNNTYDHTQYREEALLNRLNINPVKLSSGYKDVILWFSFGASCFVLLAVIMGLVFFCLKNGNMRCTICI

SEQ ID NO: 419294 - protein, 561 aa, Influenza virus
  MOD_RES (1)..(15): Any amino acid
  MOD_RES (52)..(65): Any amino acid
  MOD_RES (77)..(78): Any amino acid
  MOD_RES (101)..(101): Any amino acid
  MOD_RES (131)..(150): Any amino acid
  MOD_RES (184)..(184): Any amino acid
  MOD_RES (246)..(246): Any amino acid
  MOD_RES (273)..(283): Any amino acid
  MOD_RES (304)..(310): Any amino acid
  MOD_RES (337)..(337): Any amino acid
  MOD_RES (356)..(369): Any amino acid
  MOD_RES (389)..(401): Any amino acid
  MOD_RES (421)..(430): Any amino acid
  MOD_RES (442)..(444): Any amino acid
  MOD_RES (464)..(465): Any amino acid
  MOD_RES (561)..(561): Any amino acid
XXXXXXXXXXXXXXXGIDKICLGHHAVPNGTIVKTLTSEKEEVINATETVEXXXXXXXXXXXXXXKDLGSCHPIGMXXGTPACDLYLTGTWDTLIERENAXAHCYPGATINEEALRQKIMESGGISKISTXXXXXXXXXXXXXXXXXXXXGGDSFYAELKWLISKSKEQNFPQTANTYRNTDSXEHLIVWGIHHPSSTKEKNDLYGTQPLSISVGSSTYQNSFVPVVGARPQVNGQSGRINFHWTXVRPGDNITFSHNGGLVAPSRVSKLRGXXXXXXXXXXXDNNCESKCFWRGGSINTKLPXXXXXXXTVGQCPKYVSKRSLLLATGMRNVPEIXQERGLFGAIAGFLENGWEXXXXXXXXXXXXXXQGTGQAADYESTQAAIDQIXXXXXXXXXXXXXEFESIESEFNEIEHQIGNVXXXXXXXXXXIWTYNAELLVAXXXQHTIDMADSTMLNLYERVRXXLRQNAEEDGRGCFEIYHKCDDSCMESIRNNTYDHAQYREEALLNRLSINPVKLSSGYKDIILWFSFGASCFILLAVVMGLVFFCLKNGNMRCTILX

SEQ ID NO: 419295 - protein, 561 aa, Influenza virus
  MOD_RES (1)..(15): Any amino acid
  MOD_RES (54)..(65): Any amino acid
  MOD_RES (77)..(78): Any amino acid
  MOD_RES (101)..(101): Any amino acid
  MOD_RES (118)..(118): Any amino acid
  MOD_RES (131)..(150): Any amino acid
  MOD_RES (184)..(184): Any amino acid
  MOD_RES (230)..(235): Any amino acid
  MOD_RES (246)..(246): Any amino acid
  MOD_RES (273)..(283): Any amino acid
  MOD_RES (309)..(311): Any amino acid
  MOD_RES (337)..(340): Any amino acid
  MOD_RES (360)..(373): Any amino acid
  MOD_RES (398)..(403): Any amino acid
  MOD_RES (423)..(432): Any amino acid
  MOD_RES (445)..(446): Any amino acid
  MOD_RES (470)..(473): Any amino acid
  MOD_RES (525)..(531): Any amino acid
  MOD_RES (561)..(561): Any amino acid
XXXXXXXXXXXXXXXGLDRICLGHHAVANGTIVKTLTNEQEEVTNATETVENKXXXXXXXXXXXXKDLGNCHPVGMXXGTPVCDPHLTGTWDTLIERGSSXAYCYPGTTVNEEALRQXIMESGGISKMSTXXXXXXXXXXXXXXXXXXXXGKNSFYAELKWLVSKTKGQNFPRTTNTYRNTDTXEHLITWGIHHPSSAQEKNDLYGAQSLSISVESSTYQNNFVPVIGAXXXXXXQSGRIDFHWAXIQPGDNITFSDNGGLIAPSRVTKLKGXXXXXXXXXXXDNSCESKCFWKGGSIKTKLPFQNLSXXXVGQCPKYVNQKSLMLATGMRNVPETXXXXGLFGAKAGFIENGWEGMVNXXXXXXXXXXXXXXQAADYKSTQKTIDQVTGKLNRLIEXXXXXXESIESEFSETEHQIGNVINXXXXXXXXXXTYQAELLIAMENXXTIDLADSEMLNLYDRVRKQLRQNXXXXGKGCFEIYHACDNNCMESIRNNTYDHSQYREEALLNRLNINSVKLSSGYKDXXXXXXXGASCFVLLAAIMGLVFFCLRNGNMRCTICX

SEQ ID NO: 419296 - protein, 561 aa, Influenza virus
  MOD_RES (1)..(15): Any amino acid
  MOD_RES (54)..(65): Any amino acid
  MOD_RES (77)..(78): Any amino acid
  MOD_RES (101)..(101): Any amino acid
  MOD_RES (118)..(118): Any amino acid
  MOD_RES (131)..(150): Any amino acid
  MOD_RES (184)..(184): Any amino acid
  MOD_RES (224)..(246): Any amino acid
  MOD_RES (271)..(291): Any amino acid
  MOD_RES (311)..(311): Any amino acid
  MOD_RES (332)..(374): Any amino acid
  MOD_RES (395)..(405): Any amino acid
  MOD_RES (425)..(451): Any amino acid
  MOD_RES (462)..(473): Any amino acid
  MOD_RES (498)..(507): Any amino acid
  MOD_RES (527)..(531): Any amino acid
  MOD_RES (556)..(561): Any amino acid
XXXXXXXXXXXXXXXSLDKICLGHHAVANGTVVKTLTNEHEEVTNATETVESTXXXXXXXXXXXXKDLDNCHPIGMXXGAPACDLHLTGMWDTLIERDNAXAYCYPGSTVNEEALRQXIMESGGIDKVSTXXXXXXXXXXXXXXXXXXXXGRNSFYAELKWLVSKNKGQSFPQTTNTYRNTDPXEHLIMWGIHHPSSTKEKNELYGTQSLSISIGSSTYQNNFXXXXXXXXXXXXXXXXXXXXXXXVQPGDNIIFSHNGGLIAPDRVSKLXXXXXXXXXXXXXXXXXXXXXFWRGGSINTRLPFQNLSPRXVGQCPKYVSQRSLMLATGMRXXXXXXXXXXXXXXXXXXXXXXXXXXXXXXXXXXXXXXXXXXXVADYKSTQAAVDQITGKLNRXXXXXXXXXXXIESEFNEIEYQIGNVINWTXXXXXXXXXXXXXXXXXXXXXXXXXXXDSEMLNLYEGXXXXXXXXXXXXGKGCFEIYHTCDDNCMERIRNNTYXXXXXXXXXXLNRLNINPVTLSSGYKDIIXXXXXGASCFVLLADIMGLFFFCLKNGNMXXXXXX

SEQ ID NO: 419297 - protein, 561 aa, Influenza virus
  MOD_RES (1)..(18): Any amino acid
  MOD_RES (54)..(65): Any amino acid
  MOD_RES (76)..(78): Any amino acid
  MOD_RES (101)..(101): Any amino acid
  MOD_RES (131)..(156): Any amino acid
  MOD_RES (179)..(184): Any amino acid
  MOD_RES (226)..(249): Any amino acid
  MOD_RES (273)..(321): Any amino acid
  MOD_RES (332)..(378): Any amino acid
  MOD_RES (394)..(473): Any amino acid
  MOD_RES (501)..(507): Any amino acid
  MOD_RES (527)..(531): Any amino acid
  MOD_RES (553)..(561): Any amino acid
XXXXXXXXXXXXXXXXXXKICLGHHAIPNGTIIKTLTNEKEKVTNATETVESRXXXXXXXXXXXXRDLGNCHPIGXXXGAPSCDLHLTGKWDTLIERENSXANCYPGATVNEGALRQKIMESGGIDKIGTXXXXXXXXXXXXXXXXXXXXXXXXXXAELKWLVSKDKGRNFPQTTNTYXXXXXXEHLVMWGIHHPSSTQEKNALYGTQSLSISVESSIYQNSFVPXXXXXXXXXXXXXXXXXXXXXXXXGDNITFLHNGGLIAPSRVSKLTGXXXXXXXXXXXXXXXXXXXXXXXXXXXXXXXXXXXXXXXXXXXXXXXXXGSLLLATGMRXXXXXXXXXXXXXXXXXXXXXXXXXXXXXXXXXXXXXXXXXXXXXXXKSTQAAIDQMTGKLNXXXXXXXXXXXXXXXXXXXXXXXXXXXXXXXXXXXXXXXXXXXXXXXXXXXXXXXXXXXXXXXXXXXXXXXXXXXXXXXXGKGCFEIYHNCDDNCMESIRDNTYDHTXXXXXXXLNRLNINPVRLSSGYKDIIXXXXXGASCFVLLAIIVGLVFFCLKNXXXXXXXXX

SEQ ID NO: 419298 - protein, 561 aa, Influenza virus
  MOD_RES (1)..(27): Any amino acid
  MOD_RES (38)..(83): Any amino acid
  MOD_RES (100)..(102): Any amino acid
  MOD_RES (113)..(194): Any amino acid
  MOD_RES (223)..(262): Any amino acid
  MOD_RES (273)..(380): Any amino acid
  MOD_RES (393)..(475): Any amino acid
  MOD_RES (486)..(486): Any amino acid
  MOD_RES (497)..(515): Any amino acid
  MOD_RES (534)..(561): Any amino acid
XXXXXXXXXXXXXXXXXXXXXXXXXXXSNGTIIKTLTXXXXXXXXXXXXXXXXXXXXXXXXXXXXXXXXXXXXXXXXXXXXXXDLHLTGIWDTLIERDNXXXYCYPGATMNEXXXXXXXXXXXXXXXXXXXXXXXXXXXXXXXXXXXXXXXXXXXXXXXXXXXXXXXXXXXXXXXXXXXXXXXXXXXXXXXXXXPSSTQERNDLYGTQSLSISVGSSIYQNSXXXXXXXXXXXXXXXXXXXXXXXXXXXXXXXXXXXXXXXXAPSRVSKLIGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTQATIDQITGKLXXXXXXXXXXXXXXXXXXXXXXXXXXXXXXXXXXXXXXXXXXXXXXXXXXXXXXXXXXXXXXXXXXXXXXXXXXXXXXXXXXXGCFEIYHRCDXPCMESIRNNTXXXXXXXXXXXXXXXXXXXVKLSSGYKNVILWFSFGAXXXXXXXXXXXXXXXXXXXXXXXXXXXX

SEQ ID NO: 419299 - protein, 561 aa, Influenza virus
  MOD_RES (1)..(27): Any amino acid
  MOD_RES (42)..(213): Any amino acid
  MOD_RES (228)..(483): Any amino acid
  MOD_RES (494)..(561): Any amino acid
XXXXXXXXXXXXXXXXXXXXXXXXXXXTNGTIVKTLTNEREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGSSTYHNSFVPVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCNDNCMESIRXXXXXXXXXXXXXXXXXXXXXXXXXXXXXXXXXXXXXXXXXXXXXXXXXXXXXXXXXXXXXXXXXXXX

SEQ ID NO: 419300 - protein, 471 aa, Influenza virus
  MOD_RES (18)..(19): Any amino acid
  MOD_RES (49)..(53): Any amino acid
  MOD_RES (75)..(82): Any amino acid
  MOD_RES (308)..(308): Any amino acid
  MOD_RES (332)..(333): Any amino acid
  MOD_RES (389)..(398): Any amino acid
  MOD_RES (416)..(416): Any amino acid
MNPNQKLFALSGVAIALXXLNLLIGISNVGLNVSLHLKEKGTKQEENLXXXXXTQNNTTLIENTYVNNTTVINKXXXXXXXXYLMLNKSLCKVEGWVVVAKDNAIRFGESEQIIVTREPYVSCDPLGCKMYALHQGTTIRNKHSNGTIHDRTAFRGLISTPLGSPPIVSNSDFLCVGWSSTSCHDGIGRMTICVQGNNDNATATVYYDRRLTTTIKTWAGNILRTQESECVCHNGTCVVIMTDGSASSQAYTKVLYFHKGLVIKEEALKGSARHIEECSCYGHNSKVTCVCRDNWQGANRPVIEIDMXAMEHTSQYLCTGVLTDTSRPSDKXXGDCNNPITGSPGAPGVKGFGFLDSGNTWLGRTISPRSRSGFEMLKIPNAGTDPNSXXXXXXXXXXNNNWSGYSGSFIDYWDEXSECYNPCFYVELIRGRPEEAKYVWWTSNSLVALCGSPISVGSGSFPDGAQIQYFS

SEQ ID NO: 419301 - protein, 471 aa, Influenza virus
  MOD_RES (18)..(19): Any amino acid
  MOD_RES (49)..(53): Any amino acid
  MOD_RES (75)..(82): Any amino acid
  MOD_RES (115)..(116): Any amino acid
  MOD_RES (308)..(308): Any amino acid
  MOD_RES (332)..(333): Any amino acid
  MOD_RES (389)..(398): Any amino acid
  MOD_RES (416)..(416): Any amino acid
MNPNQKLFTLSGVAIALXXLNLIIGISNVGLNISLHLKEKGAKQEENLXXXXXTQNNTTVVENTYVNNTTIITKXXXXXXXXYLVLNKSLCKVEEWVVIAKDNAVRFGESEQIIXXREPYVSCDPTGCKMYALHQGTTIRNRHSNGTIHDRTAFRGLMSTPLGTPPTVSNSDFICVGWSSTSCHDGVGRMTICVQGKNDNATATVYYNRRLTTTIKTWARNILRTQESECVCHNGTCAVVMTDGSASSQAHTKVLYFHKGIVIKEEPLKGSAKHIEECSCYGHDSKVTCICRDNWQGANRPIIEIDMXTLEHTSRYVCTGILTDTSRPGDKXXGDCSNPITGSPGAPGVKGFGFLNGSNTWLGRTISPHSRSGFEMLKVPNAGTDPNSXXXXXXXXXXNSNWSGYSGSFIDYWNDXNECYNPCFYVELIRGRPEEVKYVWWTSNSLIALCGSPFPVGSGSFPDGAKIQYFS

SEQ ID NO: 419302 - protein, 471 aa, Influenza virus
  MOD_RES (15)..(19): Any amino acid
  MOD_RES (49)..(53): Any amino acid
  MOD_RES (75)..(82): Any amino acid
  MOD_RES (136)..(154): Any amino acid
  MOD_RES (227)..(230): Any amino acid
  MOD_RES (308)..(308): Any amino acid
  MOD_RES (332)..(335): Any amino acid
  MOD_RES (368)..(373): Any amino acid
  MOD_RES (389)..(398): Any amino acid
  MOD_RES (416)..(416): Any amino acid
  MOD_RES (428)..(444): Any amino acid
MNPNQNLFTLSGVAXXXXXMNLLIGISNVGLKVSLHLKEKGPKQEENSXXXXXNQNNTTVVENKYVNNTTIISKXXXXXXXXYLLLNKSLCNVEGWVVIAKDNAIRFGEGEQIIVTREPYVSCDPSGCKMYALHQXXXXXXXXXXXXXXXXXXXRGLISTPLGTPPTVSNSEFLCVGWSSTTCHDGIGRMTICIQGNNDNATATVYYERRLTTTIKPWARNILRTQXXXXVCHNGTCVVVMTDGSASGQAYTKVMYFHKGLIIKEEVLKGSARHVEECSCYGHNQKITCVCRDNWQGANRPVIKIDMXVMEHTSQYLCTGILTDTSRPSDRXXXXCSNPITGSPSAPGVKGFGFLDGDNTWLGRTISXXXXXXFEMLKIPNAETDPNSXXXXXXXXXXNNKWSGYSGSFIDYWDDXSVCYNPCFYVEXXXXXXXXXXXXXXXXXSLVALCGSPVSVGSGSFPDGARIQYFS

SEQ ID NO: 419303 - protein, 471 aa, Influenza virus
  MOD_RES (1)..(1): Any amino acid
  MOD_RES (14)..(19): Any amino acid
  MOD_RES (30)..(38): Any amino acid
  MOD_RES (49)..(53): Any amino acid
  MOD_RES (64)..(64): Any amino acid
  MOD_RES (75)..(82): Any amino acid
  MOD_RES (102)..(103): Any amino acid
  MOD_RES (139)..(155): Any amino acid
  MOD_RES (231)..(235): Any amino acid
  MOD_RES (295)..(296): Any amino acid
  MOD_RES (308)..(308): Any amino acid
  MOD_RES (320)..(321): Any amino acid
  MOD_RES (332)..(335): Any amino acid
  MOD_RES (346)..(347): Any amino acid
  MOD_RES (374)..(374): Any amino acid
  MOD_RES (389)..(398): Any amino acid
  MOD_RES (410)..(416): Any amino acid
  MOD_RES (428)..(445): Any amino acid
  MOD_RES (464)..(471): Any amino acid
XNPKSKLFTLSGVXXXXXXFNLLIGISNVXXXXXXXXXERGTKQEENLXXXXXTGTAKQNYLMXYVNNTTVISKXXXXXXXXYLLLNKSLCSVEGWVVIAKXXAIRFGESEQVIVTREPYVSCDPLGCRMYALHQGTTXXXXXXXXXXXXXXXXXGLMSTPLGSPPVVSNSDFMCVGWSSTTCHDGVGRMTICIQGNNNNATATVYYDGRLTTTIKTWAGKILRTQESECXXXXXTCVVIMTDGPASSQAYTKIMYFHKGLVVKEETLKGSARHIEECPCYGHSQKVTCVCRDNXXGANRPVIEINMXAMDHTSQYLCTXXLTDTSKPSDKXXXXCNNPITGSPEXXGVKGFGFLDNDNTWLGGTISPRSRSGXEMLKIPNAGIDPNSXXXXXXXXXXNSDWSGYSGSFXXXXXXXSACYNPCFYVEXXXXXXXXXXXXXXXXXXLVALCGSPVPVGSGSFPDXXXXXXXX

SEQ ID NO: 419304 - protein, 471 aa, Influenza virus
  MOD_RES (1)..(5): Any amino acid
  MOD_RES (18)..(38): Any amino acid
  MOD_RES (49)..(54): Any amino acid
  MOD_RES (75)..(82): Any amino acid
  MOD_RES (97)..(120): Any amino acid
  MOD_RES (136)..(157): Any amino acid
  MOD_RES (168)..(172): Any amino acid
  MOD_RES (184)..(189): Any amino acid
  MOD_RES (218)..(237): Any amino acid
  MOD_RES (308)..(308): Any amino acid
  MOD_RES (321)..(336): Any amino acid
  MOD_RES (347)..(358): Any amino acid
  MOD_RES (374)..(377): Any amino acid
  MOD_RES (389)..(398): Any amino acid
  MOD_RES (409)..(416): Any amino acid
  MOD_RES (428)..(445): Any amino acid
  MOD_RES (464)..(471): Any amino acid
XXXXXKLFALSGVAVALXXXXXXXXXXXXXXXXXXXXXEKGPKQEENLXXXXXXQTNTTLIENTYVNKTTVINKXXXXXXXXYLMLSKSLCKVEGWXXXXXXXXXXXXXXXXXXXXXXXXVSCDPLGCKTYALHQXXXXXXXXXXXXXXXXXXXXXXISTPLGSPPVXXXXXFICVGWSSTTCXXXXXXMTICVQGNNNNATATVYYNGRLTTTIKTXXXXXXXXXXXXXXXXXXXXVVIMTDGPANSQAYTKILYFHKGLLIKEEALQGSARHIEECSCYGHSQKATCVCRDNWQGANRPIIEINMXAMKHTSQYLCTGXXXXXXXXXXXXXXXXDNPITGSPGAXXXXXXXXXXXXNTWLGRTFSPRSRSGXXXXKIPNAETDPSSXXXXXXXXXXNRNWSGYSGSXXXXXXXXSKCYNPCFYVEXXXXXXXXXXXXXXXXXXLIALCGSPFSVGSGSFPDXXXXXXXX

SEQ ID NO: 419305 - protein, 471 aa, Influenza virus
  MOD_RES (1)..(6): Any amino acid
  MOD_RES (18)..(85): Any amino acid
  MOD_RES (96)..(157): Any amino acid
  MOD_RES (174)..(189): Any amino acid
  MOD_RES (209)..(238): Any amino acid
  MOD_RES (252)..(310): Any amino acid
  MOD_RES (321)..(399): Any amino acid
  MOD_RES (411)..(446): Any amino acid
  MOD_RES (457)..(457): Any amino acid
  MOD_RES (471)..(471): Any amino acid
XXXXXXLFALSGVAITLXXXXXXXXXXXXXXXXXXXXXXXXXXXXXXXXXXXXXXXXXXXXXXXXXXXXXXXXXXXXXXXXXXXXLNKRLCKVEGXXXXXXXXXXXXXXXXXXXXXXXXXXXXXXXXXXXXXXXXXXXXXXXXXXXXXXXXXXXXXXISTPLGSPPMVSNSDFXXXXXXXXXXXXXXXXMTICVQGNNKNATATVYYDXXXXXXXXXXXXXXXXXXXXXXXXXXXXXXVIMTDGSANSQAYXXXXXXXXXXXXXXXXXXXXXXXXXXXXXXXXXXXXXXXXXXXXXXXXXXXXXXXXXXXEHTSQYICTGXXXXXXXXXXXXXXXXXXXXXXXXXXXXXXXXXXXXXXXXXXXXXXXXXXXXXXXXXXXXXXXXXXXXXXXXXXXXXXXNNLSGYSGSFIXXXXXXXXXXXXXXXXXXXXXXXXXXXXXXXXXXXXIALCGSPISVXSGSFPNGAQIQYFX

SEQ ID NO: 419306 - protein, 471 aa, Influenza virus
  MOD_RES (1)..(6): Any amino acid
  MOD_RES (18)..(162): Any amino acid
  MOD_RES (174)..(190): Any amino acid
  MOD_RES (201)..(201): Any amino acid
  MOD_RES (218)..(249): Any amino acid
  MOD_RES (260)..(471): Any amino acid
XXXXXXLFALSGMAIALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSPPIVSNSEFXXXXXXXXXXXXXXXXXIICIQGNNDNXTATVYYNRRPTTTIKTXXXXXXXXXXXXXXXXXXXXXXXXXXXXXXXXAHTKILYFHKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419307 - protein, 471 aa, Influenza virus
  MOD_RES (1)..(207): Any amino acid
  MOD_RES (218)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNRRLTTTIKPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419308 - protein, 565 aa, Influenza virus
  MOD_RES (1)..(14): Any amino acid
  MOD_RES (52)..(52): Any amino acid
  MOD_RES (113)..(157): Any amino acid
  MOD_RES (175)..(179): Any amino acid
  MOD_RES (190)..(234): Any amino acid
  MOD_RES (250)..(255): Any amino acid
  MOD_RES (275)..(293): Any amino acid
  MOD_RES (304)..(308): Any amino acid
  MOD_RES (339)..(340): Any amino acid
  MOD_RES (387)..(431): Any amino acid
  MOD_RES (464)..(467): Any amino acid
  MOD_RES (522)..(523): Any amino acid
  MOD_RES (549)..(551): Any amino acid
XXXXXXXXXXXXXXQADEICIGYLSNNSTEKVDTIIESNVTVTSSVELVENXHTGSFCSIDGKAPISLGDCSFAGWILGNPMCDDLIGKTSWSYIVEKPNPTNGICYPGTLEXXXXXXXXXXXXXXXXXXXXXXXXXXXXXXXXXXXXXXXXXXXXXSFFRNMVWLIHQSGTYPXXXXXFNNTKGRDVLXXXXXXXXXXXXXXXXXXXXXXXXXXXXXXXXXXXXXXXXXXXXXVNGQAGRMTFYWTIVXXXXXXTFESNGAFLAPRYAFELVSXXXXXXXXXXXXXXXXXXXCQSEIGGINTXXXXXNVHRNTIGDCPKYVNVKSLKLATGLRNVPAXXTRGLFGAIAGFIEGGWPGLINGWYGFQHRNEEGTGIAADKESTQKAXXXXXXXXXXXXXXXXXXXXXXXXXXXXXXXXXXXXXXXXXXXXXDIWSYNAQLLVLLENEKTLDLHDSNVRNLHEKXXXXLKDNAKDEGNGCFTFYHKCDNECIEKVRNGTYDHKEFEEESKLNRQEIEGVKLDXXGNVYKILSIYSCIASSLVLAAIIMGXXXWACSNGSCRCTICI

SEQ ID NO: 419309 - protein, 565 aa, Influenza virus
  MOD_RES (1)..(14): Any amino acid
  MOD_RES (52)..(52): Any amino acid
  MOD_RES (113)..(157): Any amino acid
  MOD_RES (175)..(179): Any amino acid
  MOD_RES (190)..(234): Any amino acid
  MOD_RES (250)..(255): Any amino acid
  MOD_RES (275)..(293): Any amino acid
  MOD_RES (304)..(308): Any amino acid
  MOD_RES (339)..(340): Any amino acid
  MOD_RES (351)..(361): Any amino acid
  MOD_RES (387)..(431): Any amino acid
  MOD_RES (464)..(467): Any amino acid
  MOD_RES (486)..(487): Any amino acid
  MOD_RES (522)..(523): Any amino acid
  MOD_RES (549)..(551): Any amino acid
  MOD_RES (563)..(565): Any amino acid
XXXXXXXXXXXXXXKADEICIGYLSNNSTDKVDTIIENNVTVTSSVELVETXHTGSFCSINGKQPISLGDCSFTGWILGNPMCDELIGKTSWSYIVERPNPANGICYPGSLDXXXXXXXXXXXXXXXXXXXXXXXXXXXXXXXXXXXXXXXXXXXXXSFFRHMVWLIHQSETYPXXXXXFNNTKERDVLXXXXXXXXXXXXXXXXXXXXXXXXXXXXXXXXXXXXXXXXXXXXXINGQAGRMTFYWKIVXXXXXXTFESNGAFIAPRYAFELVFXXXXXXXXXXXXXXXXXXXCQTEIGGINTXXXXXSVHRNTIGDCPKYMNVKSLKLASGLRNVPAXXSRGLFGAIAGXXXXXXXXXXXGWYGFQHRNDEGTGIAADKESTQTAXXXXXXXXXXXXXXXXXXXXXXXXXXXXXXXXXXXXXXXXXXXXXNIWSYNAQLLVWLENEKTLDLHDSNVKNLHEKXXXXLRDNAKDEGNGCFTFYHRXXNECIERVRNGTYDHKDFEEESKINRQEIEGVKLNXXGNIYKILSIYSCVASSLVLAALIMGXXXWTCSNGSCRCTXXX

SEQ ID NO: 419310 - protein, 565 aa, Influenza virus
  MOD_RES (1)..(14): Any amino acid
  MOD_RES (48)..(52): Any amino acid
  MOD_RES (113)..(157): Any amino acid
  MOD_RES (175)..(179): Any amino acid
  MOD_RES (190)..(237): Any amino acid
  MOD_RES (250)..(255): Any amino acid
  MOD_RES (275)..(293): Any amino acid
  MOD_RES (304)..(308): Any amino acid
  MOD_RES (339)..(340): Any amino acid
  MOD_RES (351)..(363): Any amino acid
  MOD_RES (387)..(431): Any amino acid
  MOD_RES (446)..(449): Any amino acid
  MOD_RES (464)..(467): Any amino acid
  MOD_RES (522)..(523): Any amino acid
  MOD_RES (549)..(551): Any amino acid
  MOD_RES (565)..(565): Any amino acid
XXXXXXXXXXXXXXRADEICIGYLSNNSTERVDTIIESNVTVTNSVEXXXXXHTGTFCSINGKAPISLGDCSFAGWLLGNPRCDDLIGKNSWSYIVEKPNPVNGICYPGILEXXXXXXXXXXXXXXXXXXXXXXXXXXXXXXXXXXXXXXXXXXXXXAFFRNMVWLIYQSGTYPXXXXXFNNTKGGDVLXXXXXXXXXXXXXXXXXXXXXXXXXXXXXXXXXXXXXXXXXXXXXXXXQAGRMTFYWAIVXXXXXXTFESDGAFLAPRYAFEIVSXXXXXXXXXXXXXXXXXXXCQTEVGGINTXXXXXNVHRSTIGDCPKYVNIKSLKLATGPRNVPAXXARGLFGAIAGXXXXXXXXXXXXXYGFQHRDEEGTGIAADRESTQKAXXXXXXXXXXXXXXXXXXXXXXXXXXXXXXXXXXXXXXXXXXXXXDIWSYNARLLVLLEXXXXLDLHDSNVRSLHEKXXXXLKGNAKDEGNGCFPFYHKCDNKCIERVRNGTYDHKEFEKESKLNRQEIGGVKLDXXGDVYKILSIYSCIASSLILAAIIMGXXXWACNNGSCRCTICX

SEQ ID NO: 419311 - protein, 565 aa, Influenza virus
  MOD_RES (1)..(14): Any amino acid
  MOD_RES (52)..(52): Any amino acid
  MOD_RES (113)..(157): Any amino acid
  MOD_RES (175)..(179): Any amino acid
  MOD_RES (190)..(237): Any amino acid
  MOD_RES (250)..(255): Any amino acid
  MOD_RES (274)..(293): Any amino acid
  MOD_RES (304)..(308): Any amino acid
  MOD_RES (339)..(340): Any amino acid
  MOD_RES (358)..(366): Any amino acid
  MOD_RES (387)..(431): Any amino acid
  MOD_RES (449)..(449): Any amino acid
  MOD_RES (462)..(467): Any amino acid
  MOD_RES (522)..(523): Any amino acid
  MOD_RES (549)..(551): Any amino acid
  MOD_RES (565)..(565): Any amino acid
XXXXXXXXXXXXXXQADEICIGYMSNNSTEKVDTIIENNVTVTSSIELVENXHTGSFCSLDGKAPISLGGCSFAGWILGNPRCDDLIEKTSWSYIVEKSNPINGICYPGTLGXXXXXXXXXXXXXXXXXXXXXXXXXXXXXXXXXXXXXXXXXXXXXSFFRNMIWLIDQSGTYPXXXXXFKNTKGRDVLXXXXXXXXXXXXXXXXXXXXXXXXXXXXXXXXXXXXXXXXXXXXXXXXQTGRMTFYWTMVXXXXXXTFESNGALLAPRYALELVXXXXXXXXXXXXXXXXXXXXCQSEIGWINTXXXXXNVHRNTIGNCPKYVNVRSLKLATGLRNIPAXXSRGLFGAKAGFIEGGWPXXXXXXXXXQHRNEEGTGVAADKESTQEAXXXXXXXXXXXXXXXXXXXXXXXXXXXXXXXXXXXXXXXXXXXXXDIWSYNAKLLVLLENEKXLDLHDSNVTNLHXXXXXXLQDNAKDEGNGCFTFYHKCNNECIEKIRNGTYDHKEFKEESRLNRQEIEGVRLDXXGNVYKILSICSCIASSLVLAALNMGXXXWACGNGSCRCTICX

SEQ ID NO: 419312 - protein, 565 aa, Influenza virus
  MOD_RES (1)..(15): Any amino acid
  MOD_RES (43)..(53): Any amino acid
  MOD_RES (73)..(75): Any amino acid
  MOD_RES (102)..(157): Any amino acid
  MOD_RES (175)..(179): Any amino acid
  MOD_RES (190)..(238): Any amino acid
  MOD_RES (249)..(255): Any amino acid
  MOD_RES (275)..(293): Any amino acid
  MOD_RES (304)..(308): Any amino acid
  MOD_RES (338)..(375): Any amino acid
  MOD_RES (386)..(432): Any amino acid
  MOD_RES (443)..(453): Any amino acid
  MOD_RES (464)..(467): Any amino acid
  MOD_RES (498)..(499): Any amino acid
  MOD_RES (520)..(535): Any amino acid
  MOD_RES (548)..(551): Any amino acid
  MOD_RES (563)..(565): Any amino acid
XXXXXXXXXXXXXXXADEICIGHLSNNSTDKVNTIIENNVTVXXXXXXXXXXXTGSFCSINGRAPISLGDCSXXXWILGNPMCDNLIGKTSWSYIVEKLNPXXXXXXXXXXXXXXXXXXXXXXXXXXXXXXXXXXXXXXXXXXXXXXXXXXXXXXXXSFFRNMVWLVHQSGTYPXXXXXFNNIKGRDVLXXXXXXXXXXXXXXXXXXXXXXXXXXXXXXXXXXXXXXXXXXXXXXXXXAGRMTFYWTMXXXXXXXIFESNGAFLAPGYAFEIVSXXXXXXXXXXXXXXXXXXXCQSEIGGISTXXXXXNVHRNAIGDCPKYVNVRSLKLAIGPRNVPXXXXXXXXXXXXXXXXXXXXXXXXXXXXXXXXXXXXXXIAADKESTQEXXXXXXXXXXXXXXXXXXXXXXXXXXXXXXXXXXXXXXXXXXXXXXXLWSYNAQLLVXXXXXXXXXXXDSNVRNLHERXXXXLKNNAKDEGNGCFTFYHKCDDECIEKVRNGXXDHKEFEEESRINRQEIEGVRXXXXXXXXXXXXXXXXIASSLILAALIMXXXXWVCSNGSCRCTXXX

SEQ ID NO: 419313 - protein, 565 aa, Influenza virus
  MOD_RES (1)..(16): Any amino acid
  MOD_RES (28)..(29): Any amino acid
  MOD_RES (48)..(56): Any amino acid
  MOD_RES (74)..(75): Any amino acid
  MOD_RES (102)..(238): Any amino acid
  MOD_RES (249)..(257): Any amino acid
  MOD_RES (275)..(309): Any amino acid
  MOD_RES (333)..(375): Any amino acid
  MOD_RES (386)..(471): Any amino acid
  MOD_RES (493)..(499): Any amino acid
  MOD_RES (521)..(535): Any amino acid
  MOD_RES (549)..(565): Any amino acid
XXXXXXXXXXXXXXXXDKICIGYLSNNXXEKVNTIIESNVTVTSSIEXXXXXXXXXFCSINGKEPISLGDCSFXXWILGNPMCDYLIGKTSWSYIVEKTNPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGRMTFYWIIXXXXXXXXXESNGVFLAPRYSFELVSXXXXXXXXXXXXXXXXXXXXXXXXXXXXXXXXXXXVHRNTFGDCPKYVNVKSLKLAIGXXXXXXXXXXXXXXXXXXXXXXXXXXXXXXXXXXXXXXXXXXXIAADKESTQRXXXXXXXXXXXXXXXXXXXXXXXXXXXXXXXXXXXXXXXXXXXXXXXXXXXXXXXXXXXXXXXXXXXXXXXXXXXXXXXXXXXXXXARDEGNGCFTFYHKCDNGCIEXXXXXXXDHKEFEKESRINRQEIEGARLXXXXXXXXXXXXXXXIASSLVLAASIMGXXXXXXXXXXXXXXXXX

SEQ ID NO: 419314 - protein, 565 aa, Influenza virus
  MOD_RES (1)..(36): Any amino acid
  MOD_RES (50)..(239): Any amino acid
  MOD_RES (250)..(324): Any amino acid
  MOD_RES (339)..(376): Any amino acid
  MOD_RES (387)..(511): Any amino acid
  MOD_RES (522)..(565): Any amino acid
XXXXXXXXXXXXXXXXXXXXXXXXXXXXXXXXXXXXESNITVTSSVELVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRMTFYWTIIXXXXXXXXXXXXXXXXXXXXXXXXXXXXXXXXXXXXXXXXXXXXXXXXXXXXXXXXXXXXXXXXXXXXXXXXXXXKSLKLVTGLRNVPAXXXXXXXXXXXXXXXXXXXXXXXXXXXXXXXXXXXXXXAADKESTQKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRQEVEGVKLDXXXXXXXXXXXXXXXXXXXXXXXXXXXXXXXXXXXXXXXXXXXX

SEQ ID NO: 419315 - protein, 564 aa, Influenza virus
  MOD_RES (1)..(14): Any amino acid
  MOD_RES (57)..(60): Any amino acid
  MOD_RES (152)..(152): Any amino acid
  MOD_RES (189)..(189): Any amino acid
  MOD_RES (205)..(219): Any amino acid
  MOD_RES (287)..(291): Any amino acid
  MOD_RES (406)..(410): Any amino acid
  MOD_RES (467)..(469): Any amino acid
  MOD_RES (489)..(492): Any amino acid
  MOD_RES (503)..(503): Any amino acid
XXXXXXXXXXXXXXFAYDKICIGYQTNNSTETVNTLIEQNVPVTQVEELVHGGIDPXXXXTELGSPLVLDDCSLEGLILGNPKCDLYLNGREWSYIVERPKEMEGICYPGSIENQEELRSLFSSIKKYERVKMFDFTKWNVTYTGTSKACNXTSNQGSFYRSMRWLTLKSGQFPVQTDEYKNTRDSDIXFTWAIHHPPTSDEQVXXXXXXXXXXXXXXXEINRSFKPNIGPRPLVRGQQGRMDYYWAVLKPGQTVKIQTNGNLIAPEYGHLITGKSHGRILKNNLPXXXXXTECQLNEGVMNTSKPFQNTSKHYIGKCPKYIPSGSLKLAIGLRNVPQAQDRGLFGAIAGFIEGGWPGLVAGWYGFQHQNAEGTGIAADRDSTQKAIDNMQNKLNNVIDKMNKQFXXXXXEFSEVESRINMINSKIDDQITDIWAYNAELLVLLENQKTLDEHDANVRNLHDRVRRXXXENAIDTGDGCFEILHKCDNXXXXTIRNGTYNHKXYEEESKIERQKINGVKLEENSTYKILSIYSSVASSLVLLLMIIGGFIFGCQNGNVRCTFCI

SEQ ID NO: 419316 - protein, 564 aa, Influenza virus
  MOD_RES (1)..(14): Any amino acid
  MOD_RES (57)..(60): Any amino acid
  MOD_RES (152)..(152): Any amino acid
  MOD_RES (189)..(189): Any amino acid
  MOD_RES (205)..(219): Any amino acid
  MOD_RES (287)..(291): Any amino acid
  MOD_RES (406)..(410): Any amino acid
  MOD_RES (451)..(452): Any amino acid
  MOD_RES (467)..(469): Any amino acid
  MOD_RES (489)..(492): Any amino acid
  MOD_RES (503)..(503): Any amino acid
  MOD_RES (525)..(533): Any amino acid
XXXXXXXXXXXXXXLAYDKICIGYQTNNSTDTVNTLIEQNIPVTQVEELVHRGIDPXXXXTELGAPLVLDDCSLKGLILGNPKCDPYLNGREWSYIVERTKEMEGICYPGSVENQEELRSLFSSIKRYERVKMFDFSKWNVTYTGTSRACNXISNQGSFYRNMRWLTLKSEQFPVQTDEYKNTGDSDIXFMWAIHHPPTSNEQVXXXXXXXXXXXXXXXEINRSFRPNIGPRPLVMGQQGRMDYYWAILKPGQTVKIKTNGNLIAPEYGYLITGKSHGRVLKNNLPXXXXXTGCQLNEGVMNTSKPLQNTSKHYIGKCPRYIPSGSLKLAIGPRNVPQAQNRGLFGAIAGFIEGRWPGLVAGWYGFQHQNSEGTGIAADRGSTQKAIDNMQNRLNNVIDKMNNQFXXXXXEFSKVETRINMINSKINDQITDIWAYNAELIVLLENQKTLXXHDANVRNLHERIRRXXXENAIDAGDGCFEILHRCDDXXXXTIKNGTYNHQXYEEESKLERQKVNGVKLEENSXXXXXXXXXSVASSLVLLFMIIGGFIFGCQNGNIRCTFCI

SEQ ID NO: 419317 - protein, 564 aa, Influenza virus
  MOD_RES (1)..(14): Any amino acid
  MOD_RES (25)..(27): Any amino acid
  MOD_RES (57)..(60): Any amino acid
  MOD_RES (123)..(127): Any amino acid
  MOD_RES (147)..(152): Any amino acid
  MOD_RES (189)..(189): Any amino acid
  MOD_RES (205)..(219): Any amino acid
  MOD_RES (245)..(250): Any amino acid
  MOD_RES (287)..(291): Any amino acid
  MOD_RES (358)..(364): Any amino acid
  MOD_RES (406)..(410): Any amino acid
  MOD_RES (440)..(454): Any amino acid
  MOD_RES (467)..(469): Any amino acid
  MOD_RES (489)..(492): Any amino acid
  MOD_RES (503)..(503): Any amino acid
  MOD_RES (526)..(564): Any amino acid
XXXXXXXXXXXXXXVAYDKICIGYXXXNSTETVNTLSEQNVPVTQVEELVHGQVNPXXXXTKLGSPLVLDDCSLEGIILGNPKCDLYLSGREWSYIVERPKEIEGICYPGSIKNQEELRSLFXXXXXYERVKMFDFIKWNVTYTGTXXXXXXTSNRGSFYRSMRWLTLKLGQFPVQTDEYKNTRDSNIXFIWAIHHPPTSAEQVXXXXXXXXXXXXXXXEINRIFRPNIGPRPLIRGQQGRMDYXXXXXXPGQTVKIQTSGNLIAPEYGHLVTGKSHGRILKNDLPXXXXXTKCQLNEGVMNTSKPFQNICKPYIGKCPKYISSGSLKLAIGLRNVPQVQNRGLFGAKAGFIEGGWPXXXXXXXGFQHQNAEGIGIAADRDSTQRAIDNMQNKLNNVIDKMYKQFXXXXXEFSEVETRINTINSKIDDQVTDIWAYNAEXXXXXXXXXXXXXXXANVRNLHDRIRRXXXENALDTGDGCFEILHRCNDXXXXTIRNGTYNHRXYEEESRIERQKISGVKLEENSTXXXXXXXXXXXXXXXXXXXXXXXXXXXXXXXXXXXXXXX

SEQ ID NO: 419318 - protein, 564 aa, Influenza virus
  MOD_RES (1)..(27): Any amino acid
  MOD_RES (57)..(68): Any amino acid
  MOD_RES (88)..(96): Any amino acid
  MOD_RES (129)..(133): Any amino acid
  MOD_RES (152)..(152): Any amino acid
  MOD_RES (173)..(190): Any amino acid
  MOD_RES (205)..(219): Any amino acid
  MOD_RES (244)..(262): Any amino acid
  MOD_RES (282)..(291): Any amino acid
  MOD_RES (348)..(366): Any amino acid
  MOD_RES (395)..(395): Any amino acid
  MOD_RES (406)..(410): Any amino acid
  MOD_RES (441)..(454): Any amino acid
  MOD_RES (467)..(469): Any amino acid
  MOD_RES (489)..(492): Any amino acid
  MOD_RES (503)..(503): Any amino acid
  MOD_RES (515)..(564): Any amino acid
XXXXXXXXXXXXXXXXXXXXXXXXXXXNSTETVNTLTEQNVPVTQVEELVHGGVDPXXXXXXXXXXXXLDDCSLEGLVLGNPKCDLYXXXXXXXXXVERPKEMEGVCYPGSIENQEELKSLFSSIKKYXXXXXFDFTKWNVTHTGTSKACNXISNQGSFYRSIRWLTLKSGQXXXXXXXXXXXXXXXXXXTWAIHHPPTTDEQMXXXXXXXXXXXXXXXEINRNFKPNIGPRPFVRGQQGRMDXXXXXXXXXXXXXXXXXXXLIAPEYGHLTTGKSHGRILXXXXXXXXXXTECQLNEGVINTSKPFQNTSRHYIGKCPKYIPSNSLKLAIGLRNVPQIQNRGLFGAXXXXXXXXXXXXXXXXXXXQHQNAEGTGMAADRDSTQMAIDNMQNKLXNVIDKMNKQLXXXXXEFSEVGSRINMINSQIDDQIIDIWAYNAELXXXXXXXXXXXXXXANVRNLHDRTRRXXXENAVDTGDGCFEILHKCNDXXXXTIRNGTYNHQXYEDESRIERQKXXXXXXXXXXXXXXXXXXXXXXXXXXXXXXXXXXXXXXXXXXXXXXXXXX

SEQ ID NO: 419319 - protein, 564 aa, Influenza virus
  MOD_RES (1)..(27): Any amino acid
  MOD_RES (41)..(45): Any amino acid
  MOD_RES (57)..(70): Any amino acid
  MOD_RES (90)..(103): Any amino acid
  MOD_RES (130)..(136): Any amino acid
  MOD_RES (152)..(152): Any amino acid
  MOD_RES (174)..(194): Any amino acid
  MOD_RES (205)..(219): Any amino acid
  MOD_RES (247)..(291): Any amino acid
  MOD_RES (310)..(315): Any amino acid
  MOD_RES (351)..(367): Any amino acid
  MOD_RES (399)..(410): Any amino acid
  MOD_RES (437)..(455): Any amino acid
  MOD_RES (467)..(469): Any amino acid
  MOD_RES (489)..(492): Any amino acid
  MOD_RES (503)..(504): Any amino acid
  MOD_RES (524)..(564): Any amino acid
XXXXXXXXXXXXXXXXXXXXXXXXXXXNSTDTVNTLTEQNXXXXXVEELVHGGINPXXXXXXXXXXXXXXDCSLEGLILSNPKCDLYLNXXXXXXXXXXXXXXEGVCYPGSIKNQEELRFLFSSIKKYEXXXXXXXTKWNVTYTGISKACNXTSNQDSFYRSMKWLTLKSGQFXXXXXXXXXXXXXXXXXXXXXHHPPTSDEQIXXXXXXXXXXXXXXXEIDRSFRPNIGPRPLVREQQGRMDYYWXXXXXXXXXXXXXXXXXXXXXXXXXXXXXXXXXXXXXXXXXXXXXTECQLNEGIMNTSKPFQNXXXXXXGKCPKYIPSRSLKLAIGLRNVPQVQDRGLFGAKAGXXXXXXXXXXXXXXXXXHQNSEGTGIVADRDSTQKAIDIMQNKLNNVIXXXXXXXXXXXXEFSEVEIRINMINSKIEDQITDIWAYXXXXXXXXXXXXXXXXXXXNVRNLHDRVKRXXXENAIDNGDGCFEILHKCDDXXXXTIRTGTYNHRXXEEESKLERQRINGVKLEENXXXXXXXXXXXXXXXXXXXXXXXXXXXXXXXXXXXXXXXXX

SEQ ID NO: 419320 - protein, 564 aa, Influenza virus
  MOD_RES (1)..(110): Any amino acid
  MOD_RES (123)..(329): Any amino acid
  MOD_RES (341)..(414): Any amino acid
  MOD_RES (427)..(564): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIENQEELRFLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIGPRNVPQVQXXXXXXXXXXXXXXXXXXXXXXXXXXXXXXXXXXXXXXXXXXXXXXXXXXXXXXXXXXXXXXXXXXXXXXXXXXVESRINTINSKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419321 - protein, 567 aa, Influenza virus
  MOD_RES (1)..(17): Any amino acid
  MOD_RES (86)..(89): Any amino acid
  MOD_RES (138)..(154): Any amino acid
  MOD_RES (165)..(172): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (468)..(472): Any amino acid
  MOD_RES (564)..(567): Any amino acid
XXXXXXXXXXXXXXXXXADRICVGYLSTNSSERVDTLLENGVPVTSSVDLVETNHTGTYCSLNGISPVHLGDCSFEGWIVGNPACXXXXGIREWSYLIEDPSAPHGLCYPGELDNNGELRHLFSGIRSFSRTELIPPXXXXXXXXXXXXXXXXXKGTNSFYRNLXXXXXXXXGGYPVIKKTYNNTTGRDVLVLWGIHHPXXXXXXXXXXXXXXPYTLVSTSSWSXXXXXXXGVRPGYNGQRSWMKIYWXXXXXXXXISFESNGGLLAPRYGYIIEEYGKGRIFQSRIRXXKCNTKCQTSVGGINTNKTFQNIERNALGDCPKYIKSGQLKLATGLRNVPAXXXRGLFGAIAGFIEGGWPGLINGWYGFQHQNEQGVGMAADKESTQKAIDQITTKINNIIDKMNGNYDSIRGEFNQVEKRINMLADRIDDAVTDVWSYNAKLLVLLENDKTLDMHDANVRNLHDQVRXXXXXNAIDEGNGCFELLHKCNDSCMETIRNGTYNHTEYAEESKLKRQEIEGIKLKSEDNVYKALSIYSCIASSVVLVGLILAFIMWACSSGNCRFXXXX

SEQ ID NO: 419322 - protein, 567 aa, Influenza virus
  MOD_RES (1)..(17): Any amino acid
  MOD_RES (86)..(89): Any amino acid
  MOD_RES (138)..(154): Any amino acid
  MOD_RES (165)..(179): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (356)..(366): Any amino acid
  MOD_RES (468)..(472): Any amino acid
  MOD_RES (564)..(567): Any amino acid
XXXXXXXXXXXXXXXXXADKICVGYLSTNSTEKVDTLLENDVPVTSSVDLIETNHTGTYCSLDGVSPVHLGDCSFEGWIGGNPACXXXXGTREWSYLIEDPGAPHGLCYPGELNNNGELRHLFSGIKSFSRTELIAPXXXXXXXXXXXXXXXXXTGTSSFYRNLXXXXXXXXXXXXXXXGTYNNTTGRDVLVMWGIHHPXXXXXXXXXXXXXXPYTLVSTKSWSXXXXXXXGIRPGYNGQKSWMKIYWXXXXXXXXITFESNGGLLAPKYGYIIEEYGRGRIFQSRIRXXRCNTKCQTSVGGIDTNKTFQNIDKNALGDCPKYIKSDQLKLATGLRNIPAXXXRGFFGAIAGFIEXXXXXXXXXXXGFQHQNEQGTGIAADKESTQKAIDRITTKINNIIEKMNGNYDSIRGEFSQVEQRINMLADRIDDAVTDIWSYNAKLLVLLENDKTLNMHDANVRNLHEQVRXXXXXNAVDEGNGCFELLHKCNNSCMETIRNGTYDHTEYEEESKLKRQEINGIKLKSDDSVYKALSIYSCIASSIVLVGLILSFIMWACSNGSCRFXXXX

SEQ ID NO: 419323 - protein, 567 aa, Influenza virus
  MOD_RES (1)..(17): Any amino acid
  MOD_RES (86)..(89): Any amino acid
  MOD_RES (112)..(123): Any amino acid
  MOD_RES (138)..(154): Any amino acid
  MOD_RES (165)..(179): Any amino acid
  MOD_RES (200)..(213): Any amino acid
  MOD_RES (225)..(231): Any amino acid
  MOD_RES (249)..(256): Any amino acid
  MOD_RES (275)..(276): Any amino acid
  MOD_RES (289)..(290): Any amino acid
  MOD_RES (341)..(343): Any amino acid
  MOD_RES (359)..(366): Any amino acid
  MOD_RES (386)..(409): Any amino acid
  MOD_RES (429)..(431): Any amino acid
  MOD_RES (468)..(472): Any amino acid
  MOD_RES (564)..(567): Any amino acid
XXXXXXXXXXXXXXXXXADRICIGYLSTNSSEKVDTLLENNVPVTSSIDLIETTHTGTYCSLGGVSPVHLGDCRFEGWIVGNPSCXXXXGVREWSYLIEDPAAPHGLCYPGXXXXXXXXXXXXSGIKSFSRTQLIAPXXXXXXXXXXXXXXXXXTGTNSFYRNLXXXXXXXXXXXXXXXRTYNNTTGRDVLVIWGIHHPXXXXXXXXXXXXXXPYTLVSTGSWSXXXXXXXGVRPGYNGQKSWTKIYWXXXXXXXXITFESNGGFLAPRYGYIIXXYGKGRIFQSPIRXXRCNTRCQTSVGGINTNRTFQNIDKNALGECPKYIKSDQLKLATGLKNVPAXXXRAVDGTIAGFIEGGWXXXXXXXXGFQHQNEQGMGMAADKESTXXXXXXXXXXXXXXXXXXXXXXXXIRGEFNQVENRINMLADRIXXXVTDIWSYNARLLVLLENDKTLDLHDANVRNLHDQIRXXXXXNAINEGNGCFELLHKCNNTCMETIRNGTYNHAKYEEESKLKRQEIDGIKLKSDDNVYKALSIYSCIASSIVMVGLILAFIMWTCNSGNCRFXXXX

SEQ ID NO: 419324 - protein, 567 aa, Influenza virus
  MOD_RES (1)..(22): Any amino acid
  MOD_RES (84)..(92): Any amino acid
  MOD_RES (112)..(126): Any amino acid
  MOD_RES (137)..(154): Any amino acid
  MOD_RES (165)..(179): Any amino acid
  MOD_RES (200)..(213): Any amino acid
  MOD_RES (225)..(231): Any amino acid
  MOD_RES (243)..(256): Any amino acid
  MOD_RES (267)..(276): Any amino acid
  MOD_RES (289)..(304): Any amino acid
  MOD_RES (323)..(326): Any amino acid
  MOD_RES (337)..(343): Any amino acid
  MOD_RES (357)..(368): Any amino acid
  MOD_RES (386)..(409): Any amino acid
  MOD_RES (429)..(450): Any amino acid
  MOD_RES (468)..(484): Any amino acid
  MOD_RES (505)..(511): Any amino acid
  MOD_RES (537)..(537): Any amino acid
  MOD_RES (557)..(567): Any amino acid
XXXXXXXXXXXXXXXXXXXXXXVGYLSTNSSDKVDTLLESDVPVTSSIDLVETSHTGTYCSLSGVSPVHLGDCNFEGWIVGNPXXXXXXXXXEWSYLIEDPTAPHGLCYPGXXXXXXXXXXXXXXXRSFSRTELIAXXXXXXXXXXXXXXXXXXRGTNSFYRNLXXXXXXXXXXXXXXXGAYNNTTGRDVLVMWGLHHPXXXXXXXXXXXXXXPYTLVSTRSWSXXXXXXXGTRPGYNGQKSXXXXXXXXXXXXXXVSFESNGGLLXXXXXXXXXXYGKGRIFQSHIRXXXXXXXXXXXXXXXXTNRTFQNIDRNALGDCPKXXXXGQLKLATGLKXXXXXXXRGLLGAIAGFIEGXXXXXXXXXXXXQHQNEQGVGIAADKESTXXXXXXXXXXXXXXXXXXXXXXXXIRGEFSQVERRINMLADRIXXXXXXXXXXXXXXXXXXXXXXTLDMHDANVKNLHEQVRXXXXXXXXXXXXXXXXXLHKCNDSCMDTIRNGTYNHIXXXXXXXLKRQEIEGIRLKSEDGVYKALSIYSXIASSVVLVGPILSFIMWAGXXXXXXXXXXX

SEQ ID NO: 419325 - protein, 567 aa, Influenza virus
  MOD_RES (1)..(25): Any amino acid
  MOD_RES (54)..(96): Any amino acid
  MOD_RES (116)..(154): Any amino acid
  MOD_RES (165)..(179): Any amino acid
  MOD_RES (191)..(213): Any amino acid
  MOD_RES (225)..(231): Any amino acid
  MOD_RES (246)..(278): Any amino acid
  MOD_RES (289)..(309): Any amino acid
  MOD_RES (329)..(330): Any amino acid
  MOD_RES (341)..(371): Any amino acid
  MOD_RES (391)..(409): Any amino acid
  MOD_RES (425)..(456): Any amino acid
  MOD_RES (468)..(494): Any amino acid
  MOD_RES (505)..(513): Any amino acid
  MOD_RES (540)..(542): Any amino acid
  MOD_RES (564)..(567): Any amino acid
XXXXXXXXXXXXXXXXXXXXXXXXXLSTNSSEKVNTLLENDVPVTSTIDLIETXXXXXXXXXXXXXXXXXXXXXXXXXXXXXXXXXXXXXXXXXXXLIEDPSAPHRLCYPGELDNXXXXXXXXXXXXXXXXXXXXXXXXXXXXXXXXXXXXXXXKGFNSFYRNLXXXXXXXXXXXXXXXGVYNNTTGRDVXXXXXXXXXXXXXXXXXXXXXXXPYTLVTTSSWSXXXXXXXGVRPRYNGQRSWMKXXXXXXXXXXXXXXXXXXXXXXXXXXXXXXXXXKGRIFQSRIIXXXXXXXXXXXXXXXXXXXXXQNIERNALGNCPKYIKSGQXXLATGLRNVPTXXXXXXXXXXXXXXXXXXXXXXXXXXXXXXXNEQGTGIAAEKESTQKAIDXXXXXXXXXXXXXXXXXXXIRGEFNQVEQRINMLXXXXXXXXXXXXXXXXXXXXXXXXXXXXXXXXANVRNLHEQIKXXXXXXXXXXXXXXXXXXXXXXXXXXXTIRNGTYNHSXXXXXXXXXRQEIEGIKLESEDNVYRALSIYSCIAXXXVLVGLILTFIMWACNSGNCRFXXXX

SEQ ID NO: 419326 - protein, 567 aa, Influenza virus
  MOD_RES (1)..(37): Any amino acid
  MOD_RES (48)..(330): Any amino acid
  MOD_RES (341)..(550): Any amino acid
  MOD_RES (564)..(567): Any amino acid
XXXXXXXXXXXXXXXXXXXXXXXXXXXXXXXXXXXXXLENGVPVTSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLATGLRNVPSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFIMWACSNGNCRFXXXX

SEQ ID NO: 419327 - protein, 568 aa, Influenza virus; identical to SEQ ID NO: 418424

SEQ ID NO: 419328 - protein, 568 aa, Influenza virus
  MOD_RES (1)..(9): Any amino acid
  MOD_RES (22)..(163): Any amino acid
  MOD_RES (183)..(568): Any amino acid
XXXXXXXXXGSEHTAYSQITNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFSRLNWLTKETNGNYGPINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419329 - protein, 570 aa, Influenza virus; identical to SEQ ID NO: 418426

SEQ ID NO: 419330 - protein, 570 aa, Influenza virus
  MOD_RES (1)..(7): Any amino acid
  MOD_RES (67)..(76): Any amino acid
  MOD_RES (99)..(99): Any amino acid
  MOD_RES (119)..(120): Any amino acid
  MOD_RES (149)..(152): Any amino acid
  MOD_RES (190)..(196): Any amino acid
  MOD_RES (229)..(267): Any amino acid
  MOD_RES (287)..(309): Any amino acid
  MOD_RES (333)..(337): Any amino acid
  MOD_RES (357)..(400): Any amino acid
  MOD_RES (420)..(519): Any amino acid
  MOD_RES (539)..(570): Any amino acid
XXXXXXXILVLGLSMVRSDKICLGHHAVPNGTKVNTLTEKGVEVVNATETVEITGINKVCTKGKKAXXXXXXXXXXTIIGPPQCDSHLKFKADLIIERXNSSDICYPGKFTNEEALRQXXRESGGIDKEPMGFRYSGIKTDGATSACKXXXXSFYSEMKWLLSSKANQVFPQLNQTYRNNRKEPALIVWXXXXXXXLDEQNKLYGAGNKLITVGSSKYRQSFSPSPGAXXXXXXXXXXXXXXXXXXXXXXXXXXXXXXXXXXXXXXXFLRSNAPSGVEYNGKSLGIXXXXXXXXXXXXXXXXXXXXXXXPLPFQNIDSWAVGRCPRYVKQSSXXXXXGMKNVPEKIHTRGLFGAIAXXXXXXXXXXXXXXXXXXXXXXXXXXXXXXXXXXXXXXXXXXXXLNRLIEKTNTQFELIDNEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIMINPVKLSGGYKDVILWFXXXXXXXXXXXXXXXXXXXXXXXXXXXXXXXX

SEQ ID NO: 419331 - protein, 570 aa, Influenza virus
  MOD_RES (1)..(155): Any amino acid
  MOD_RES (175)..(218): Any amino acid
  MOD_RES (238)..(338): Any amino acid
  MOD_RES (365)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSEMKWLSSSGNNQVFPQLNXXXXXXXXXXXXXXXXXXXXXXXXXXXXXXXXXXXXXXXXXXXXQQSFSPSPGDRPKVNGQAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMKNVPEKIRVKRRPVAKAGFIENGWEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419332 - protein, 570 aa, Influenza virus
  MOD_RES (1)..(156): Any amino acid
  MOD_RES (176)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEMKWLLSSKDNQVFPQLNQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419333 - protein, 569 aa, Influenza virus
  MOD_RES (12)..(15): Any amino acid
  MOD_RES (160)..(160): Any amino acid
  MOD_RES (172)..(173): Any amino acid
  MOD_RES (343)..(343): Any amino acid
  MOD_RES (471)..(471): Any amino acid
QPNDGQVLYFLXXXXGRYSKADKICIGYLSNNSSDTVDTLTENGVPVTSSIDLVETNHTGTYCSLNGVSPIHLGDCSFEGWIVGNPSCATNINIREWSYLIEDPNAPNKLCFPGELDNNGELRHLFSGVNSFSRTELISPSKWGNVLDGVTASCLDRGAXSFYRNLVWLVKXXNGKYPVIKGDYNNTTGRDVLVLWGIHHPDTEATATNLYVNKNPYTLVSTKEWSKRYELEIGTRIGDGQRSWMKLYWHLMRPGERITFESNGGLLAPRYGYIIEKYGTGRIFQSGVRMAKCNTKCQTSMGGINTNKTFQNIERNALGDCPKYIKSGQLKLATGLRNVPSIXGERGLFGAIAGFIEGGWPGLINGWYGFQHQNEQGTGIAADKASTQKAIDEITTKINNIIEKMNGNYDSIRGEFNQVEKRINMLADRVDDAVTDIWSYNAKLLVLIENDRTLDLHDANVRNLHDQVKRXLKNNAIDEGDGCFNLLHKCNDSCMETIRNGTYNHEDYKEESQLKRQEIEGIKLKTEDNVYKVLSIYSCIASSIVMVGLILAFIMWACSSGNCRFNVCI

SEQ ID NO: 419334 - protein, 569 aa, Influenza virus
  MOD_RES (1)..(15): Any amino acid
  MOD_RES (78)..(80): Any amino acid
  MOD_RES (126)..(129): Any amino acid
  MOD_RES (160)..(160): Any amino acid
  MOD_RES (172)..(173): Any amino acid
  MOD_RES (193)..(193): Any amino acid
  MOD_RES (328)..(331): Any amino acid
  MOD_RES (351)..(375): Any amino acid
  MOD_RES (402)..(416): Any amino acid
  MOD_RES (471)..(471): Any amino acid
XXXXXXXXXXXXXXXVKYSRADKICIGYLSNNATDTVDTLTENGVPVTSSVDLVETNHTGTYCSLNGISPIHLGDCSXXXWIVGNPSCASNINIREWSYLIEDPNAPHKLCFPGEVDNNGELRHLXXXXNSFSRTELINPSKWGDILEGTTASCQNRGAXSFYRNLIWLVNXXIGEYPVVKGEYNNTTGRDVXVLWGIHHPDSETTATKLYVNKNPYTLVSTKEWSRRYELEIGTRIGEGQRSWMKIYWHLMHPGERIMFESNGGLIAPRYGYIIEKYGSGRIFQSGVRLAKCNTKCQTSVGGIDTNKTFQNIDRNAIGDCPKYIKSXXXXLATGLRNVPIPIGERGLFGXXXXXXXXXXXXXXXXXXXXXXXXXQGTGIAADKTSTQKAINEITTKINNIXXXXXXXXXXXXXXXNQVEKRINMIADRVDDAVTDVWSYNAKLLVLLENGRTLDLHDANVKNLHEQVKRXLKDNAIDEGDGCFSILHKCNDSCMEAIRNGTYNHEDYREESQLKRQEIEGIKLKSEDNVYKVLSIYSCIASSTVLVGLILAFIMWACSNGSCRFNVCI

SEQ ID NO: 419335 - protein, 569 aa, Influenza virus
  MOD_RES (1)..(15): Any amino acid
  MOD_RES (46)..(61): Any amino acid
  MOD_RES (81)..(100): Any amino acid
  MOD_RES (122)..(129): Any amino acid
  MOD_RES (160)..(160): Any amino acid
  MOD_RES (172)..(179): Any amino acid
  MOD_RES (190)..(195): Any amino acid
  MOD_RES (218)..(225): Any amino acid
  MOD_RES (273)..(277): Any amino acid
  MOD_RES (325)..(332): Any amino acid
  MOD_RES (343)..(343): Any amino acid
  MOD_RES (354)..(375): Any amino acid
  MOD_RES (395)..(419): Any amino acid
  MOD_RES (439)..(441): Any amino acid
  MOD_RES (471)..(471): Any amino acid
  MOD_RES (495)..(506): Any amino acid
XXXXXXXXXXXXXXXGRYSIADKICIGYLSNNSTDKVDTLTENGVXXXXXXXXXXXXXXXXYCSLNGVSPVHLGDCSFEGXXXXXXXXXXXXXXXXXXXXIEDPNAPNKFCYPGELDNNGEXXXXXXXXNSFSRTELIPPSKWGDVLDGVTASCRDNGAXSFYRNLVWIVKXXXXXXXXVKGDYNNTTGXXXXXXWGIHHPDTETTANKLYVNKNPYXXXXXXXXSKRYELEIGARIGEGQRSWMKLYWHLMHPGERITFESSGGLLAPRYGXXXXXYGTGRIFQSRIRMGKCNTKCQTSLGGINTNKTFQNIDKNALGDCPKYXXXXXXXXATGLRNVPSVXNERGLFGAIAXXXXXXXXXXXXXXXXXXXXXXQGTGIAADKVSTQKAINEIXXXXXXXXXXXXXXXXXXXXXXXXXEKRINMLADWVDDAVTDIWXXXAKLLVLLENDRTLDLHDANVRNLHEQIKRXLKSNAIDEGDGCFSLLHKCNDSCXXXXXXXXXXXXDYREESQLKKQEIEGIKLKTEDNIYKILSIYSCIASSVVLVGLILAFILWACSSGNCRFSVCI

SEQ ID NO: 419336 - protein, 569 aa, Influenza virus
  MOD_RES (1)..(15): Any amino acid
  MOD_RES (53)..(61): Any amino acid
  MOD_RES (78)..(102): Any amino acid
  MOD_RES (120)..(131): Any amino acid
  MOD_RES (160)..(161): Any amino acid
  MOD_RES (172)..(179): Any amino acid
  MOD_RES (191)..(195): Any amino acid
  MOD_RES (223)..(237): Any amino acid
  MOD_RES (269)..(278): Any amino acid
  MOD_RES (324)..(343): Any amino acid
  MOD_RES (354)..(381): Any amino acid
  MOD_RES (401)..(445): Any amino acid
  MOD_RES (471)..(471): Any amino acid
  MOD_RES (497)..(523): Any amino acid
XXXXXXXXXXXXXXXGRYSRADKICIGYLSNNSTDTVDTLTETGVPVTSSVDXXXXXXXXXYCSLNGISPVHLGDCSXXXXXXXXXXXXXXXXXXXXXXXXXDPNAPNKLCYPGELDNNXXXXXXXXXXXXFSRTELINPNKWGNVLDGVTASCLDKGAXXFYRNLIWLVKXXXXXXXXVRGDYNNTTGRXXXXXWGIHHPDTEEVAINLYASKNPYTLVSTXXXXXXXXXXXXXXXGDGQRSWMKIYWHLMSPGERIMFESNGGLLAXXXXXXXXXXGTGRIFQSGIRMARCNTKCQTSLGGVNTNKTFQNIEKNALGDCPKXXXXXXXXXXXXXXXXXXXXVERGLFGAIAXXXXXXXXXXXXXXXXXXXXXXXXXXXXADKVSTQKALNEITTKINNXXXXXXXXXXXXXXXXXXXXXXXXXXXXXXXXXXXXXXXXXXXXXVLLENGRTLGLHDANVRNLHDQIKRXLQNNAIDEGDGCFNFFHKCNDSCMEXXXXXXXXXXXXXXXXXXXXXXXXXXXLKTEDNVYKILSIYSCIASSIVLVGLILAFIMWACSNGNCRFNVCI

SEQ ID NO: 419337 - protein, 569 aa, Influenza virus
  MOD_RES (1)..(15): Any amino acid
  MOD_RES (26)..(27): Any amino acid
  MOD_RES (47)..(102): Any amino acid
  MOD_RES (122)..(131): Any amino acid
  MOD_RES (156)..(161): Any amino acid
  MOD_RES (172)..(196): Any amino acid
  MOD_RES (219)..(243): Any amino acid
  MOD_RES (269)..(280): Any amino acid
  MOD_RES (302)..(343): Any amino acid
  MOD_RES (354)..(382): Any amino acid
  MOD_RES (395)..(456): Any amino acid
  MOD_RES (471)..(525): Any amino acid
  MOD_RES (545)..(569): Any amino acid
XXXXXXXXXXXXXXXSRYSKADKICXXYLSNNSTDKIDTLTETGVPXXXXXXXXXXXXXXXXXXXXXXXXXXXXXXXXXXXXXXXXXXXXXXXXXXXXXXXXDPNAPHKLCYPGEVDNNGEXXXXXXXXXXFSRTELISPNKWGDILDGVTASCRXXXXXXFYRNLIWLVQXXXXXXXXXXXXXXXXXXXXXXXXXGIHHPDTEAVATRLYVNKNPYTXXXXXXXXXXXXXXXXXXXXXXXXXWMKLYWHLMSPGERTTFESNGGLIAXXXXXXXXXXXXGRIFQSGVRVARCNTKCQTSVXXXXXXXXXXXXXXXXXXXXXXXXXXXXXXXXXXXXXXXXXXSERGLFGAIAXXXXXXXXXXXXXXXXXXXXXXXXXXXXXDKASTQKAINEIXXXXXXXXXXXXXXXXXXXXXXXXXXXXXXXXXXXXXXXXXXXXXXXXXXXXXXXXXXXXXXHDANVKNLHDQIKRXXXXXXXXXXXXXXXXXXXXXXXXXXXXXXXXXXXXXXXXXXXXXXXXXXXXXXXTEDNVYKVLAIYSCIASSIXXXXXXXXXXXXXXXXXXXXXXXXX

SEQ ID NO: 419338 - protein, 569 aa, Influenza virus
  MOD_RES (1)..(33): Any amino acid
  MOD_RES (46)..(149): Any amino acid
  MOD_RES (160)..(248): Any amino acid
  MOD_RES (259)..(294): Any amino acid
  MOD_RES (305)..(343): Any amino acid
  MOD_RES (354)..(536): Any amino acid
  MOD_RES (554)..(569): Any amino acid
XXXXXXXXXXXXXXXXXXXXXXXXXXXXXXXXXTDKVDTLTETGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTASCLDRGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWHLMRPGERTXXXXXXXXXXXXXXXXXXXXXXXXXXXXXXXXXXXXTKCQTSMGGVXXXXXXXXXXXXXXXXXXXXXXXXXXXXXXXXXXXXXXXDERGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYSCIASSTVMVGLILAFXXXXXXXXXXXXXXXX

SEQ ID NO: 419339 - protein, 627 aa, Influenza virus
  MOD_RES (18)..(26): Any amino acid
  MOD_RES (47)..(304): Any amino acid
  MOD_RES (324)..(342): Any amino acid
  MOD_RES (355)..(385): Any amino acid
  MOD_RES (415)..(479): Any amino acid
  MOD_RES (491)..(601): Any amino acid
  MOD_RES (622)..(627): Any amino acid
KQGKTKATKMKAILVVLXXXXXXXXXTAYSQITNGTTGNPIICLGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSNAPSGIEYNGKSLGIQSDXXXXXXXXXXXXXXXXXXXTSLTSLPFQNIHXXXXXXXXXXXXXXXXXXXXXXXXXXXXXXXRGLFGAIAGFIEGGWTGMVDGWYGYHHQNXXXXXXXXXXXXXXXXXXXXXXXXXXXXXXXXXXXXXXXXXXXXXXXXXXXXXXXXXXXXXXXXXYNAELLVLLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGSLQCRICIQCRICIRADGXXXXXX

SEQ ID NO: 419340 - protein, 627 aa, Influenza virus
  MOD_RES (1)..(1): Any amino acid
  MOD_RES (18)..(304): Any amino acid
  MOD_RES (321)..(388): Any amino acid
  MOD_RES (415)..(479): Any amino acid
  MOD_RES (491)..(601): Any amino acid
XQGKTKATKMEAILVVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSNAPSGVEYNGKSLGIXXXXXXXXXXXXXXXXXXXXXXXXXXXXXXXXXXXXXXXXXXXXXXXXXXXXXXXXXXXXXXXXXXXXFGAIAGFIENGWEGMVDGWYGFRHQNXXXXXXXXXXXXXXXXXXXXXXXXXXXXXXXXXXXXXXXXXXXXXXXXXXXXXXXXXXXXXXXXXYQAELLVAMENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMVLLQCRICIQCRICILDQNFRNIRK

SEQ ID NO: 419341 - protein, 627 aa, Influenza virus
  MOD_RES (1)..(4): Any amino acid
  MOD_RES (18)..(391): Any amino acid
  MOD_RES (415)..(479): Any amino acid
  MOD_RES (491)..(601): Any amino acid
XXXXTKATKMKAIIVVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAGFIEGGWPGLINGWYGFQHRNXXXXXXXXXXXXXXXXXXXXXXXXXXXXXXXXXXXXXXXXXXXXXXXXXXXXXXXXXXXXXXXXXYNAELLILLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHSCLQCRICIQCRICIDFRDMRKNTL

SEQ ID NO: 419342 - protein, 627 aa, Influenza virus
  MOD_RES (1)..(6): Any amino acid
  MOD_RES (18)..(394): Any amino acid
  MOD_RES (413)..(479): Any amino acid
  MOD_RES (491)..(601): Any amino acid
  MOD_RES (625)..(627): Any amino acid
XXXXXXQPNDGQVLYFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFIEGGWTGMIDGWYGYHHXXXXXXXXXXXXXXXXXXXXXXXXXXXXXXXXXXXXXXXXXXXXXXXXXXXXXXXXXXXXXXXXXXXYNAQLLVLLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHGSLQCRICIRCTISLVKTTLFLXXX

SEQ ID NO: 419343 - protein, 627 aa, Influenza virus
  MOD_RES (1)..(394): Any amino acid
  MOD_RES (415)..(479): Any amino acid
  MOD_RES (491)..(603): Any amino acid
  MOD_RES (619)..(627): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFIEGGWPGLVAGWYGFQHQNXXXXXXXXXXXXXXXXXXXXXXXXXXXXXXXXXXXXXXXXXXXXXXXXXXXXXXXXXXXXXXXXXYNAKLLVLLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLCSVEYASKTRISEIXXXXXXXXX

SEQ ID NO: 419344 - protein, 627 aa, Influenza virus
  MOD_RES (1)..(404): Any amino acid
  MOD_RES (415)..(610): Any amino acid
  MOD_RES (621)..(627): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGWYGFQHQNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQCRICIRADXXXXXXX

SEQ ID NO: 419345 - protein, 627 aa, Influenza virus
  MOD_RES (1)..(610): Any amino acid
  MOD_RES (621)..(627): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMRCTISLVKTXXXXXXX

SEQ ID NO: 419346 - protein, 627 aa, Influenza virus
  MOD_RES (1)..(610): Any amino acid
  MOD_RES (621)..(627): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQCRICIDFRXXXXXXX

SEQ ID NO: 419347 - protein, 627 aa, Influenza virus
  MOD_RES (1)..(610): Any amino acid
  MOD_RES (621)..(627): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQCRICILDQXXXXXXX

SEQ ID NO: 419348 - protein, 599 aa, Influenza virus
  MOD_RES (19)..(26): Any amino acid
  MOD_RES (62)..(83): Any amino acid
  MOD_RES (95)..(123): Any amino acid
  MOD_RES (147)..(180): Any amino acid
  MOD_RES (192)..(266): Any amino acid
  MOD_RES (281)..(316): Any amino acid
  MOD_RES (329)..(329): Any amino acid
  MOD_RES (402)..(408): Any amino acid
  MOD_RES (431)..(434): Any amino acid
  MOD_RES (473)..(486): Any amino acid
  MOD_RES (506)..(506): Any amino acid
  MOD_RES (528)..(541): Any amino acid
  MOD_RES (582)..(582): Any amino acid
  MOD_RES (594)..(599): Any amino acid
KQGKTKATKMKAILVVLLXXXXXXXXADTLCIGYHANNSTDTVDTVLEKNVTVTHSVNLLEXXXXXXXXXXXXXXXXXXXXXXIAGWILGNPECXXXXXXXXXXXXXXXXXXXXXXXXXXXXXDYEELREQLSSVSSFERFEIFPKXXXXXXXXXXXXXXXXXXXXXXXXXXXXXXXXXXKEKENSYPMINXXXXXXXXXXXXXXXXXXXXXXXXXXXXXXXXXXXXXXXXXXXXXXXXXXXXXXXXXXXXXXXXXXXXXXXXXXXDKITFEATGNLVVPXXXXXXXXXXXXXXXXXXXXXXXXXXXXXXXXXXXXTSLTSLPFQNIHXITIGKCPKYVKSTKLRLATGLRNVPSIQSRGLFGAIAGFIEGGWTGMVDGWYGYHHQNEQGSGYAADLKSTQXXXXXXXNKVNSVIEKMNTQFTAVGKEFNXXXXRIENLNKKVDDGFLDIWTYNAELLVLLENERTLDYHDSXXXXXXXXXXXXXXNNAKEIGNGCFEFYHKCDNXCMESVKNGTYDYPKYSEEAKLXXXXXXXXXXXXXXIYQILAIYSTVASSLVLVVSLGAISFWMCSNGSLQCRICIXLQCRICIRADGXXXXXX

SEQ ID NO: 419349 - protein, 599 aa, Influenza virus
  MOD_RES (1)..(1): Any amino acid
  MOD_RES (19)..(26): Any amino acid
  MOD_RES (62)..(83): Any amino acid
  MOD_RES (94)..(123): Any amino acid
  MOD_RES (147)..(180): Any amino acid
  MOD_RES (192)..(266): Any amino acid
  MOD_RES (281)..(329): Any amino acid
  MOD_RES (363)..(367): Any amino acid
  MOD_RES (402)..(408): Any amino acid
  MOD_RES (430)..(434): Any amino acid
  MOD_RES (473)..(486): Any amino acid
  MOD_RES (506)..(506): Any amino acid
  MOD_RES (528)..(541): Any amino acid
  MOD_RES (591)..(599): Any amino acid
XQGKTKATKMEAILVVLLXXXXXXXXADTICIGYHANNSTDTVDTILEKNVTVTHSVDLLEXXXXXXXXXXXXXXXXXXXXXXVAGWILGNPEXXXXXXXXXXXXXXXXXXXXXXXXXXXXXXNYEELREQLSTVSSFERFEIFPNXXXXXXXXXXXXXXXXXXXXXXXXXXXXXXXXXXKEKENSYPKINXXXXXXXXXXXXXXXXXXXXXXXXXXXXXXXXXXXXXXXXXXXXXXXXXXXXXXXXXXXXXXXXXXXXXXXXXXXDTIIFEANGNLIAPXXXXXXXXXXXXXXXXXXXXXXXXXXXXXXXXXXXXXXXXXXXXXXXXXVTIGECPKYVRSAKLRMVTGLRNIPSIQSRGLFXXXXXFIEGGWTGMIDGWYGYHHQNGQGSGYAADQKSTQXXXXXXXNKVNSIIEKMNTQFTVVGKEFXXXXXRMENLNKKVDDGLLDVWTYNAELLVLLENERTLDFHDSXXXXXXXXXXXXXXNNAKELGNGCFEFYHKCNDXCMESVRNGTYDYPKYSKESKLXXXXXXXXXXXXXXVYQILAIYSTAASSLVLLVSLGAISFWMCSGHSCRICIEYASKTRISEIXXXXXXXXX

SEQ ID NO: 419350 - protein, 599 aa, Influenza virus
  MOD_RES (1)..(4): Any amino acid
  MOD_RES (19)..(26): Any amino acid
  MOD_RES (62)..(83): Any amino acid
  MOD_RES (95)..(123): Any amino acid
  MOD_RES (147)..(266): Any amino acid
  MOD_RES (281)..(329): Any amino acid
  MOD_RES (357)..(381): Any amino acid
  MOD_RES (398)..(408): Any amino acid
  MOD_RES (431)..(434): Any amino acid
  MOD_RES (473)..(486): Any amino acid
  MOD_RES (506)..(506): Any amino acid
  MOD_RES (528)..(541): Any amino acid
  MOD_RES (582)..(582): Any amino acid
XXXXTKATKMKAIIVVLLXXXXXXXXADTICVGYHANNSTDTVDTLLEKNVTVTHSVNILEXXXXXXXXXXXXXXXXXXXXXXIAGWLLGNPECXXXXXXXXXXXXXXXXXXXXXXXXXXXXXDYEELKEQLSTVSSFEKFEIFPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTITFEATGNLIAPXXXXXXXXXXXXXXXXXXXXXXXXXXXXXXXXXXXXXXXXXXXXXXXXXITIGECPKYVKSTKLRMATGLRNIPSIXXXXXXXXXXXXXXXXXXXXXXXXXGYHHQNAQGSGYAADLXXXXXXXXXXXNKVNSVVEKMNTQFTAVGKEFSXXXXRIENLNKKIDDGFLDVWTYNAELLILLENERTLDFHDLXXXXXXXXXXXXXXNNAKEVGNGCFEFYHKCDDXCMESIKNGTYDYPKYSEESKLXXXXXXXXXXXXXXIHQILAIYSTVASSSVLLVSLGAVSFWMCSNGSLRCRICIXLQCRICILDQNFRNIRK

SEQ ID NO: 419351 - protein, 599 aa, Influenza virus
  MOD_RES (1)..(8): Any amino acid
  MOD_RES (19)..(38): Any amino acid
  MOD_RES (56)..(83): Any amino acid
  MOD_RES (94)..(123): Any amino acid
  MOD_RES (147)..(266): Any amino acid
  MOD_RES (278)..(329): Any amino acid
  MOD_RES (366)..(387): Any amino acid
  MOD_RES (398)..(408): Any amino acid
  MOD_RES (431)..(434): Any amino acid
  MOD_RES (450)..(462): Any amino acid
  MOD_RES (473)..(495): Any amino acid
  MOD_RES (506)..(507): Any amino acid
  MOD_RES (528)..(541): Any amino acid
  MOD_RES (569)..(569): Any amino acid
  MOD_RES (582)..(582): Any amino acid
XXXXXXXXEREAKLFVLFXXXXXXXXXXXXXXXXXXXXSTDTVDTVREKNVTVTHXXXXXXXXXXXXXXXXXXXXXXXXXXXXVAGWLLGNPEXXXXXXXXXXXXXXXXXXXXXXXXXXXXXXNYEELREHLSSVSSFERFEMFPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTIIFEASGNLXXXXXXXXXXXXXXXXXXXXXXXXXXXXXXXXXXXXXXXXXXXXXXXXXXXXITIGKCSKYVKSTQLRMATGLRNVPSVQSRGLFGAIXXXXXXXXXXXXXXXXXXXXXXEQGSGYAADQXXXXXXXXXXXNKVNTVIEKMNIQFTSVGKEFNXXXXRIENLNRKVDDGFLDXXXXXXXXXXXXXNERTLDFHDFXXXXXXXXXXXXXXXXXXXXXXXCFEFYHKCNNXXMESVKNGTYNYPKYSEESRLXXXXXXXXXXXXXXVHQILAIYSTVASSLILIVSLGAISFWXCSNGSLQCRVCIXLQCRICIDFRDMRKNTL

SEQ ID NO: 419352 - protein, 599 aa, Influenza virus
  MOD_RES (1)..(12): Any amino acid
  MOD_RES (23)..(39): Any amino acid
  MOD_RES (59)..(83): Any amino acid
  MOD_RES (95)..(128): Any amino acid
  MOD_RES (145)..(266): Any amino acid
  MOD_RES (281)..(329): Any amino acid
  MOD_RES (363)..(387): Any amino acid
  MOD_RES (402)..(411): Any amino acid
  MOD_RES (430)..(434): Any amino acid
  MOD_RES (458)..(462): Any amino acid
  MOD_RES (473)..(517): Any amino acid
  MOD_RES (528)..(552): Any amino acid
  MOD_RES (589)..(599): Any amino acid
XXXXXXXXXXXXIIIVVLLYTFXXXXXXXXXXXXXXXXXTDTVDTVLERNVTVTHSVNXXXXXXXXXXXXXXXXXXXXXXXXXVAGWILGNPKCXXXXXXXXXXXXXXXXXXXXXXXXXXXXXXXXXXKEQLSSVSSFKRFEIFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTIIFEATGNLLVPXXXXXXXXXXXXXXXXXXXXXXXXXXXXXXXXXXXXXXXXXXXXXXXXXFTIGECPKYVRSTRLRMATGLRNIPSVQSRGLFXXXXXXXXXXXXXXXXXXXXXXXXXEQGSGYAADRKSTQXXXXXXXXXXNSVIEKMNIQFTAVGKEFXXXXXRIESLNNKVDDGFIDIWTYNAELXXXXXNERTLDYHDFXXXXXXXXXXXXXXXXXXXXXXXXXXXXXXXXXXXXXXXXXXXXXYPKYSKEAKLXXXXXXXXXXXXXXXXXXXXXXXXXASSLVLIVSLGAIGFWMCSNGSLLCSVEYASKTRISXXXXXXXXXXX

SEQ ID NO: 419353 - protein, 599 aa, Influenza virus
  MOD_RES (1)..(130): Any amino acid
  MOD_RES (144)..(270): Any amino acid
  MOD_RES (281)..(343): Any amino acid
  MOD_RES (356)..(415): Any amino acid
  MOD_RES (430)..(438): Any amino acid
  MOD_RES (458)..(552): Any amino acid
  MOD_RES (569)..(569): Any amino acid
  MOD_RES (581)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQLSSVSSFEKFEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFEATGNLVAPXXXXXXXXXXXXXXXXXXXXXXXXXXXXXXXXXXXXXXXXXXXXXXXXXXXXXXXXXXXXXXXLRLATGLRNIPSXXXXXXXXXXXXXXXXXXXXXXXXXXXXXXXXXXXXXXXXXXXXXXXXXXXXXXXXXXXXEKMNTQFTSVGKEFXXXXXXXXXLNKKVDDGFIDVWTYNAELXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASTLVLLVSLGAIGFWXCSWSLQCRICIXXXXXXXXXXXXXXXXXXX

SEQ ID NO: 419354 - protein, 599 aa, Influenza virus
  MOD_RES (1)..(346): Any amino acid
  MOD_RES (357)..(416): Any amino acid
  MOD_RES (427)..(573): Any amino acid
  MOD_RES (584)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTGLRNVPSIXXXXXXXXXXXXXXXXXXXXXXXXXXXXXXXXXXXXXXXXXXXXXXXXXXXXXXXXXXXXKMNIQFTSVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGSLQCRICIXXXXXXXXXXXXXXXX

SEQ ID NO: 419355 - protein, 599 aa, Influenza virus
  MOD_RES (1)..(573): Any amino acid
  MOD_RES (584)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMVLLQCRICIXXXXXXXXXXXXXXXX

SEQ ID NO: 419356 - protein, 599 aa, Influenza virus
  MOD_RES (1)..(573): Any amino acid
  MOD_RES (584)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHSCLQCRICIXXXXXXXXXXXXXXXX

SEQ ID NO: 419357 - protein, 599 aa, Influenza virus
  MOD_RES (1)..(573): Any amino acid
  MOD_RES (584)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHGSLQCRICIXXXXXXXXXXXXXXXX

SEQ ID NO: 419358 - protein, 484 aa, Influenza virus
  MOD_RES (21)..(106): Any amino acid
  MOD_RES (231)..(232): Any amino acid
  MOD_RES (269)..(282): Any amino acid
  MOD_RES (298)..(299): Any amino acid
  MOD_RES (323)..(325): Any amino acid
  MOD_RES (341)..(354): Any amino acid
  MOD_RES (379)..(382): Any amino acid
  MOD_RES (395)..(409): Any amino acid
  MOD_RES (445)..(447): Any amino acid
  MOD_RES (465)..(468): Any amino acid
  MOD_RES (482)..(484): Any amino acid
IGLREQKQEFKMNPNQKIIIXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWXXNILRTQESECACVNGSCFTVMTDGPSVMGQASYKIFXXXXXXXXXXXXXXAPNYHYEECSCYPDSXXITCVCRDNWHGSNRPWVSFNQNLXXXIGYICSGIFGDNPRPXXXXXXXXXXXXXXGANGVKGFSFKYGNGVWIGRTKSIXXXXGFEMIWDPNGWTXXXXXXXXXXXXXXXNEWSGYSGSFVQHPELTGLDCIRPCFWVELIRGRPXXXTTIWTSGSSISFCGVNSXXXXWSWPDGAELPFTIXXX

SEQ ID NO: 419359 - protein, 484 aa, Influenza virus
  MOD_RES (1)..(10): Any amino acid
  MOD_RES (21)..(106): Any amino acid
  MOD_RES (231)..(232): Any amino acid
  MOD_RES (259)..(282): Any amino acid
  MOD_RES (298)..(299): Any amino acid
  MOD_RES (323)..(325): Any amino acid
  MOD_RES (341)..(354): Any amino acid
  MOD_RES (379)..(382): Any amino acid
  MOD_RES (395)..(409): Any amino acid
  MOD_RES (445)..(447): Any amino acid
  MOD_RES (465)..(468): Any amino acid
  MOD_RES (482)..(484): Any amino acid
XXXXXXXXXXKMNPNQKIITXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIYTKDNSIRIGSKGDIFVIREPFISCSHLECKTFFLTQGALLNDRHSNGTVKDRSPYRALMSCPLGEAPSPYNSKFESVAWSASACHDGMGWLTIGISGPDDGAVAVLKYNDIITDTIKSWXXQILRTQESECVCMNGSCFTIMTDGPSXXXXXXXXXXXXXXXXXXXXXXXXAPNFHYEECSCYPESXXVMCVCRDNWHGSNRPWVSFDQNLXXXIGYICSGVFGDNPRPXXXXXXXXXXXXXXGANGVKGFSYKYGNGVWMGRTKSNXXXXGFEMIWDPDGWTXXXXXXXXXXXXXXXTDWSGYSGSFVQHPELTGMNCIRPCFWVELVRGLPXXXATIWTSGSSISFCGVDSXXXXWSWPDGADLPFTIXXX

SEQ ID NO: 419360 - protein, 484 aa, Influenza virus
  MOD_RES (1)..(106): Any amino acid
  MOD_RES (148)..(150): Any amino acid
  MOD_RES (187)..(189): Any amino acid
  MOD_RES (231)..(232): Any amino acid
  MOD_RES (259)..(282): Any amino acid
  MOD_RES (298)..(299): Any amino acid
  MOD_RES (320)..(325): Any amino acid
  MOD_RES (336)..(354): Any amino acid
  MOD_RES (379)..(382): Any amino acid
  MOD_RES (395)..(409): Any amino acid
  MOD_RES (445)..(448): Any amino acid
  MOD_RES (465)..(468): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIYSKDNGIRIGSKGDVFVMREPFISCSHFECRTFFLTQXXXLNDKHSNGTVKNRSPYRALMSCPIGEAPSPYNSRFEXXXWSASACHDGTSWLTIGISGPDNEAVAVLKYKGIITGTIKSWXXRILRTQESECVCVNGSCFTVLTDGPSXXXXXXXXXXXXXXXXXXXXXXXXAPNFYYEECSCYPDTXXVVCVCRDNWHASNRPWVSFDXXXXXXMGYICSGIFGXXXXXXXXXXXXXXXXXXXGADGVKGFSYKYDNGVWIGRTKSNXXXXGFEMVWDPNGWTXXXXXXXXXXXXXXXNDWSGYSGSFVQHPELTGLNCIKPCFWVELIRGQPXXXXTIWASGSSISFCGVNGXXXXWSWPDGAKLPFTIXXX

SEQ ID NO: 419361 - protein, 484 aa, Influenza virus
  MOD_RES (1)..(106): Any amino acid
  MOD_RES (127)..(127): Any amino acid
  MOD_RES (141)..(150): Any amino acid
  MOD_RES (184)..(189): Any amino acid
  MOD_RES (231)..(232): Any amino acid
  MOD_RES (259)..(282): Any amino acid
  MOD_RES (298)..(299): Any amino acid
  MOD_RES (323)..(325): Any amino acid
  MOD_RES (341)..(354): Any amino acid
  MOD_RES (379)..(409): Any amino acid
  MOD_RES (432)..(448): Any amino acid
  MOD_RES (464)..(470): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWAIHTKDNSVRIGSKGDVFXIREPFISCSQLECXXXXXXXXXXLNDKHSNGTAKDRSPHRTLMSCPVGEAPSPYNSXXXXXXWSASACHDGLGWITIGISGPDDGAVAVLKYKGIITETIKSWXXKILRTQESECVCINGSCFTIMTDGPNXXXXXXXXXXXXXXXXXXXXXXXXAPNSHYEECSCYPDAXXIICVCRDNWHGSNRPWISFDQNLXXXVGYICSGVFGDNPRSXXXXXXXXXXXXXXGAYGVKGFSFRYGNGVWIGRTKSTXXXXXXXXXXXXXXXXXXXXXXXXXXXXXXXTNWSGYSGSFVQHPELTGMDCIXXXXXXXXXXXXXXXXXTIWTSASSISFCGVNXXXXXXXWPDGAELPFAIXXX

SEQ ID NO: 419362 - protein, 484 aa, Influenza virus
  MOD_RES (1)..(111): Any amino acid
  MOD_RES (135)..(151): Any amino acid
  MOD_RES (177)..(189): Any amino acid
  MOD_RES (200)..(201): Any amino acid
  MOD_RES (231)..(235): Any amino acid
  MOD_RES (250)..(282): Any amino acid
  MOD_RES (296)..(300): Any amino acid
  MOD_RES (320)..(325): Any amino acid
  MOD_RES (336)..(354): Any amino acid
  MOD_RES (365)..(368): Any amino acid
  MOD_RES (379)..(421): Any amino acid
  MOD_RES (441)..(448): Any amino acid
  MOD_RES (465)..(470): Any amino acid
  MOD_RES (482)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKDNSVRIGSKGDIFVMREPFISXXXXXXXXXXXXXXXXXNDRHSNGTIKDRSPFRALMSCPVGEXXXXXXXXXXXXXWSASACHDGVXXITIGISGPDNGAVAVLKYKGVITDTIKSWXXXXXRTQESECACINGSCXXXXXXXXXXXXXXXXXXXXXXXXXXXXXXXXXAPNYYYEECSCYPXXXXXMCVCRDNWHASNRPWISFDXXXXXXMGYICSGVFGXXXXXXXXXXXXXXXXXXXGTNGVKGFSFXXXXGIWIGRTKSTXXXXXXXXXXXXXXXXXXXXXXXXXXXXXXXXXXXXXXXXXXXHPELTGLDCMRPCFWVELIXXXXXXXXTIWTSGSIISFCGVNSXXXXXXWPDGAELPFIIXXX

SEQ ID NO: 419363 - protein, 484 aa, Influenza virus
  MOD_RES (1)..(112): Any amino acid
  MOD_RES (126)..(154): Any amino acid
  MOD_RES (165)..(215): Any amino acid
  MOD_RES (227)..(309): Any amino acid
  MOD_RES (323)..(330): Any amino acid
  MOD_RES (341)..(357): Any amino acid
  MOD_RES (372)..(428): Any amino acid
  MOD_RES (441)..(454): Any amino acid
  MOD_RES (465)..(474): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKDNGVRIGSKGDVXXXXXXXXXXXXXXXXXXXXXXXXXXXXXHSNGTVKBRSXXXXXXXXXXXXXXXXXXXXXXXXXXXXXXXXXXXXXXXXXXXXXXXXXXXVLKYNGIITGTXXXXXXXXXXXXXXXXXXXXXXXXXXXXXXXXXXXXXXXXXXXXXXXXXXXXXXXXXXXXXXXXXXXXXXXXXXXXXXXXXXXASNRPWVSFNQDLXXXXXXXXSGVLGDNPRPXXXXXXXXXXXXXXXXXGVKGFSYRYGNGVWXXXXXXXXXXXXXXXXXXXXXXXXXXXXXXXXXXXXXXXXXXXXXXXXXXXXXXXXXNCMRPCFWVELVXXXXXXXXXXXXXXSSISFCGVSSXXXXXXXXXXADLPFTQEQK

SEQ ID NO: 419364 - protein, 484 aa, Influenza virus
  MOD_RES (1)..(215): Any amino acid
  MOD_RES (227)..(310): Any amino acid
  MOD_RES (321)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLKYNGIITETXXXXXXXXXXXXXXXXXXXXXXXXXXXXXXXXXXXXXXXXXXXXXXXXXXXXXXXXXXXXXXXXXXXXXXXXXXXXXXXXXXXXANRPWVSFNQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419365 - protein, 484 aa, Influenza virus
  MOD_RES (1)..(311): Any amino acid
  MOD_RES (323)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNRPWVSFNHNLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419366 - protein, 566 aa, Influenza virus
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (369)..(371): Any amino acid
  MOD_RES (382)..(421): Any amino acid
  MOD_RES (432)..(433): Any amino acid
  MOD_RES (460)..(471): Any amino acid
  MOD_RES (491)..(491): Any amino acid
  MOD_RES (502)..(550): Any amino acid
  MOD_RES (565)..(566): Any amino acid
XXXXXXXXXXXXXXXXXDTICIGYHANNSTDTVDTXXXKNVTVTHSVNLLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNVHPVTIGECPKYVKSXXXXXXXXXXXXXSIQSRGLFGAIAGFIEGGWTGMIDGWYGYXXXNEQGSGYAADXXXXXXXXXXXXXXXXXXXXXXXXXXXXXXXXXXXXXXXXENLNKKVDDGXXDIWTYNAELLVLLENERTLDFHDSNVXXXXXXXXXXXXNNAKEIGNGCFEFYHKCNNXCMESVKNGTYXXXXXXXXXXXXXXXXXXXXXXXXXXXXXXXXXXXXXXXXXXXXXXXXXSFWMCSNGSLQCRIXX

SEQ ID NO: 419367 - protein, 566 aa, Influenza virus
  MOD_RES (1)..(17): Any amino acid
  MOD_RES (36)..(38): Any amino acid
  MOD_RES (51)..(307): Any amino acid
  MOD_RES (327)..(339): Any amino acid
  MOD_RES (369)..(371): Any amino acid
  MOD_RES (382)..(421): Any amino acid
  MOD_RES (432)..(433): Any amino acid
  MOD_RES (460)..(471): Any amino acid
  MOD_RES (491)..(491): Any amino acid
  MOD_RES (502)..(550): Any amino acid
  MOD_RES (565)..(566): Any amino acid
XXXXXXXXXXXXXXXXXDTLCIGYHANNSTETVDTXXXKNITVTHSVNLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNIHPVTIGKCPKYVKSXXXXXXXXXXXXXSIQTRGLFGAIAGFIEGGWTGMVDGWYGYXXXNEQGSGFAADXXXXXXXXXXXXXXXXXXXXXXXXXXXXXXXXXXXXXXXXESLNNKVDDGXXDVWTYNAELLVLLENERTLDYHDSNVXXXXXXXXXXXXNNAKELGNGCFEFYHRCDDXCMDSVKNGTYXXXXXXXXXXXXXXXXXXXXXXXXXXXXXXXXXXXXXXXXXXXXXXXXXCFWMCSNGSLHGRIXX

SEQ ID NO: 419368 - protein, 566 aa, Influenza virus
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (351)..(353): Any amino acid
  MOD_RES (369)..(371): Any amino acid
  MOD_RES (382)..(421): Any amino acid
  MOD_RES (432)..(433): Any amino acid
  MOD_RES (460)..(471): Any amino acid
  MOD_RES (491)..(491): Any amino acid
  MOD_RES (502)..(550): Any amino acid
  MOD_RES (565)..(566): Any amino acid
XXXXXXXXXXXXXXXXXDTICVGYHANNSTDTIDTXXXKNVTVTHSINLLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNVHPITIGECPKYVRSXXXXXXXXXXXXXSVQSRGLFGAIXXXIEGGWTGMVNGWYGYXXXNDQGSGYAADXXXXXXXXXXXXXXXXXXXXXXXXXXXXXXXXXXXXXXXXENLNKKIDDGXXDLWTYNAELLILLENERTLDLHDSNVXXXXXXXXXXXXNNAQEIGNGCFEFYHKCDDXCMESVRNGTYXXXXXXXXXXXXXXXXXXXXXXXXXXXXXXXXXXXXXXXXXXXXXXXXXGFWMCSNGSLQCKIXX

SEQ ID NO: 419369 - protein, 566 aa, Influenza virus
  MOD_RES (1)..(17): Any amino acid
  MOD_RES (28)..(38): Any amino acid
  MOD_RES (51)..(307): Any amino acid
  MOD_RES (319)..(339): Any amino acid
  MOD_RES (352)..(353): Any amino acid
  MOD_RES (364)..(371): Any amino acid
  MOD_RES (382)..(421): Any amino acid
  MOD_RES (432)..(433): Any amino acid
  MOD_RES (444)..(447): Any amino acid
  MOD_RES (460)..(471): Any amino acid
  MOD_RES (491)..(491): Any amino acid
  MOD_RES (502)..(550): Any amino acid
  MOD_RES (564)..(566): Any amino acid
XXXXXXXXXXXXXXXXXDPICIGYHANXXXXXXXXXXXKNVTVTHAVNLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNIHPITIGXXXXXXXXXXXXXXXXXXXXXSIHSRGLFGAIAXXFEGGWTGMIDXXXXXXXXNEQGSGYAANXXXXXXXXXXXXXXXXXXXXXXXXXXXXXXXXXXXXXXXXENLNRKVDDGXXDIWTYNAEMLXXXXNERTLDFHDFNVXXXXXXXXXXXXNNAREIGNGCFEFYHKCNDXCMESIKNGTYXXXXXXXXXXXXXXXXXXXXXXXXXXXXXXXXXXXXXXXXXXXXXXXXXSFWMCPNGSLQCKXXX

SEQ ID NO: 419370 - protein, 566 aa, Influenza virus
  MOD_RES (1)..(18): Any amino acid
  MOD_RES (29)..(38): Any amino acid
  MOD_RES (49)..(307): Any amino acid
  MOD_RES (325)..(339): Any amino acid
  MOD_RES (353)..(371): Any amino acid
  MOD_RES (382)..(421): Any amino acid
  MOD_RES (432)..(434): Any amino acid
  MOD_RES (445)..(448): Any amino acid
  MOD_RES (459)..(471): Any amino acid
  MOD_RES (491)..(553): Any amino acid
  MOD_RES (564)..(566): Any amino acid
XXXXXXXXXXXXXXXXXXTLCICYHANNXXXXXXXXXXKKLTVTHSVNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNIHPATIGECPKYVXXXXXXXXXXXXXXXSIQSKGLFGAIAGXXXXXXXXXXXXXXXXXXXNEQGYGYAADXXXXXXXXXXXXXXXXXXXXXXXXXXXXXXXXXXXXXXXXENLNKRVDDGXXXVWTYNAELLIXXXXERTLDFHESNXXXXXXXXXXXXXNKVKEIGNGCFEFYHKCDNXXXXXXXXXXXXXXXXXXXXXXXXXXXXXXXXXXXXXXXXXXXXXXXXXXXXXXXXXXXXXXXMCSHGSLQCRXXX

SEQ ID NO: 419371 - protein, 566 aa, Influenza virus
  MOD_RES (1)..(40): Any amino acid
  MOD_RES (51)..(434): Any amino acid
  MOD_RES (445)..(449): Any amino acid
  MOD_RES (460)..(472): Any amino acid
  MOD_RES (483)..(554): Any amino acid
  MOD_RES (565)..(566): Any amino acid
XXXXXXXXXXXXXXXXXXXXXXXXXXXXXXXXXXXXXXXXVTVTHSVNLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIWTYNAELLIXXXXXRTLDFHDLNVXXXXXXXXXXXXXNAKETGNGCFXXXXXXXXXXXXXXXXXXXXXXXXXXXXXXXXXXXXXXXXXXXXXXXXXXXXXXXXXXXXXXXXXXXXXXXXCSNGSLQCRVXX

SEQ ID NO: 419372 - protein, 566 aa, Influenza virus
  MOD_RES (1)..(41): Any amino acid
  MOD_RES (52)..(473): Any amino acid
  MOD_RES (484)..(554): Any amino acid
  MOD_RES (565)..(566): Any amino acid
XXXXXXXXXXXXXXXXXXXXXXXXXXXXXXXXXXXXXXXXXKVTHRENLLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAKEIGNGCFKXXXXXXXXXXXXXXXXXXXXXXXXXXXXXXXXXXXXXXXXXXXXXXXXXXXXXXXXXXXXXXXXXXXXXXXCPNGSLQCTIXX

SEQ ID NO: 419373 - protein, 566 aa, Influenza virus
  MOD_RES (1)..(474): Any amino acid
  MOD_RES (485)..(566): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRELGNGCFEFXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419374 - protein, 475 aa, Influenza virus
  MOD_RES (1)..(46): Any amino acid
  MOD_RES (57)..(94): Any amino acid
  MOD_RES (126)..(128): Any amino acid
  MOD_RES (144)..(151): Any amino acid
  MOD_RES (195)..(221): Any amino acid
  MOD_RES (235)..(236): Any amino acid
  MOD_RES (250)..(270): Any amino acid
  MOD_RES (287)..(287): Any amino acid
  MOD_RES (307)..(314): Any amino acid
  MOD_RES (329)..(345): Any amino acid
  MOD_RES (357)..(371): Any amino acid
  MOD_RES (382)..(404): Any amino acid
  MOD_RES (415)..(416): Any amino acid
  MOD_RES (433)..(436): Any amino acid
  MOD_RES (462)..(462): Any amino acid
XXXXXXXXXXXXXXXXXXXXXXXXXXXXXXXXXXXXXXXXXXXXXXKNNQVILCEPXXXXXXXXXXXXXXXXXXXXXXXXXXXXXXXXXXXXXXITGFAPFSKDNSIRLSAGGDIWVTREPYVSCXXXKCYQFALGQGTTLNNXXXXXXXXDRTPYRTLLMNELGVPFHLGTKQVCIAWSSSSCHDGKAWLHVCXXXXXXXXXXXXXXXXXXXXXXXXXXXNILRTQESECVCIXXTCTVVMTDGSASGXXXXXXXXXXXXXXXXXXXXXGSAQHVEECSCYPRYPXVRCVCRDNWKGSNRPIVDIXXXXXXXXSSYVCSGLVGDTPRXXXXXXXXXXXXXXXXXGGHGVKGWAFDXXXXXXXXXXXXXXXRSGYETFKVIXXXXXXXXXXXXXXXXXXXXXXXSGYSGIFSVEXXSCINRCFYVELIRGRKXXXXVWWTSNSIVVFCGTSGTYGTGSWPDXRTSISCLYKLSQF

SEQ ID NO: 419375 - protein, 475 aa, Influenza virus
  MOD_RES (1)..(46): Any amino acid
  MOD_RES (57)..(94): Any amino acid
  MOD_RES (126)..(128): Any amino acid
  MOD_RES (144)..(151): Any amino acid
  MOD_RES (195)..(221): Any amino acid
  MOD_RES (235)..(236): Any amino acid
  MOD_RES (250)..(270): Any amino acid
  MOD_RES (286)..(287): Any amino acid
  MOD_RES (307)..(314): Any amino acid
  MOD_RES (328)..(345): Any amino acid
  MOD_RES (357)..(371): Any amino acid
  MOD_RES (382)..(404): Any amino acid
  MOD_RES (415)..(416): Any amino acid
  MOD_RES (433)..(436): Any amino acid
  MOD_RES (462)..(475): Any amino acid
XXXXXXXXXXXXXXXXXXXXXXXXXXXXXXXXXXXXXXXXXXXXXXKNNQVILCGPXXXXXXXXXXXXXXXXXXXXXXXXXXXXXXXXXXXXXXIKGFAPFSKDNSVRLSAGGDIWITREPYVSCXXXRCYQFALGQGTTLDNXXXXXXXXDRTPHRTLLMNELGIPFHLGTKQVCMAWSSSSCHDGRAWLHVCXXXXXXXXXXXXXXXXXXXXXXXXXXXKILRTQESECICIXXICTVVMTDGSVSGXXXXXXXXXXXXXXXXXXXXXGSAQHIEECSCYPRYXXVRCICRDNWKGSNRPVVDIXXXXXXXXSSYMCSGLVGDTPXXXXXXXXXXXXXXXXXXGNHGVKGWAFDXXXXXXXXXXXXXXXRLGYETFKVIXXXXXXXXXXXXXXXXXXXXXXXSGYSGVFSVEXXNCINRCFYVELIRGRRXXXXVLWTSNSIVVFCGASGTYGTGTWPDXXXXXXXXXXXXXX

SEQ ID NO: 419376 - protein, 475 aa, Influenza virus
  MOD_RES (1)..(46): Any amino acid
  MOD_RES (57)..(94): Any amino acid
  MOD_RES (125)..(132): Any amino acid
  MOD_RES (144)..(151): Any amino acid
  MOD_RES (195)..(221): Any amino acid
  MOD_RES (235)..(236): Any amino acid
  MOD_RES (250)..(270): Any amino acid
  MOD_RES (287)..(287): Any amino acid
  MOD_RES (307)..(314): Any amino acid
  MOD_RES (328)..(345): Any amino acid
  MOD_RES (357)..(371): Any amino acid
  MOD_RES (382)..(404): Any amino acid
  MOD_RES (415)..(416): Any amino acid
  MOD_RES (433)..(436): Any amino acid
  MOD_RES (462)..(475): Any amino acid
XXXXXXXXXXXXXXXXXXXXXXXXXXXXXXXXXXXXXXXXXXXXXXKNNQVILCEQXXXXXXXXXXXXXXXXXXXXXXXXXXXXXXXXXXXXXXVTGFAPFSKDNSIRLSASGDVWVTREPYVSXXXXXXXXFALGQGTTLKNXXXXXXXXDRIPHRTLLMSELGVPFYLGTRQVCIAWSSSSCYDGKAWLHVCXXXXXXXXXXXXXXXXXXXXXXXXXXXRILRTQESECVCVXXTCTVIMTDGSASGXXXXXXXXXXXXXXXXXXXXXGGAQHVEECSCYPRFPXVRCVCRDNWRGSNRPIVDIXXXXXXXXSSYICSGLVGDTPXXXXXXXXXXXXXXXXXXGNPGVKGWAFDXXXXXXXXXXXXXXXRSGYETFRVIXXXXXXXXXXXXXXXXXXXXXXXSGYSGIFSIEXXRCINRCFYVELIRGRNXXXXVGWTSNSIVVFCSTSGTYGSGSWPDXXXXXXXXXXXXXX

SEQ ID NO: 419377 - protein, 475 aa, Influenza virus
  MOD_RES (1)..(94): Any amino acid
  MOD_RES (124)..(132): Any amino acid
  MOD_RES (144)..(151): Any amino acid
  MOD_RES (177)..(179): Any amino acid
  MOD_RES (195)..(221): Any amino acid
  MOD_RES (235)..(236): Any amino acid
  MOD_RES (250)..(270): Any amino acid
  MOD_RES (287)..(287): Any amino acid
  MOD_RES (298)..(345): Any amino acid
  MOD_RES (357)..(371): Any amino acid
  MOD_RES (382)..(404): Any amino acid
  MOD_RES (415)..(416): Any amino acid
  MOD_RES (433)..(436): Any amino acid
  MOD_RES (456)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAGFAPFSKDNSIRLSAGGAIWVTREPYVXXXXXXXXXFALGQGTTLSNXXXXXXXXDRTSYRTLLMNELGVPFYLGTKQVCXXXSSSSCHDGKSWLHVCXXXXXXXXXXXXXXXXXXXXXXXXXXXKILRTHESECVCIXXTCAVVMTDGSASEXXXXXXXXXXXXXXXXXXXXXGNAQHVEECSCYPRSPXVRCICRDNWRXXXXXXXXXXXXXXXXXXXXXXXXXXXXXXXXXXXXXXXXXXXXXXXXGDHGVKGWAFDXXXXXXXXXXXXXXXRLGYETFKVVXXXXXXXXXXXXXXXXXXXXXXXSGYFGVFSVEXXSCVNRCFYVELIRGRPXXXXVWWTSTSIVVFCGTSGIYGXXXXXXXXXXXXXXXXXXXX

SEQ ID NO: 419378 - protein, 475 aa, Influenza virus
  MOD_RES (1)..(94): Any amino acid
  MOD_RES (105)..(106): Any amino acid
  MOD_RES (122)..(151): Any amino acid
  MOD_RES (162)..(163): Any amino acid
  MOD_RES (183)..(183): Any amino acid
  MOD_RES (195)..(236): Any amino acid
  MOD_RES (250)..(276): Any amino acid
  MOD_RES (287)..(294): Any amino acid
  MOD_RES (307)..(345): Any amino acid
  MOD_RES (357)..(371): Any amino acid
  MOD_RES (382)..(422): Any amino acid
  MOD_RES (433)..(436): Any amino acid
  MOD_RES (462)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITGFASFSKDXXIRLSAGGAVWVTREPXXXXXXXXXXXXXXXXXXXXXXXXXXXXXXDRSPYRTLLMXXLGVPFHLGTRQVCMAWSSSXCYDGKAWLHICXXXXXXXXXXXXXXXXXXXXXXXXXXXXXXXXXXXXXXXXXXICAVVMTDGSALGXXXXXXXXXXXXXXXXXXXXXXXXXXXEEGSVYPRFLXXXXXXXXNWKGSNRPIIDIXXXXXXXXXXXXXXXXXXXXXXXXXXXXXXXXXXXXXXXGSHGVKGWAFDXXXXXXXXXXXXXXXRSGYETFRVTXXXXXXXXXXXXXXXXXXXXXXXXXXXXXXXXXXXXXXXXXFYVELIRGREXXXXVWWTSNSVVVFCGTSGTCGTGSWPDXXXXXXXXXXXXXX

SEQ ID NO: 419379 - protein, 475 aa, Influenza virus
  MOD_RES (1)..(95): Any amino acid
  MOD_RES (106)..(108): Any amino acid
  MOD_RES (124)..(238): Any amino acid
  MOD_RES (249)..(294): Any amino acid
  MOD_RES (307)..(437): Any amino acid
  MOD_RES (462)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGFAPFSKDNXXXLSAGGDIWATREPYVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVIMIDGSASXXXXXXXXXXXXXXXXXXXXXXXXXXXXXXXXXXXXXXXXXXXXXXNWKGSNRPVIDIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLWTSNSIVEFCGTSGTYGKGSWPDXXXXXXXXXXXXXX

SEQ ID NO: 419380 - protein, 475 aa, Influenza virus
  MOD_RES (1)..(95): Any amino acid
  MOD_RES (106)..(108): Any amino acid
  MOD_RES (123)..(438): Any amino acid
  MOD_RES (454)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGFAPFSEDNXXXVSAGGDIWVTRKPYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWTSNSIVAFCGTSGTXXXXXXXXXXXXXXXXXXXXXX

SEQ ID NO: 419381 - protein, 475 aa, Influenza virus
  MOD_RES (1)..(110): Any amino acid
  MOD_RES (124)..(441): Any amino acid
  MOD_RES (455)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASGDIWVTREPYAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSIVVFCGTPGTYXXXXXXXXXXXXXXXXXXXXX

SEQ ID NO: 419382 - protein, 569 aa, Influenza virus
  MOD_RES (17)..(21): Any amino acid
  MOD_RES (38)..(38): Any amino acid
  MOD_RES (94)..(94): Any amino acid
  MOD_RES (106)..(161): Any amino acid
  MOD_RES (173)..(182): Any amino acid
  MOD_RES (195)..(259): Any amino acid
  MOD_RES (289)..(294): Any amino acid
  MOD_RES (330)..(341): Any amino acid
  MOD_RES (392)..(418): Any amino acid
  MOD_RES (436)..(437): Any amino acid
  MOD_RES (499)..(500): Any amino acid
  MOD_RES (523)..(527): Any amino acid
MDNQTKTMTITFLILLXXXXXGDQICIGYHANNSTEKXDTILERNVTVTHAKDILEKTHNGKLCKLNGIPPLELGDCSIAGWLLGNPECDRLLXVPEWSYIVEKEXXXXXXXXXXXXXXXXXXXXXXXXXXXXXXXXXXXXXXXXXXXXXXXXXXXXXXXXPSFFRNMVWLTXXXXXXXXXXRSYNNTSGEQMLXXXXXXXXXXXXXXXXXXXXXXXXXXXXXXXXXXXXXXXXXXXXXXXXXXXXXXXXXXXXXXXXXINFESTGNLIAPEYGFKISKRGSSGIMKTXXXXXXCETKCQTPLGAINTTLPFHNIHPLTIGECPKYVKSXXXXXXXXXXXXPQIESRGLFGAIAGFIEGGWQGMVDGWYGYHHSNDQGSGYAADKESTQKAXXXXXXXXXXXXXXXXXXXXXXXXXXXNLERRLENLNKKMEDGFXXVWTYNAELLVLMENERTLDFHDSNVKNLYDKVRMQLRDNAKEIGNGCFEFYHKCDDECMNSXXNGTYDYPKYEEESKLNRNEIKGXXXXXMGVYQILAIYATVAGSLSLAIMIAGISFWMCSNGSLQCRICI

SEQ ID NO: 419383 - protein, 569 aa, Influenza virus
  MOD_RES (13)..(21): Any amino acid
  MOD_RES (38)..(38): Any amino acid
  MOD_RES (94)..(94): Any amino acid
  MOD_RES (106)..(161): Any amino acid
  MOD_RES (172)..(182): Any amino acid
  MOD_RES (195)..(259): Any amino acid
  MOD_RES (289)..(294): Any amino acid
  MOD_RES (330)..(341): Any amino acid
  MOD_RES (354)..(355): Any amino acid
  MOD_RES (392)..(418): Any amino acid
  MOD_RES (436)..(437): Any amino acid
  MOD_RES (499)..(500): Any amino acid
  MOD_RES (523)..(527): Any amino acid
  MOD_RES (540)..(540): Any amino acid
  MOD_RES (565)..(569): Any amino acid
MDKQTKTMTITFXXXXXXXXXGDQICIGYHSNNSTEKXDTILEQNVTVTHAKNILEKTHNGKLCRLSGIPPLELRDCSIAGWLLGNPKCDRLLXVPEWSYIMEKEXXXXXXXXXXXXXXXXXXXXXXXXXXXXXXXXXXXXXXXXXXXXXXXXXXXXXXXXSSFFRNMVWLXXXXXXXXXXXGSYNNTSGEQILXXXXXXXXXXXXXXXXXXXXXXXXXXXXXXXXXXXXXXXXXXXXXXXXXXXXXXXXXXXXXXXXXINFESTGNLVAPEYGFKISKRGGSGIMKTXXXXXXCETRCQTPLGAINTTLPFHNVHPLTIGECPKYIKSXXXXXXXXXXXXPQMESRGLFGAIXXFIEGGWQGMIDGWYGYHHSNDQGAGYAADKESTQRAXXXXXXXXXXXXXXXXXXXXXXXXXXXNLEKRLENLNKKVEDGFXXVWTYNVELLVLMENEMTLDFHDSNVRNLYDRVRMQLRDNAKELGNGCFEFYHKCNDECMNSXXNGTYDYSKYEEESKLNRTEIKGXXXXXMGIYQILAIYATXAGSLSLAIMMAGISLWMCSNGSLQXXXXX

SEQ ID NO: 419384 - protein, 569 aa, Influenza virus
  MOD_RES (17)..(21): Any amino acid
  MOD_RES (37)..(38): Any amino acid
  MOD_RES (94)..(94): Any amino acid
  MOD_RES (106)..(161): Any amino acid
  MOD_RES (173)..(182): Any amino acid
  MOD_RES (195)..(259): Any amino acid
  MOD_RES (289)..(294): Any amino acid
  MOD_RES (308)..(309): Any amino acid
  MOD_RES (329)..(341): Any amino acid
  MOD_RES (356)..(376): Any amino acid
  MOD_RES (392)..(418): Any amino acid
  MOD_RES (436)..(437): Any amino acid
  MOD_RES (499)..(500): Any amino acid
  MOD_RES (523)..(527): Any amino acid
  MOD_RES (538)..(540): Any amino acid
  MOD_RES (565)..(569): Any amino acid
MDNQTKKMTITFLILLXXXXXGDQICVGYHSNNSTEXXDTILEKNVTVTHAQDILEKVHNGKLCRLRGIPPLVLGDCSIAGWLLGNPECDILLXVPEWSYIVEREXXXXXXXXXXXXXXXXXXXXXXXXXXXXXXXXXXXXXXXXXXXXXXXXXXXXXXXXPSFFRNMIWLTXXXXXXXXXXGSYNNTNGEQILXXXXXXXXXXXXXXXXXXXXXXXXXXXXXXXXXXXXXXXXXXXXXXXXXXXXXXXXXXXXXXXXXISFESTGNLIAPEYGFRISKRGSSGIVKTXXXXXXCETQCQTPLGAINXXLPFHNIHPLAIGECPKYVKXXXXXXXXXXXXXPQIEPRGLFGAIAGXXXXXXXXXXXXXXXXXXXXXQGSGYAADKASTQKAXXXXXXXXXXXXXXXXXXXXXXXXXXXSLERRLENLNKKMEDGLXXVWTYNAEVLVLMENERTLEFHDSNVKSLYDKVRMQLKDNAKEVGNGCFEFYHKCDNECMDSXXNGTYNYPKYEEESRLNRNEIKGXXXXXMGAYQILAIYXXXAGSLSLAIMVAGISIWMCSNGSLQXXXXX

SEQ ID NO: 419385 - protein, 569 aa, Influenza virus
  MOD_RES (14)..(21): Any amino acid
  MOD_RES (38)..(42): Any amino acid
  MOD_RES (79)..(81): Any amino acid
  MOD_RES (94)..(94): Any amino acid
  MOD_RES (106)..(182): Any amino acid
  MOD_RES (195)..(259): Any amino acid
  MOD_RES (271)..(272): Any amino acid
  MOD_RES (289)..(294): Any amino acid
  MOD_RES (311)..(318): Any amino acid
  MOD_RES (330)..(341): Any amino acid
  MOD_RES (354)..(418): Any amino acid
  MOD_RES (435)..(437): Any amino acid
  MOD_RES (487)..(487): Any amino acid
  MOD_RES (499)..(500): Any amino acid
  MOD_RES (523)..(528): Any amino acid
  MOD_RES (540)..(544): Any amino acid
  MOD_RES (564)..(569): Any amino acid
MDNKTKKMTITFLXXXXXXXXGDRICIGYHANNSTETXXXXXERNVTVTHAQDILERTHNGKLCKLSGVPPLELGDCSXXXWLLGNPECDLLLXVPEWSYIIEKEXXXXXXXXXXXXXXXXXXXXXXXXXXXXXXXXXXXXXXXXXXXXXXXXXXXXXXXXXXXXXXXXXXXXXXXXXXXXXRSYNNTSGKQMLXXXXXXXXXXXXXXXXXXXXXXXXXXXXXXXXXXXXXXXXXXXXXXXXXXXXXXXXXXXXXXXXXISFESTGNLVAXXYGFKISKRGNSGIMKTXXXXXXCETKCQSPLGAINTTLXXXXXXXXTIGECPKYVRSXXXXXXXXXXXXPQTESRGLFGAIXXXXXXXXXXXXXXXXXXXXXXXXXXXXXXXXXXXXXXXXXXXXXXXXXXXXXXXXXXXXXXXXXNLEKRLGNLNKKMEDGXXXVWTYNTELLVLMENERTLDYHDSNVKNLYNKVRMQLRDNVKELGNGCFEXYHKCDDECMDSXXNGTYYYPKYEEESKLKRNEIKGXXXXXXGVYQILVIYATXXXXXSLAIMIAGIFLWMCSNGSLXXXXXX

SEQ ID NO: 419386 - protein, 569 aa, Influenza virus
  MOD_RES (1)..(21): Any amino acid
  MOD_RES (38)..(44): Any amino acid
  MOD_RES (58)..(58): Any amino acid
  MOD_RES (78)..(82): Any amino acid
  MOD_RES (94)..(95): Any amino acid
  MOD_RES (106)..(182): Any amino acid
  MOD_RES (193)..(259): Any amino acid
  MOD_RES (275)..(275): Any amino acid
  MOD_RES (289)..(294): Any amino acid
  MOD_RES (316)..(341): Any amino acid
  MOD_RES (356)..(420): Any amino acid
  MOD_RES (435)..(450): Any amino acid
  MOD_RES (499)..(500): Any amino acid
  MOD_RES (523)..(544): Any amino acid
  MOD_RES (564)..(569): Any amino acid
XXXXXXXXXXXXXXXXXXXXXGDQICVGYHANNSTERXXXXXXXNITVTHAKDILERXHNGKLCRLNGIPPLELGNCXXXXXLLGNPECDLFLXXPEWSYIMEKKXXXXXXXXXXXXXXXXXXXXXXXXXXXXXXXXXXXXXXXXXXXXXXXXXXXXXXXXXXXXXXXXXXXXXXXXXXXXXGSYNNTSGKQXXXXXXXXXXXXXXXXXXXXXXXXXXXXXXXXXXXXXXXXXXXXXXXXXXXXXXXXXXXXXXXXXXXINFESNGNLIAPEYGXKISKRGSSGVMKTXXXXXXCDTKCQTPLGALNTTLPFHNIXXXXXXXXXXXXXXXXXXXXXXXXXXPQIEARGLFGAIAGXXXXXXXXXXXXXXXXXXXXXXXXXXXXXXXXXXXXXXXXXXXXXXXXXXXXXXXXXXXXXXXXXERRLENLSKRMEDGXXXXXXXXXXXXXXXXNERTLGFHDSNVKNLYEKVRMQLRDNAKETGNGCFEFYHKCDDECMSSXXNGTYDYIKYEEESKLNRSEIKGXXXXXXXXXXXXXXXXXXXXXXSLAIMMAGIFFWMCSNGSLXXXXXX

SEQ ID NO: 419387 - protein, 569 aa, Influenza virus
  MOD_RES (1)..(26): Any amino acid
  MOD_RES (38)..(52): Any amino acid
  MOD_RES (65)..(68): Any amino acid
  MOD_RES (79)..(183): Any amino acid
  MOD_RES (195)..(422): Any amino acid
  MOD_RES (436)..(451): Any amino acid
  MOD_RES (466)..(468): Any amino acid
  MOD_RES (480)..(501): Any amino acid
  MOD_RES (513)..(569): Any amino acid
XXXXXXXXXXXXXXXXXXXXXXXXXXIGYHSNNSTKKXXXXXXXXXXXXXXXDILEKAHNGKLCXXXXTPPLELGDCSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSYNNTSGEQVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLENLDKKMEDGFXXXXXXXXXXXXXXXXERILDFHDSNVKSLXXXVKMQLRDNAKEXXXXXXXXXXXXXXXXXXXXXXGTYDYPKYEKEXXXXXXXXXXXXXXXXXXXXXXXXXXXXXXXXXXXXXXXXXXXXXXXXXXXXXXXXX

SEQ ID NO: 419388 - protein, 569 aa, Influenza virus
  MOD_RES (1)..(53): Any amino acid
  MOD_RES (64)..(453): Any amino acid
  MOD_RES (465)..(569): Any amino acid
XXXXXXXXXXXXXXXXXXXXXXXXXXXXXXXXXXXXXXXXXXXXXXXXXXXXXILEKMHNGKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLDFHDSSVKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419389 - protein, 562 aa, Influenza virus
  MOD_RES (1)..(12): Any amino acid
  MOD_RES (101)..(103): Any amino acid
  MOD_RES (118)..(122): Any amino acid
  MOD_RES (136)..(154): Any amino acid
  MOD_RES (166)..(173): Any amino acid
  MOD_RES (199)..(203): Any amino acid
  MOD_RES (214)..(249): Any amino acid
  MOD_RES (286)..(286): Any amino acid
  MOD_RES (386)..(392): Any amino acid
  MOD_RES (403)..(404): Any amino acid
XXXXXXXXXXXXVRGDQICIGYHANNSTEKVDTILERNVTVTHAKDILEKTHNGKLCKLNGIPPLELGDCSIAGWLLGNPECDRLLSVPEWSYIMEKENPXXXLCYPGSFNDYEELKXXXXXVKHFEKVKILPKDXXXXXXXXXXXXXXXXXXXPSFFRNMVWLTXXXXXXXXAKGSYNNTSGEQMLIIWGVHHPNDEXXXXXLYQNVGTYVSXXXXXXXXXXXXXXXXXXXXXXXXXXXXXXXXXXXXWDTINFESTGNLIAPEYGFKISKRGSSGIMKTEGTLXNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFXXXXXXXNSVIEKMNTQXXAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 419390 - protein, 562 aa, Influenza virus
  MOD_RES (1)..(12): Any amino acid
  MOD_RES (101)..(103): Any amino acid
  MOD_RES (118)..(122): Any amino acid
  MOD_RES (136)..(154): Any amino acid
  MOD_RES (166)..(173): Any amino acid
  MOD_RES (199)..(203): Any amino acid
  MOD_RES (214)..(249): Any amino acid
  MOD_RES (286)..(286): Any amino acid
  MOD_RES (348)..(348): Any amino acid
  MOD_RES (386)..(392): Any amino acid
  MOD_RES (403)..(404): Any amino acid
  MOD_RES (530)..(533): Any amino acid
XXXXXXXXXXXXVKGDQICIGYHSNNSTEKVDTNLERNVTVTHAQDILEKTHNGRLCKLSGIPPLELGDCSITGWLLGNPECDRLLRVPEWSYIVERENPXXXLCYPGSFNNYEELKXXXXXVTHFEKVKILPRDXXXXXXXXXXXXXXXXXXXPSFFRNMIWLTXXXXXXXXAKRSYNNTSGEQVLVIWGIHHPNDDXXXXXLYQKVGTYVSXXXXXXXXXXXXXXXXXXXXXXXXXXXXXXXXXXXXWDVINFESTGNLVAPEYGFKISRRGNSGIMKTEKTLXNCETKCQSPLGAINTTLPFHNIHPLTIGECPRYVKSEKLVLATGPRNVPQIEPRGLFGAIAXFIEGGWQGMIDGWYGYHHSNDQGAGYAADKESTQRAFXXXXXXXNSIIEKMNTQXXAVGKEFNNLERRLENLSKRMEDGFIDVWTYNAELLVLMENEMTLDFHDSNVRNLYDKVRMQLRDNAKEIGNGCFEFYHKCNDECMNSVRNGTYDYPKYEKESKLNRNEIKGIKLSNMGVYQILAIXXXXAGSLSLAIMIAGISLWMCSNGSLQCRVCI

SEQ ID NO: 419391 - protein, 562 aa, Influenza virus
  MOD_RES (1)..(12): Any amino acid
  MOD_RES (101)..(103): Any amino acid
  MOD_RES (118)..(122): Any amino acid
  MOD_RES (136)..(154): Any amino acid
  MOD_RES (165)..(173): Any amino acid
  MOD_RES (199)..(203): Any amino acid
  MOD_RES (214)..(249): Any amino acid
  MOD_RES (286)..(286): Any amino acid
  MOD_RES (344)..(369): Any amino acid
  MOD_RES (386)..(392): Any amino acid
  MOD_RES (403)..(404): Any amino acid
  MOD_RES (437)..(439): Any amino acid
  MOD_RES (548)..(562): Any amino acid
XXXXXXXXXXXXVRGDQICVGYHSNNSTETVDTILERNVTVTHAKNILEKTHNGKLCRLSGIPPLELGNCSIAGWLLGNPECDRLLTVPEWSYIVEKENPXXXLCYPGNFNDYEELKXXXXXVKHFEKVRILPKDXXXXXXXXXXXXXXXXXXXSSFFRNMVWLXXXXXXXXXARGSYNNTSGEQMLVIWGVHHPIDEXXXXXLYQEVGTYVSXXXXXXXXXXXXXXXXXXXXXXXXXXXXXXXXXXXXWDVISFESTGNLIAPEYGFRISKRGSSGIMKTGGTLXDCETKCQTPLGALNTTLPFHNIHPLTMGECPKYVKSDRLVLATGLRNIPQIESRGLFXXXXXXXXXXXXXXXXXXXXXXXXXXQGSGYAADKASTQKAIXXXXXXXNSVIEKMNIQXXAVGKEFGNLERRLENLNKRMEDGFRDVWTYNAXXXVLMENERTLGFHDSNVKNLYNKVRMQLRDNAKELGNGCFEFYHKCDNECMDSVKNGTYYYPKYEEESKLKRNEIKGVKLSNMGVYQVLAIYATVAGSLSLAIMVAGISXXXXXXXXXXXXXXX

SEQ ID NO: 419392 - protein, 562 aa, Influenza virus
  MOD_RES (1)..(12): Any amino acid
  MOD_RES (70)..(77): Any amino acid
  MOD_RES (101)..(103): Any amino acid
  MOD_RES (118)..(122): Any amino acid
  MOD_RES (136)..(173): Any amino acid
  MOD_RES (199)..(203): Any amino acid
  MOD_RES (214)..(249): Any amino acid
  MOD_RES (286)..(286): Any amino acid
  MOD_RES (299)..(303): Any amino acid
  MOD_RES (347)..(375): Any amino acid
  MOD_RES (386)..(392): Any amino acid
  MOD_RES (403)..(404): Any amino acid
  MOD_RES (440)..(441): Any amino acid
  MOD_RES (477)..(487): Any amino acid
  MOD_RES (533)..(537): Any amino acid
  MOD_RES (557)..(562): Any amino acid
XXXXXXXXXXXXVKGDRICIGYHANNSTETIDTILERNVTVTHAQNILEKTHNGRLCRLRGIPPLELGDXXXXXXXXGNPECDRLLNVPEWSYIIEKENPXXXLCYPGSLNDYEELKXXXXXVRHFEKVKILARNXXXXXXXXXXXXXXXXXXXXXXXXXXXXXXXXXXXXXXAKGSYNNTNGEQILIIWGVHHPKDEXXXXXLYQNVETYVSXXXXXXXXXXXXXXXXXXXXXXXXXXXXXXXXXXXXLDTINFESTGNLVVPEYGFKISKRGGSGIMKTERTLXNCDTKCQTPLGAXXXXXPFHNVHPLAIGECPKYVKSERLVLATGLRNAHKMESRGLFGAIXXXXXXXXXXXXXXXXXXXXXXXXXXXXXADKESTQKAIXXXXXXXNFVIEKMNTQXXAVEKEFSNLEKRLENLNKKVEDGFLDVWTYNTELLXXMENERILDFHDSNVKSLYDKVRMQLRDNVKELGDGXXXXXXXXXXXCMSSVKNGTYDYSKYEEESKLNKNEIKGVKLSNMGIYQILAIYATXXXXXSLAIMIAGIFLWMCSNGSLXXXXXX

SEQ ID NO: 419393 - protein, 562 aa, Influenza virus
  MOD_RES (1)..(20): Any amino acid
  MOD_RES (41)..(41): Any amino acid
  MOD_RES (61)..(77): Any amino acid
  MOD_RES (98)..(122): Any amino acid
  MOD_RES (136)..(173): Any amino acid
  MOD_RES (185)..(188): Any amino acid
  MOD_RES (199)..(249): Any amino acid
  MOD_RES (264)..(268): Any amino acid
  MOD_RES (286)..(286): Any amino acid
  MOD_RES (300)..(311): Any amino acid
  MOD_RES (346)..(375): Any amino acid
  MOD_RES (386)..(392): Any amino acid
  MOD_RES (403)..(404): Any amino acid
  MOD_RES (438)..(444): Any amino acid
  MOD_RES (470)..(487): Any amino acid
  MOD_RES (535)..(537): Any amino acid
  MOD_RES (557)..(562): Any amino acid
XXXXXXXXXXXXXXXXXXXXGYHSNNSTKKADTILERNVTXTHAKDILEKAHNGKLCRLSXXXXXXXXXXXXXXXXXGNPECDRFLSIPEWSYIMEKXXXXXXXXXXXXXXXXXXXXXXXXXVTHFEKIKILPRDXXXXXXXXXXXXXXXXXXXXXXXXXXXXXXXXXXXXXXAQGSYNNTSGEXXXXIWGIHHPNDEXXXXXXXXXXXXXXXXXXXXXXXXXXXXXXXXXXXXXXXXXXXXXXXXXXXWDTISFESTGNLVAXXXXXKISKRGSSGVMKTEGTLXNCETQCQTPLGAIXXXXXXXXXXXXTIGECPKYVRSEKLVLATGLRNVPQMESRGLFGAXXXXXXXXXXXXXXXXXXXXXXXXXXXXXXADKESTQKAVXXXXXXXNSVIEKINTQXXSVGKEFSNLEKRLGNLNKKMEDGLLDVWTYNAEXXXXXXXERTLDFHDSSVKNLYEKVRMQLRDNXXXXXXXXXXXXXXXXXXCMNSVKTGTYDYPKYEEESRLNRNEIKGVELSSMGVYQILVIYATVAXXXSLAIMMAGIFFWMCSNGSLXXXXXX

SEQ ID NO: 419394 - protein, 562 aa, Influenza virus
  MOD_RES (1)..(29): Any amino acid
  MOD_RES (40)..(41): Any amino acid
  MOD_RES (59)..(89): Any amino acid
  MOD_RES (101)..(180): Any amino acid
  MOD_RES (191)..(314): Any amino acid
  MOD_RES (333)..(333): Any amino acid
  MOD_RES (349)..(407): Any amino acid
  MOD_RES (439)..(450): Any amino acid
  MOD_RES (471)..(492): Any amino acid
  MOD_RES (530)..(562): Any amino acid
XXXXXXXXXXXXXXXXXXXXXXXXXXXXXKIDTILERNVXXTHAQDILERTHNGKLCKXXXXXXXXXXXXXXXXXXXXXXXXXXXXXXXEWSYIVERETPXXXXXXXXXXXXXXXXXXXXXXXXXXXXXXXXXXXXXXXXXXXXXXXXXXXXXXXXXXXXXXXXXXXXXXXXXXXXXXXXTSGKQMLIIWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXECPKYVKSKRLVLATGLRXVPQIEARGLFGAIAGXXXXXXXXXXXXXXXXXXXXXXXXXXXXXXXXXXXXXXXXXXXXXXXXXXXXXXXXXXXKEFNNLEKRLENLDKKMEDGFLGVWTYNAELXXXXXXXXXXXXHDSNVKNLYERVRMQLRDNAXXXXXXXXXXXXXXXXXXXXXXRNGTYNYPKYEEESRLNRNEIKGIKLSSMGIYQILAIXXXXXXXXXXXXXXXXXXXXXXXXXXXXXXXXX

SEQ ID NO: 419395 - protein, 562 aa, Influenza virus
  MOD_RES (1)..(50): Any amino acid
  MOD_RES (65)..(319): Any amino acid
  MOD_RES (339)..(457): Any amino acid
  MOD_RES (470)..(507): Any amino acid
  MOD_RES (519)..(562): Any amino acid
XXXXXXXXXXXXXXXXXXXXXXXXXXXXXXXXXXXXXXXXXXXXXXXXXXTHNGKLCRLRGIPPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKSDRLVLAIGLRNVPQIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLYDRVRMQLRDNXXXXXXXXXXXXXXXXXXXXXXXXXXXXXXXXXXXXXXLKRNEIKGVELXXXXXXXXXXXXXXXXXXXXXXXXXXXXXXXXXXXXXXXXXXXX

SEQ ID NO: 419396 - protein, 562 aa, Influenza virus
  MOD_RES (1)..(513): Any amino acid
  MOD_RES (526)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGVKLSSMGIYQXXXXXXXXXXXXXXXXXXXXXXXXXXXXXXXXXXXXX

SEQ ID NO: 419397 - protein, 469 aa, Influenza virus
  MOD_RES (16)..(24): Any amino acid
  MOD_RES (44)..(51): Any amino acid
  MOD_RES (62)..(86): Any amino acid
  MOD_RES (210)..(212): Any amino acid
  MOD_RES (367)..(367): Any amino acid
  MOD_RES (386)..(399): Any amino acid
MNPNQKIITIGSVSLXXXXXXXXXQIAILATTVTLHFKQHECDXXXXXXXXPCEPIIIERNXXXXXXXXXXXXXXXXXXXXXXXXXWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGXXXDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTIXKDLRSGYETFKVIGGWSTXXXXXXXXXXXXXXNNNWSGYSGIFSVEGKSCINRCFYVELIRGRPQETRVWWTSNSIVVFCGTSGTYGTGSWPDGANINFMPI

SEQ ID NO: 419398 - protein, 469 aa, Influenza virus
  MOD_RES (16)..(24): Any amino acid
  MOD_RES (44)..(51): Any amino acid
  MOD_RES (62)..(86): Any amino acid
  MOD_RES (210)..(212): Any amino acid
  MOD_RES (367)..(367): Any amino acid
  MOD_RES (386)..(399): Any amino acid
MNPNQKTITIGSVSLXXXXXXXXXQIAILVTTVTLHFKQNECSXXXXXXXXPCEPIIVERNXXXXXXXXXXXXXXXXXXXXXXXXXWSKPQCKITGFAPFSKDNPIRLSGGGDIWVTREPYVSCSPSKCYQFALGQGATLDNKHSNDTIHDRTPHRTLLMNELGVSFHLGTKQVCIAWSSSSCHDGRAWLHVCVTGDDKNATASFIYNGXXXDSIVSWSQNILRTHESECVCINGSCTVVMTDGSASGKADTRILFIEEGKIIHISPLSGSAQHVEECSCYPRYPGVRCICRDNWRGSNRPVVDINMADYSIDSSYICSGLVGDTPRNGDSSSNSNCRNPNNERGNQGVKGWAFDNGNDVWMGRTIXKDSRSGYETFKVIGGWTTXXXXXXXXXXXXXXSDNRSGYSGIFSVEHKGCINRCFYVELIRGRKQETRVWWTSNSIAVFCGTSGTYGTGSWPDGADINFMPI

SEQ ID NO: 419399 - protein, 469 aa, Influenza virus
  MOD_RES (1)..(1): Any amino acid
  MOD_RES (16)..(24): Any amino acid
  MOD_RES (44)..(51): Any amino acid
  MOD_RES (62)..(86): Any amino acid
  MOD_RES (159)..(162): Any amino acid
  MOD_RES (182)..(182): Any amino acid
  MOD_RES (210)..(212): Any amino acid
  MOD_RES (319)..(319): Any amino acid
  MOD_RES (367)..(367): Any amino acid
  MOD_RES (386)..(399): Any amino acid
  MOD_RES (451)..(454): Any amino acid
XNPNQKIITIDSVSLXXXXXXXXXQIAILAATVTLHFKQHKCDXXXXXXXXPCEPIIIEKNXXXXXXXXXXXXXXXXXXXXXXXXXWSKPQCQIAGFAPFSKDNSIRLSADGDIWVTREPYVSCDTVKCYQFALGQGTTLENKHSNGTKHDRIPHRTLXXXXLGVPFHLGTRQVCIAWSSSXCHDGKAWLHICVTGDDENATASFIYGGXXXDSIGSWSHNILRTQESECICINRICTVVMTDGSASGRADTKILFIEEGKIVHIGPLSGSAQHIEECSCYSRYPNVRCVCRDNWKGSNRPIIDINIAEYSIDSSYVCXGLVGDTPRSDDSSSSSNCRDPNNEKGNQGVKGWAFDSGSDVWMGRTIXRDSRSGYETFRVIGGWATXXXXXXXXXXXXXXSNNWSGYSGIFSVENKRCINRCFYVELIRGRQQETRVWWTSSSIVVFCGTSXXXXKGSWPDGANIDFMPV

SEQ ID NO: 419400 - protein, 469 aa, Influenza virus
  MOD_RES (1)..(2): Any amino acid
  MOD_RES (16)..(24): Any amino acid
  MOD_RES (43)..(51): Any amino acid
  MOD_RES (62)..(86): Any amino acid
  MOD_RES (99)..(103): Any amino acid
  MOD_RES (163)..(166): Any amino acid
  MOD_RES (182)..(184): Any amino acid
  MOD_RES (210)..(212): Any amino acid
  MOD_RES (332)..(332): Any amino acid
  MOD_RES (367)..(367): Any amino acid
  MOD_RES (379)..(399): Any amino acid
  MOD_RES (411)..(414): Any amino acid
  MOD_RES (450)..(455): Any amino acid
  MOD_RES (469)..(469): Any amino acid
XXPNQKIITMGSVSLXXXXXXXXXQIAILATTITLHFKQNECXXXXXXXXXPCEPTIIERNXXXXXXXXXXXXXXXXXXXXXXXXXWSKPQCHITGFAXXXXXNSIRLSASGDIWVTREPYVSCDSNKCYQFALGQGTTLNNKHSNGTIHDRSPHRTLLMNEXXXXFHLGTRQVCVAWSSSXXXDGKAWLHVCITGDDKNATASLIYDGXXXDSISSWSQNILRTQESECVCISGTCAVVMTDGSASGKADTRILFVKEGKVVHISPLAGSAQHVEECSCYPQYPDVRCVCRDNWRGSNRPVLDISMEDYSIDSGYVCSGLVGDTPRNNDGXSNSNCKDPNNERGTQGVKGWAFDDGNDLWMGRTIXKESRSGYETFKXXXXXXXXXXXXXXXXXXXXXSNNRSGYSGIFXXXXKNCINRCFYVELIRGRSQETRVWWTSNSIVVFVAPXXXXXXGSWPDGANTNFMPX

SEQ ID NO: 419401 - protein, 469 aa, Influenza virus
  MOD_RES (1)..(2): Any amino acid
  MOD_RES (14)..(24): Any amino acid
  MOD_RES (44)..(87): Any amino acid
  MOD_RES (100)..(106): Any amino acid
  MOD_RES (126)..(126): Any amino acid
  MOD_RES (137)..(137): Any amino acid
  MOD_RES (159)..(166): Any amino acid
  MOD_RES (186)..(187): Any amino acid
  MOD_RES (208)..(213): Any amino acid
  MOD_RES (225)..(226): Any amino acid
  MOD_RES (245)..(249): Any amino acid
  MOD_RES (307)..(308): Any amino acid
  MOD_RES (367)..(370): Any amino acid
  MOD_RES (382)..(399): Any amino acid
  MOD_RES (410)..(414): Any amino acid
  MOD_RES (444)..(456): Any amino acid
XXPNQKIITIGFVXXXXXXXXXXXHIAILVTTVTLHFKQHDCDXXXXXXXXXXXXXXXXXXXXXXXXXXXXXXXXXXXXXXXXXXXXSKTQCQITGFAPXXXXXXXRLSAGGDIWITREPYVSCDXDKCYQFALGQXTTLDNKHSNDTVHDRIPHRTLXXXXXXXXFHLGTKQVCAAWSSSSCHDXXTWLHVCVTGDDRNATASLIYXXXXXXSVGSWSQNILRXXESECVCINGICTVVMTDGXXXXXADTRILFIREGKIVHVSPLSGSAQHIEECSCYPQYPDVRCTCRDNWKGSNRPIVDINXXDYSIDSNYVCSGLVGDTPRNDDRSSNSKSRDPNNERGNHGVKGWAFDYGDDVLMGRTIXXXXRSGYETFRVTGXXXXXXXXXXXXXXXXXXKNNWSGYSGIXXXXXKSCVNRCFYVELIRGMPQEARVWWTSNSIXXXXXXXXXXXXXSWPDGANINLMPI

SEQ ID NO: 419402 - protein, 469 aa, Influenza virus
  MOD_RES (1)..(3): Any amino acid
  MOD_RES (16)..(33): Any amino acid
  MOD_RES (44)..(107): Any amino acid
  MOD_RES (126)..(192): Any amino acid
  MOD_RES (210)..(276): Any amino acid
  MOD_RES (298)..(303): Any amino acid
  MOD_RES (315)..(322): Any amino acid
  MOD_RES (357)..(374): Any amino acid
  MOD_RES (386)..(456): Any amino acid
XXXNQKIITIGSASLXXXXXXXXXXXXXXXXXXTLHFKQHECNXXXXXXXXXXXXXXXXXXXXXXXXXXXXXXXXXXXXXXXXXXXXXXXXXXXXXXXXXXXXXXXXLSAGGDIWVMREPYVSCNXXXXXXXXXXXXXXXXXXXXXXXXXXXXXXXXXXXXXXXXXXXXXXXXXXXXXXXXXXXXXXXXXXXCITGDDRNATASFIYEGXXXXXXXXXXXXXXXXXXXXXXXXXXXXXXXXXXXXXXXXXXXXXXXXXXXXXXXXXXXXXXXXXXXECSCYPRYPNVRCICKDNWKGXXXXXXDISMEDYSIGSXXXXXXXXGDTPRNDDRFSSSNCRNPNNEKGYPGVKGWAFDSXXXXXXXXXXXXXXXXXXETFRVIGGWTTXXXXXXXXXXXXXXXXXXXXXXXXXXXXXXXXXXXXXXXXXXXXXXXXXXXXXXXXXXXXXXXXXXXXXXXSWPDGANISFMPI

SEQ ID NO: 419403 - protein, 469 aa, Influenza virus
  MOD_RES (1)..(116): Any amino acid
  MOD_RES (127)..(193): Any amino acid
  MOD_RES (208)..(284): Any amino acid
  MOD_RES (295)..(341): Any amino acid
  MOD_RES (357)..(374): Any amino acid
  MOD_RES (386)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTREPYVSCGPXXXXXXXXXXXXXXXXXXXXXXXXXXXXXXXXXXXXXXXXXXXXXXXXXXXXXXXXXXXXXXXXXXXVTGYEKNATASFIYXXXXXXXXXXXXXXXXXXXXXXXXXXXXXXXXXXXXXXXXXXXXXXXXXXXXXXXXXXXXXXXXXXXXXXXXXXXXXPDVRCICKDNXXXXXXXXXXXXXXXXXXXXXXXXXXXXXXXXXXXXXXXXXXXXXXXNERGYPGVKGWAFDDXXXXXXXXXXXXXXXXXXETFRVIGGWVTXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419404 - protein, 469 aa, Influenza virus
  MOD_RES (1)..(346): Any amino acid
  MOD_RES (357)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPGVKGWAFDYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419405 - protein, 580 aa, Influenza virus
  MOD_RES (15)..(29): Any amino acid
  MOD_RES (51)..(57): Any amino acid
  MOD_RES (72)..(86): Any amino acid
  MOD_RES (105)..(133): Any amino acid
  MOD_RES (147)..(200): Any amino acid
  MOD_RES (213)..(273): Any amino acid
  MOD_RES (287)..(291): Any amino acid
  MOD_RES (302)..(306): Any amino acid
  MOD_RES (332)..(340): Any amino acid
  MOD_RES (355)..(356): Any amino acid
  MOD_RES (408)..(414): Any amino acid
  MOD_RES (480)..(480): Any amino acid
  MOD_RES (506)..(539): Any amino acid
  MOD_RES (557)..(562): Any amino acid
MLSLIMRTVIALSYXXXXXXXXXXXXXXXNNNNNTATLCCLGHHAVPNGTXXXXXXXDQIEVTNATELVQSXXXXXXXXXXXXXXXWEKNCTLIDALLGDPQCDXXXXXXXXXXXXXXXXXXXXXXXXXXXXXSLRSLVASSGTLEXXXXXXXXXXXXXXXXXXXXXXXXXXXXXXXXXXXXXXXXXXXXXXXXXXXXXXFDKLYIWGVHHPXXXXXXXXXXXXXXXXXXXXXXXXXXXXXXXXXXXXXXXXXXXXXXXXXXXXXXXXXXXXXSTGNLIAPRGYFKXXXXXLNNEIRWPPHXXXXXSECITPNGSIPNDKPFQNVNRITYGXXXXXXXXXTLKLATGMRNVPEKXXRGIFGAIAGFIENGWEGMVDGWYGFRHQNSNSEGTGQAADLKSTQAAIDQIXXXXXXXIGKTNEKFHQIEKEFSEVEGRIQDLEKYVEDTKIDLWSYNAELLVALENQHTIDLTDSEMNKLFEXTKKQLRENAEDMGNGCFKIYHKCDNXXXXXXXXXXXXXXXXXXXXXXXXXXXXXXXXXXGYKDWILWISFAISCFLXXXXXXGFIMWACQKGNIRCNICI

SEQ ID NO: 419406 - protein, 580 aa, Influenza virus
  MOD_RES (1)..(3): Any amino acid
  MOD_RES (15)..(32): Any amino acid
  MOD_RES (49)..(57): Any amino acid
  MOD_RES (72)..(90): Any amino acid
  MOD_RES (105)..(133): Any amino acid
  MOD_RES (147)..(200): Any amino acid
  MOD_RES (213)..(273): Any amino acid
  MOD_RES (287)..(306): Any amino acid
  MOD_RES (332)..(341): Any amino acid
  MOD_RES (355)..(356): Any amino acid
  MOD_RES (408)..(414): Any amino acid
  MOD_RES (480)..(480): Any amino acid
  MOD_RES (506)..(539): Any amino acid
  MOD_RES (555)..(562): Any amino acid
XXXHSMSGFRSNLPXXXXXXXXXXXXXXXXXXNNSTATLCLGHHAVPNXXXXXXXXXDHIEVTNATELVQNXXXXXXXXXXXXXXXXXXXCTLMDALLGDPHCDXXXXXXXXXXXXXXXXXXXXXXXXXXXXXSLRSLIASSGTLEXXXXXXXXXXXXXXXXXXXXXXXXXXXXXXXXXXXXXXXXXXXXXXXXXXXXXXFDKLYVWGVHHPXXXXXXXXXXXXXXXXXXXXXXXXXXXXXXXXXXXXXXXXXXXXXXXXXXXXXXXXXXXXXSNGNLIAPRGYFRXXXXXXXXXXXXXXXXXXXXSACITPNGSIPNEKPFQNVNKITYGXXXXXXXXXXLKLATGMRNIPEKXXRGLFGAIAGFIENGWEGMIDGWYGFRHHNSNSEGIGQAADLKSTQTAIDQIXXXXXXXIEKTNEKFHQIEKEFSEIEGRIQDLEKYIEDTKVDLWSYNAELLVALENQNTIDLTDSEMSKLFEXTRRQLRENAEDMGGGCFTIYHKCDNXXXXXXXXXXXXXXXXXXXXXXXXXXXXXXXXXXGYKDWVLWISFAISCXXXXXXXXGFIMWACQRGNIRCNICI

SEQ ID NO: 419407 - protein, 580 aa, Influenza virus
  MOD_RES (1)..(10): Any amino acid
  MOD_RES (22)..(35): Any amino acid
  MOD_RES (51)..(57): Any amino acid
  MOD_RES (72)..(90): Any amino acid
  MOD_RES (105)..(133): Any amino acid
  MOD_RES (147)..(200): Any amino acid
  MOD_RES (213)..(273): Any amino acid
  MOD_RES (287)..(306): Any amino acid
  MOD_RES (332)..(344): Any amino acid
  MOD_RES (355)..(356): Any amino acid
  MOD_RES (408)..(414): Any amino acid
  MOD_RES (480)..(480): Any amino acid
  MOD_RES (494)..(494): Any amino acid
  MOD_RES (506)..(539): Any amino acid
  MOD_RES (557)..(562): Any amino acid
  MOD_RES (576)..(580): Any amino acid
XXXXXXXXXXIFIFILLTHWAXXXXXXXXXXXXXXMATLCLGHHAVANGTXXXXXXXDQVEVTNATELVQIXXXXXXXXXXXXXXXXXXXCTLIDAMLGDPHCDXXXXXXXXXXXXXXXXXXXXXXXXXXXXXSLRSIVASSGTLEXXXXXXXXXXXXXXXXXXXXXXXXXXXXXXXXXXXXXXXXXXXXXXXXXXXXXXFDKLYIWGIHHPXXXXXXXXXXXXXXXXXXXXXXXXXXXXXXXXXXXXXXXXXXXXXXXXXXXXXXXXXXXXXSNGNLVAPRGYFKXXXXXXXXXXXXXXXXXXXXSGCITPNGSIPNNKPFQNVNKVTYGXXXXXXXXXXXXXATGMRNVPERXXKGLFGAIAGFIENGWEGMMDGWYGFRHLNSNSEGRGQAADLKSTQAAVNQIXXXXXXXIERTNEKFHQIEKEFTEVEGRIQDLERYVEDTKIDLWSYNAGLLVALENQHTIHLTDSEMNKLFDXTRKQLRENAEDLGXGCLKIYHKCDNXXXXXXXXXXXXXXXXXXXXXXXXXXXXXXXXXXEYKDWILWISFATSCFLXXXXXXGFIVWACQRGNIRXXXXX

SEQ ID NO: 419408 - protein, 580 aa, Influenza virus
  MOD_RES (1)..(10): Any amino acid
  MOD_RES (22)..(35): Any amino acid
  MOD_RES (51)..(57): Any amino acid
  MOD_RES (72)..(90): Any amino acid
  MOD_RES (102)..(133): Any amino acid
  MOD_RES (147)..(200): Any amino acid
  MOD_RES (211)..(273): Any amino acid
  MOD_RES (284)..(306): Any amino acid
  MOD_RES (324)..(344): Any amino acid
  MOD_RES (355)..(366): Any amino acid
  MOD_RES (386)..(386): Any amino acid
  MOD_RES (408)..(414): Any amino acid
  MOD_RES (426)..(438): Any amino acid
  MOD_RES (480)..(480): Any amino acid
  MOD_RES (506)..(539): Any amino acid
  MOD_RES (553)..(562): Any amino acid
XXXXXXXXXXIFNFILLTHWAXXXXXXXXXXXXXXAATLCLGHHAVQNGTXXXXXXXDRIEVTNATELVQGXXXXXXXXXXXXXXXXXXXCTLVDALLGDPXXXXXXXXXXXXXXXXXXXXXXXXXXXXXXXXTLRSLVASSGNLEXXXXXXXXXXXXXXXXXXXXXXXXXXXXXXXXXXXXXXXXXXXXXXXXXXXXXXSDKLYIWGVHXXXXXXXXXXXXXXXXXXXXXXXXXXXXXXXXXXXXXXXXXXXXXXXXXXXXXXXXXXXXXXXCTGNLIAPRGXXXXXXXXXXXXXXXXXXXXXXXFECITPNGSISNDKPFQXXXXXXXXXXXXXXXXXXXXXATGMRNVPETXXXXXXXXXXXXIENGWEGMVNGWYGFRHQNXNSEGMGQAADLKSTQAAINQIXXXXXXXIKKTNEKFHQIXXXXXXXXXXXXXLEKYVEDTKVDLWSYNADVLVALENQHTIDLADSEMNKLFEXTKRQLRENAEDIGNGCFKIYHRCDNXXXXXXXXXXXXXXXXXXXXXXXXXXXXXXXXXXGYKNWILWISFAIXXXXXXXXXXGFIMWTCQKGNIKCNICI

SEQ ID NO: 419409 - protein, 580 aa, Influenza virus
  MOD_RES (1)..(10): Any amino acid
  MOD_RES (22)..(35): Any amino acid
  MOD_RES (48)..(57): Any amino acid
  MOD_RES (68)..(94): Any amino acid
  MOD_RES (105)..(135): Any amino acid
  MOD_RES (147)..(200): Any amino acid
  MOD_RES (212)..(307): Any amino acid
  MOD_RES (324)..(344): Any amino acid
  MOD_RES (355)..(373): Any amino acid
  MOD_RES (387)..(387): Any amino acid
  MOD_RES (407)..(414): Any amino acid
  MOD_RES (425)..(447): Any amino acid
  MOD_RES (458)..(459): Any amino acid
  MOD_RES (480)..(482): Any amino acid
  MOD_RES (493)..(494): Any amino acid
  MOD_RES (506)..(539): Any amino acid
  MOD_RES (557)..(562): Any amino acid
  MOD_RES (578)..(580): Any amino acid
XXXXXXXXXXIFIFLLLTHWAXXXXXXXXXXXXXXTAMLCLGHHAVPXXXXXXXXXXDNIEVTNATEXXXXXXXXXXXXXXXXXXXXXXXXXXXDSLLGDPHCDXXXXXXXXXXXXXXXXXXXXXXXXXXXXXXXRSIVASSGTVEXXXXXXXXXXXXXXXXXXXXXXXXXXXXXXXXXXXXXXXXXXXXXXXXXXXXXXFDKLYVWGIHHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKCITPNGSIPNGKPFQXXXXXXXXXXXXXXXXXXXXXATGMRNIPERXXXXXXXXXXXXXXXXXXXMVDGWYGFRYQNSXSEGTGQAGDLKSTQAAITQXXXXXXXXVEKTNEKFHQXXXXXXXXXXXXXXXXXXXXXXXIDLWSYNADVXXAMENQHTIDLTDAEMNKLFEXXXKQLRENAEEMXXGCFRIYHKCDNXXXXXXXXXXXXXXXXXXXXXXXXXXXXXXXXXXGYKDWFLWISFAMSCFLXXXXXXGFVMWACQKGNIKCNXXX

SEQ ID NO: 419410 - protein, 580 aa, Influenza virus
  MOD_RES (1)..(13): Any amino acid
  MOD_RES (24)..(37): Any amino acid
  MOD_RES (51)..(319): Any amino acid
  MOD_RES (330)..(377): Any amino acid
  MOD_RES (389)..(394): Any amino acid
  MOD_RES (406)..(451): Any amino acid
  MOD_RES (467)..(468): Any amino acid
  MOD_RES (479)..(484): Any amino acid
  MOD_RES (498)..(542): Any amino acid
  MOD_RES (555)..(567): Any amino acid
XXXXXXXXXXXXXRFSYVFCLALXXXXXXXXXXXXXXTLCLGHHAVSNGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRPFQNVNKITXXXXXXXXXXXXXXXXXXXXXXXXXXXXXXXXXXXXXXXXXXXXXXXXGRLVRFRHQNSXXXXXXADFKSTQAAINXXXXXXXXXXXXXXXXXXXXXXXXXXXXXXXXXXXXXXXXXXXXXXSYNAEFLVALENQHTXXMTDSEMNKLFXXXXXXLRENAEDMGDGCFXXXXXXXXXXXXXXXXXXXXXXXXXXXXXXXXXXXXXXXXXXXXXDWILWISFAMSCXXXXXXXXXXXXXACQKGNIRCDICI

SEQ ID NO: 419411 - protein, 580 aa, Influenza virus
  MOD_RES (1)..(13): Any amino acid
  MOD_RES (24)..(379): Any amino acid
  MOD_RES (391)..(397): Any amino acid
  MOD_RES (408)..(452): Any amino acid
  MOD_RES (463)..(487): Any amino acid
  MOD_RES (498)..(580): Any amino acid
XXXXXXXXXXXXXVLSCIFCLAFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHQNSEGXXXXXXXKSTQAAIDQVXXXXXXXXXXXXXXXXXXXXXXXXXXXXXXXXXXXXXXXXXXXXXYNAEILVALEXXXXXXXXXXXXXXXXXXXXXXXXXNAEDMGNGCLXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419412 - protein, 580 aa, Influenza virus; identical to SEQ ID NO: 418958
  MOD_RES (1)..(379): Any amino acid
  MOD_RES (391)..(580): Any amino acid

SEQ ID NO: 419413 - protein, 580 aa, Influenza virus; identical to SEQ ID NO: 418960
  MOD_RES (1)..(379): Any amino acid
  MOD_RES (391)..(580): Any amino acid

SEQ ID NO: 419414 - protein, 580 aa, Influenza virus; identical to SEQ ID NO: 418959
  MOD_RES (1)..(379): Any amino acid
  MOD_RES (391)..(580): Any amino acid

SEQ ID NO: 419415 - protein, 574 aa, Influenza virus
  MOD_RES (12)..(23): Any amino acid
  MOD_RES (51)..(51): Any amino acid
  MOD_RES (66)..(82): Any amino acid
  MOD_RES (99)..(127): Any amino acid
  MOD_RES (142)..(194): Any amino acid
  MOD_RES (207)..(251): Any amino acid
  MOD_RES (263)..(267): Any amino acid
  MOD_RES (282)..(285): Any amino acid
  MOD_RES (296)..(300): Any amino acid
  MOD_RES (329)..(329): Any amino acid
  MOD_RES (402)..(408): Any amino acid
  MOD_RES (500)..(500): Any amino acid
  MOD_RES (514)..(514): Any amino acid
  MOD_RES (528)..(533): Any amino acid
  MOD_RES (553)..(555): Any amino acid
HSMSGFRSNLPXXXXXXXXXXXXNNNNNTATLCCLGHHAVPNGTIVKTITXDQIEVTNATELVQSXXXXXXXXXXXXXXXXXKNCTLIDALLGDPQCDXXXXXXXXXXXXXXXXXXXXXXXXXXXXXSLRSLVASSGTLEFXXXXXXXXXXXXXXXXXXXXXXXXXXXXXXXXXXXXXXXXXXXXXXXXXXXXXFDKLYIWGVHHPXXXXXXXXXXXXXXXXXXXXXXXXXXXXXXXXXXXXXXXXXXXXXSIYWTIVKPGDXXXXXSTGNLIAPRGYFKIXXXXLNNEIRWPPHXXXXXSECITPNGSIPNDKPFQNVNRITYGACPXYVKQNTLKLATGMRNVPEKQTRGIFGAIAGFIENGWEGMVDGWYGFRHQNSNSEGTGQAADLKSTQAAINQIXXXXXXXIGKTNEKFHQIEKEFSEVEGRIQDLEKYVEDTKIDLWSYNAELLVALENQHTIDLTDSEMNKLFERTKKQLRENAEDMGNGCFKIYHKCDNXCIGSIRNGTYDHDXYRDEALNNRFQIKXXXXXXGYKDWILWISFAISCFLLCXXXLGFIMWACQKGNIRCNICI

SEQ ID NO: 419416 - protein, 574 aa, Influenza virus
  MOD_RES (1)..(1): Any amino acid
  MOD_RES (12)..(26): Any amino acid
  MOD_RES (51)..(51): Any amino acid
  MOD_RES (66)..(84): Any amino acid
  MOD_RES (99)..(127): Any amino acid
  MOD_RES (142)..(194): Any amino acid
  MOD_RES (207)..(251): Any amino acid
  MOD_RES (263)..(267): Any amino acid
  MOD_RES (282)..(300): Any amino acid
  MOD_RES (329)..(329): Any amino acid
  MOD_RES (379)..(380): Any amino acid
  MOD_RES (402)..(408): Any amino acid
  MOD_RES (500)..(500): Any amino acid
  MOD_RES (514)..(514): Any amino acid
  MOD_RES (528)..(533): Any amino acid
  MOD_RES (549)..(555): Any amino acid
XMKTIIIVLSCXXXXXXXXXXXXXXXNNSTATLCLGHHAVPNGTLVKTITXDHIEVTNATELVQNXXXXXXXXXXXXXXXXXXXCTLMDALLGDPHCDXXXXXXXXXXXXXXXXXXXXXXXXXXXXXSLRSLIASSGTLEFXXXXXXXXXXXXXXXXXXXXXXXXXXXXXXXXXXXXXXXXXXXXXXXXXXXXXFDKLYVWGVHHPXXXXXXXXXXXXXXXXXXXXXXXXXXXXXXXXXXXXXXXXXXXXXSVYWTVVKPGDXXXXXSNGNLIAPRGYYKMXXXXXXXXXXXXXXXXXXXSACITPNGSIPNEKPFQNVNKITYGACPXYVKQSTLKLATGMRNIPEKQTRGLFGAIAGFIENGWEGMMDGWYGFRHQXXNSEGIGQAADLKSTQAAVNQIXXXXXXXIEKTNEKFHQIEKEFTEVEGRIQDLERYVEDTKIDLWSYNAGLLVALENQNTIDLTDSEMSKLFERTRKQLRENAEDLGNGCFKIYHKCNNXCIESIRNGTYDHNXYRDEAVNNRFQIKXXXXXXGYKDWVLWISFAISCXXXXXXXLGFIMWACQRGNIRCNICI

SEQ ID NO: 419417 - protein, 574 aa, Influenza virus
  MOD_RES (1)..(29): Any amino acid
  MOD_RES (51)..(51): Any amino acid
  MOD_RES (66)..(84): Any amino acid
  MOD_RES (98)..(127): Any amino acid
  MOD_RES (142)..(194): Any amino acid
  MOD_RES (205)..(251): Any amino acid
  MOD_RES (263)..(267): Any amino acid
  MOD_RES (282)..(300): Any amino acid
  MOD_RES (322)..(329): Any amino acid
  MOD_RES (358)..(359): Any amino acid
  MOD_RES (379)..(380): Any amino acid
  MOD_RES (402)..(408): Any amino acid
  MOD_RES (420)..(428): Any amino acid
  MOD_RES (474)..(474): Any amino acid
  MOD_RES (500)..(500): Any amino acid
  MOD_RES (514)..(514): Any amino acid
  MOD_RES (526)..(533): Any amino acid
  MOD_RES (553)..(555): Any amino acid
XXXXXXXXXXXXXXXXXXXXXXXXXXXXXMATLCLGHHAVPNGTVVKTITXDQVEVTNATELVQIXXXXXXXXXXXXXXXXXXXCTLVDALLGDPHCXXXXXXXXXXXXXXXXXXXXXXXXXXXXXXSLRSIVASSGTLEFXXXXXXXXXXXXXXXXXXXXXXXXXXXXXXXXXXXXXXXXXXXXXXXXXXXXXSDKLYIWGVHXXXXXXXXXXXXXXXXXXXXXXXXXXXXXXXXXXXXXXXXXXXXXXXSIHWTIVKPGDXXXXXCTGNLIAPRGYFRIXXXXXXXXXXXXXXXXXXXSGCITPNGSIPNNKPFQNVNKXXXXXXXXYIKQNTLKLATGMRNVPETQTRGIFGAIXXFIENGWEGMIDGWYGFRHQXXNSEGRGQAADLKSTQAAIDQIXXXXXXXIKKTNEKFHQIXXXXXXXXXRIQDLEKYIEDTKVDLWSYNAELLIALENQHTIHLTDSEMNKLFDXTRRQLRENAEDMGNGCLKIYHKCDNXCIGSIRNETYDHDXYRNEALNNRFQXXXXXXXXEYKDWILWISFATSCFLLCXXXLGFIMWTCQKGNIKCNICI

SEQ ID NO: 419418 - protein, 574 aa, Influenza virus
  MOD_RES (1)..(29): Any amino acid
  MOD_RES (51)..(51): Any amino acid
  MOD_RES (62)..(86): Any amino acid
  MOD_RES (98)..(127): Any amino acid
  MOD_RES (142)..(194): Any amino acid
  MOD_RES (207)..(251): Any amino acid
  MOD_RES (263)..(271): Any amino acid
  MOD_RES (282)..(300): Any amino acid
  MOD_RES (322)..(329): Any amino acid
  MOD_RES (358)..(360): Any amino acid
  MOD_RES (380)..(381): Any amino acid
  MOD_RES (401)..(408): Any amino acid
  MOD_RES (419)..(432): Any amino acid
  MOD_RES (476)..(476): Any amino acid
  MOD_RES (494)..(500): Any amino acid
  MOD_RES (512)..(514): Any amino acid
  MOD_RES (528)..(533): Any amino acid
  MOD_RES (553)..(555): Any amino acid
  MOD_RES (570)..(574): Any amino acid
XXXXXXXXXXXXXXXXXXXXXXXXXXXXXAATLCLGHHAVPNGTIVRTITXDNIEVTNATEXXXXXXXXXXXXXXXXXXXXXXXXXLIDALLGDPHCXXXXXXXXXXXXXXXXXXXXXXXXXXXXXXTLRSLVASSGNLEFXXXXXXXXXXXXXXXXXXXXXXXXXXXXXXXXXXXXXXXXXXXXXXXXXXXXXFDKLYIWGIHHPXXXXXXXXXXXXXXXXXXXXXXXXXXXXXXXXXXXXXXXXXXXXXSVYWTIVKPGDXXXXXXXXXLIAPRGYFKMXXXXXXXXXXXXXXXXXXXFECITPNGSISNDKPFQNVNKXXXXXXXXYVKQKTLKLATGMRNVPERQTRGIFGAIXXXIENGWEGMVNGWYGFRHQNXXSEGMGQAADLKSTQAAITQXXXXXXXXVEKTNEKFHQXXXXXXXXXXXXXXLEKYVEDTKVDLWSYNAEFLVALENQHTIHMTDSEMNKLFEKTXKQLRENAEEMGNGCFKIXXXXXXXCMESIRNGTYDXXXYRDEALNNRSQIKXXXXXXGYKDWFLWISFAMSCFLLCXXXLGFIVWACQRGNIRXXXXX

SEQ ID NO: 419419 - protein, 574 aa, Influenza virus
  MOD_RES (1)..(29): Any amino acid
  MOD_RES (51)..(86): Any amino acid
  MOD_RES (98)..(194): Any amino acid
  MOD_RES (205)..(251): Any amino acid
  MOD_RES (263)..(271): Any amino acid
  MOD_RES (282)..(300): Any amino acid
  MOD_RES (329)..(329): Any amino acid
  MOD_RES (358)..(368): Any amino acid
  MOD_RES (381)..(389): Any amino acid
  MOD_RES (401)..(445): Any amino acid
  MOD_RES (471)..(482): Any amino acid
  MOD_RES (500)..(501): Any amino acid
  MOD_RES (514)..(515): Any amino acid
  MOD_RES (528)..(534): Any amino acid
  MOD_RES (547)..(555): Any amino acid
  MOD_RES (572)..(574): Any amino acid
XXXXXXXXXXXXXXXXXXXXXXXXXXXXXTAMLCLGHHAVPNGTMVKTITXXXXXXXXXXXXXXXXXXXXXXXXXXXXXXXXXXXXLIDSLLGDPHCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNKLYIWGVHXXXXXXXXXXXXXXXXXXXXXXXXXXXXXXXXXXXXXXXXXXXXXXXSIYWTVVKPGDXXXXXXXXXLIAPRGYFKVXXXXXXXXXXXXXXXXXXXSKCITPNGSIPNGKPFQNVNRITYGPCPXYVRQNTLKLATGMRNIPERQTRGLFGAIXXXXXXXXXXXVDGWYGFRHHNSXXXXXXXXXDFKSTQAAINQXXXXXXXXXXXXXXXXXXXXXXXXXXXXXXXXXXXXXXXXXXXXXSYNAEILVALENQHTIDLADSEMNKXXXXXXXXXXXXAEDMGNGCFTIYHKCDNXXIGSIRNGTYNHDXXRDEALSNRFQIKXXXXXXXYKNWILWISFAIXXXXXXXXXLGFVMWACQKGNIKCNXXX

SEQ ID NO: 419420 - protein, 574 aa, Influenza virus
  MOD_RES (1)..(316): Any amino acid
  MOD_RES (329)..(370): Any amino acid
  MOD_RES (381)..(391): Any amino acid
  MOD_RES (402)..(446): Any amino acid
  MOD_RES (464)..(464): Any amino acid
  MOD_RES (476)..(482): Any amino acid
  MOD_RES (499)..(536): Any amino acid
  MOD_RES (549)..(561): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQNVNRITYGVCPXXXXXXXXXXXXXXXXXXXXXXXXXXXXXXXXXXXXXXXXXXGWYGFRHLNSXXXXXXXXXXXKSTQAAIDQVXXXXXXXXXXXXXXXXXXXXXXXXXXXXXXXXXXXXXXXXXXXXXYNAELLVAMENQHTIDLXDSEMSKLFEKTXXXXXXXAEDMGNGCFRIYHKCDXXXXXXXXXXXXXXXXXXXXXXXXXXXXXXXXXXXXXXDWILWISFAMSCXXXXXXXXXXXXXACQKGNIRCDICI

SEQ ID NO: 419421 - protein, 574 aa, Influenza virus
  MOD_RES (1)..(316): Any amino acid
  MOD_RES (329)..(371): Any amino acid
  MOD_RES (388)..(461): Any amino acid
  MOD_RES (472)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQNINRITYGACPXXXXXXXXXXXXXXXXXXXXXXXXXXXXXXXXXXXXXXXXXXXGRLVRFRHQNSEGTGQXXXXXXXXXXXXXXXXXXXXXXXXXXXXXXXXXXXXXXXXXXXXXXXXXXXXXXXXXXXXXXXXXXXXXXXXXXDMTDSEMNKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419422 - protein, 574 aa, Influenza virus
  MOD_RES (1)..(373): Any amino acid
  MOD_RES (388)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHQNSEGIGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419423 - protein, 574 aa, Influenza virus
  MOD_RES (1)..(373): Any amino acid
  MOD_RES (388)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHHNSEGTGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419424 - protein, 574 aa, Influenza virus
  MOD_RES (1)..(373): Any amino acid
  MOD_RES (385)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHLNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419425 - protein, 574 aa, Influenza virus
  MOD_RES (1)..(377): Any amino acid
  MOD_RES (388)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRHQNSEGRGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419426 - protein, 574 aa, Influenza virus; identical to SEQ ID NO: 418969
  MOD_RES (1)..(377): Any amino acid
  MOD_RES (388)..(574): Any amino acid

SEQ ID NO: 419427 - protein, 486 aa, Influenza virus
  MOD_RES (16)..(79): Any amino acid
  MOD_RES (91)..(101): Any amino acid
  MOD_RES (134)..(134): Any amino acid
  MOD_RES (151)..(159): Any amino acid
  MOD_RES (205)..(207): Any amino acid
  MOD_RES (218)..(228): Any amino acid
  MOD_RES (257)..(263): Any amino acid
  MOD_RES (276)..(278): Any amino acid
  MOD_RES (318)..(324): Any amino acid
  MOD_RES (340)..(357): Any amino acid
  MOD_RES (378)..(381): Any amino acid
  MOD_RES (392)..(413): Any amino acid
  MOD_RES (442)..(445): Any amino acid
AKAGVKMNPNQKIITXXXXXXXXXXXXXXXXXXXXXXXXXXXXXXXXXXXXXXXXXXXXXXXXXXXXXXXXXXXXXXXXEKEKEICSVVLXXXXXXXXXXXITGFAPFSKDNSIRLSAGGDIWVTREPYVSCDXDKCYQFALGQGTTLNNXXXXXXXXXRTPYRTLLMNELGVPFHLGTKQVCIAWSSSSCHDGKAWLHVCVTGXXXNATASFIYNGXXXXXXXXXXXEILRTQESECVCINGTCTVVMTDGSASGXXXXXXXEYYFVKEGKIVHXXXLSGSAQHVEECSCYPRYPGVRCVCRDNWKGSNRPIVDINXXXXXXXSSYVCSGLVGDTPRKXXXXXXXXXXXXXXXXXXHGVKGWAFDDGNDVWMGRTIXXXXRSGYETFKVIXXXXXXXXXXXXXXXXXXXXXXRSGYSGIFSVEGKSCINRCFYVELIRGRXXXXEVLWTSNSIVVFCGTSGTYGTGSWPDGADINLHAYISFRNL

SEQ ID NO: 419428 - protein, 486 aa, Influenza virus
  MOD_RES (1)..(101): Any amino acid
  MOD_RES (131)..(134): Any amino acid
  MOD_RES (151)..(159): Any amino acid
  MOD_RES (190)..(190): Any amino acid
  MOD_RES (202)..(207): Any amino acid
  MOD_RES (218)..(228): Any amino acid
  MOD_RES (257)..(278): Any amino acid
  MOD_RES (318)..(324): Any amino acid
  MOD_RES (340)..(357): Any amino acid
  MOD_RES (378)..(381): Any amino acid
  MOD_RES (392)..(413): Any amino acid
  MOD_RES (442)..(445): Any amino acid
  MOD_RES (483)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAGFAPFSKDNSIRLAAGGDIWVTRVPYVXXXXGKCYQFALGQGTTLDNXXXXXXXXXRIPHRTLLMNELGIPFHLGTRQVCIAWSSSXCHDGRAWLHVCXXXXXXNATASFIYDGXXXXXXXXXXXKILRTQESECICINGTCTVVMTDGNASGXXXXXXXXXXXXXXXXXXXXXXLSGSAQHIEECSCYPRYSGVRCICRDNWKGSNRPVVDINXXXXXXXSRYVCSGLVGDTPRNXXXXXXXXXXXXXXXXXXPGVKGWAFDNGDDVWMGRTIXXXXRLGYETFKVIXXXXXXXXXXXXXXXXXXXXXXWSGYSGIFSVESKSCVNRCFYVELIRGSXXXXEVWWTSNSIVVFCGTSGTYGSGSWPDGADINLMPIYSXXXX

SEQ ID NO: 419429 - protein, 486 aa, Influenza virus
  MOD_RES (1)..(111): Any amino acid
  MOD_RES (134)..(134): Any amino acid
  MOD_RES (151)..(159): Any amino acid
  MOD_RES (205)..(207): Any amino acid
  MOD_RES (218)..(228): Any amino acid
  MOD_RES (257)..(278): Any amino acid
  MOD_RES (318)..(324): Any amino acid
  MOD_RES (338)..(357): Any amino acid
  MOD_RES (378)..(381): Any amino acid
  MOD_RES (392)..(413): Any amino acid
  MOD_RES (437)..(445): Any amino acid
  MOD_RES (462)..(464): Any amino acid
  MOD_RES (475)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSIRLSAGGAIWVTREPYVSCSXSKCYQFALGQGTTLSNXXXXXXXXXRTPHRTLLMNELGVPFHLGTRQVCMAWSSSSCHDGKAWLHVCITGXXXNATASFIYGGXXXXXXXXXXXNILRTQESECVCINGTCAVVMTDGSASEXXXXXXXXXXXXXXXXXXXXXXLLGSAQHVEECSCYPRFPGIRCVCRDNWKGSNRPVIDINXXXXXXXSSYMCSGLVGDTPXXXXXXXXXXXXXXXXXXXXQGVKGWAFDNENDVWMGRTIXXXXRSGYETFRVIXXXXXXXXXXXXXXXXXXXXXXMSGYSGIFSVENKNCINRCFYVEXXXXXXXXXRVWWTSNSIVAFCGTSXXXGTGSWPDGANXXXXXXXXXXXX

SEQ ID NO: 419430 - protein, 486 aa, Influenza virus
  MOD_RES (1)..(112): Any amino acid
  MOD_RES (134)..(134): Any amino acid
  MOD_RES (145)..(165): Any amino acid
  MOD_RES (186)..(207): Any amino acid
  MOD_RES (218)..(228): Any amino acid
  MOD_RES (257)..(278): Any amino acid
  MOD_RES (317)..(324): Any amino acid
  MOD_RES (338)..(357): Any amino acid
  MOD_RES (378)..(381): Any amino acid
  MOD_RES (392)..(413): Any amino acid
  MOD_RES (427)..(445): Any amino acid
  MOD_RES (456)..(464): Any amino acid
  MOD_RES (475)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIRLAAGGAIWVTRELYVSCDXNKCYQFALGQXXXXXXXXXXXXXXXXXXXXXLLMSELGVPFHLGTKQVCMAXXXXXXXXXXXXXXXXXXXXXXNATASFVYDGXXXXXXXXXXXDILRTQESECVCISGTCAVVMTDGSASDXXXXXXXXXXXXXXXXXXXXXXLSGNAQHVEECSCYPRYPNVRCVCRDNWRGSNRPIVDIXXXXXXXXSSYLCSGLVGDTPXXXXXXXXXXXXXXXXXXXXPGVKGWAFDDGNDIWMGRTIXXXXRLGYETFKVVXXXXXXXXXXXXXXXXXXXXXXRSGYSGVFSVEGKXXXXXXXXXXXXXXXXXXXKVWWTSNSIVXXXXXXXXXGTGSWPDGAEXXXXXXXXXXXX

SEQ ID NO: 419431 - protein, 486 aa, Influenza virus
  MOD_RES (1)..(118): Any amino acid
  MOD_RES (131)..(134): Any amino acid
  MOD_RES (145)..(170): Any amino acid
  MOD_RES (183)..(238): Any amino acid
  MOD_RES (252)..(278): Any amino acid
  MOD_RES (298)..(304): Any amino acid
  MOD_RES (318)..(357): Any amino acid
  MOD_RES (378)..(445): Any amino acid
  MOD_RES (456)..(471): Any amino acid
  MOD_RES (484)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGDIWVTRELYVXXXXDRCYQFALGQXXXXXXXXXXXXXXXXXXXXXXXXXXLGVPFYLGTKQVXXXXXXXXXXXXXXXXXXXXXXXXXXXXXXXXXXXXXXXXXXXXXXXXXXXXXXXXVCINGTCTVIMTDXXXXXXXXXXXXXXXXXXXXXXXXXXXLSGGAQHVEECSCYPRYPDXXXXXXXNWKGSNRPIIDINXXXXXXXXXXXXXXXXXXXXXXXXXXXXXXXXXXXXXXXXPGVKGWAFDYGNDLWMGRTIXXXXXXXXXXXXXXXXXXXXXXXXXXXXXXXXXXXXXXXXXXXXXXXXXXXXXXXXXXXXXXXXXXXXDVLWTSNSIVXXXXXXXXXXXXXXXXGADIKSHAYISFXXX

SEQ ID NO: 419432 - protein, 486 aa, Influenza virus
  MOD_RES (1)..(123): Any amino acid
  MOD_RES (134)..(239): Any amino acid
  MOD_RES (250)..(307): Any amino acid
  MOD_RES (318)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTREPYVSCGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCINGICTVVMXXXXXXXXXXXXXXXXXXXXXXXXXXXXXXXXXXXXXXXXXXXXXXXXXXXXXXXXXXGSNRPVVDIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419433 - protein, 486 aa, Influenza virus
  MOD_RES (1)..(240): Any amino acid
  MOD_RES (251)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIDGTCTVVMTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419434 - protein, 571 aa, Influenza virus
  MOD_RES (1)..(18): Any amino acid
  MOD_RES (33)..(34): Any amino acid
  MOD_RES (45)..(46): Any amino acid
  MOD_RES (59)..(63): Any amino acid
  MOD_RES (74)..(76): Any amino acid
  MOD_RES (93)..(107): Any amino acid
  MOD_RES (139)..(141): Any amino acid
  MOD_RES (157)..(157): Any amino acid
  MOD_RES (168)..(174): Any amino acid
  MOD_RES (206)..(207): Any amino acid
  MOD_RES (222)..(233): Any amino acid
  MOD_RES (275)..(288): Any amino acid
  MOD_RES (299)..(317): Any amino acid
  MOD_RES (342)..(343): Any amino acid
  MOD_RES (505)..(505): Any amino acid
  MOD_RES (545)..(549): Any amino acid
XXXXXXXXXXXXXXXXXXYTGNPVICLGHHAVXXNGTMVKTLTDXXIEVVTAQELVESXXXXXLCPSPLRLVDXXXCDIVNGALGSPGCDHLXXXXXXXXXXXXXXXDTCYPFDVPDYQSLRSILANNGKFEFIAEEFXXXTVKQNGKSGACKRANXNDFFNRLNWLXXXXXXXYPLQNLTKVNNGDYARLYIWGVHHPSTDTEQXXLYKNNPGRVTVSTKXXXXXXXXXXXXRPWVRGQSGRISFYWTIVEPGDLIVFNTIGNLIAPRGHYKLXXXXXXXXXXXXXXIGSCVSKCHTXXXXXXXXXXXXXXXXXXXGDCPKYVKQGSLKLATGMRNIPEKXXRGLFGAIAGFIENGWQGLIDGWYGFRHQNAEGTGTAADLKSTQAAIDQINGKLNRLIEKTNEKYHQIEKEFEQVEGRIQDLEKYVEDTKIDLWSYNAELLVALENQHTIDVTDSEMNKLFERVRRQLRENAEDKGNGCFEIFHQCDNNCIESIRNGTYDHDXYRDEAINNRFQIQGVKLTQGYKDIILWISFSISCFLLVAXXXXXALLLAFILWACQNGNIRCQICI

SEQ ID NO: 419435 - protein, 571 aa, Influenza virus
  MOD_RES (1)..(18): Any amino acid
  MOD_RES (33)..(34): Any amino acid
  MOD_RES (45)..(46): Any amino acid
  MOD_RES (59)..(63): Any amino acid
  MOD_RES (74)..(76): Any amino acid
  MOD_RES (93)..(107): Any amino acid
  MOD_RES (139)..(141): Any amino acid
  MOD_RES (157)..(157): Any amino acid
  MOD_RES (168)..(174): Any amino acid
  MOD_RES (206)..(207): Any amino acid
  MOD_RES (222)..(233): Any amino acid
  MOD_RES (275)..(288): Any amino acid
  MOD_RES (299)..(317): Any amino acid
  MOD_RES (342)..(343): Any amino acid
  MOD_RES (354)..(363): Any amino acid
  MOD_RES (436)..(444): Any amino acid
  MOD_RES (505)..(505): Any amino acid
  MOD_RES (545)..(549): Any amino acid
XXXXXXXXXXXXXXXXXXYTGNPVICMGHHAVXXNGTMVKTLADXXVEVVTAQELVEAXXXXXLCPSPLRLIDXXXCDIINGALGSPGCDRLXXXXXXXXXXXXXXXDTCYPFDVPEYQSLRSILANNGRFEFIAEEFXXXTVKQNGKSSACKRANXNDFFRRLNWLXXXXXXXYPLQNLTKINNGDYTRLYIWGVHHPSTDKEQXXLYKNSPGRVTVSTKXXXXXXXXXXXXRPLVRGQSGRVSFYWTIVEPEDLIVFNTIGNLVAPRGHYKLXXXXXXXXXXXXXXIGSCASKCHTXXXXXXXXXXXXXXXXXXXGDCPKYIKQGSLKLATGMRNIPERXXKGLFGAIAGFXXXXXXXXXXGWYGFRHQNSEGTGTAADLKSTQTAIDQINGKLNRLIERTNEKYHQIEKEFGQVEGRIQDLERYVEDTKIDLXXXXXXXXXALENQHTIDMTDSEMNKLFERIRHQLRENAEDKGNGCFEIFHKCDNSCIESIRNGTYNHDXYRDEAISNRFQIQGVRLTQGYKDIILWVSFSISCFLLAAXXXXXALLIAFVLWACQNGNLRCQICI

SEQ ID NO: 419436 - protein, 571 aa, Influenza virus
  MOD_RES (1)..(18): Any amino acid
  MOD_RES (33)..(34): Any amino acid
  MOD_RES (45)..(46): Any amino acid
  MOD_RES (59)..(63): Any amino acid
  MOD_RES (74)..(76): Any amino acid
  MOD_RES (92)..(107): Any amino acid
  MOD_RES (139)..(141): Any amino acid
  MOD_RES (156)..(157): Any amino acid
  MOD_RES (168)..(174): Any amino acid
  MOD_RES (189)..(193): Any amino acid
  MOD_RES (206)..(207): Any amino acid
  MOD_RES (222)..(233): Any amino acid
  MOD_RES (275)..(288): Any amino acid
  MOD_RES (299)..(317): Any amino acid
  MOD_RES (340)..(381): Any amino acid
  MOD_RES (435)..(447): Any amino acid
  MOD_RES (505)..(505): Any amino acid
XXXXXXXXXXXXXXXXXXYTENPVICLGHHSVXXNGTIVKTLTDXXIEVVAAQELVESXXXXXLCPSPLKLIDXXXCDIVNSALGSPGCDHXXXXXXXXXXXXXXXXDTCYPFDVPGYQSLRSILANNGKFEFIVEKFXXXTVKQDGKSSACKRAXXDDFFNRLNWLXXXXXXXYPLQNLTKTNNGDYXXXXXWGVHHPSTDAEQXXLYKNNPGRVSVSTKXXXXXXXXXXXXRPLVRSQSGRISFYWTIVDPGDIIVFNTIGNLIAPRGHYRLXXXXXXXXXXXXXXIGSCESKCHTXXXXXXXXXXXXXXXXXXXGECPKYVKQGSLRLATGMRNIPXXXXXXXXXXXXXXXXXXXXXXXXXXXXXXXXXXXXXXXXXXLKSTQAAIDKINGKLNRLIEKTNDKYHQIEKEFEQVEGRTQDLEEYVEDTKIDXXXXXXXXXXXXXNQHTIDVADSEMNKLFERVKRQLRENAEDRGNGCFEIFHRCDNKCIESIRNGTYDHNXYRNEAINNRFQIQGIKLTQGYKDVILWISFSISCFLFISCFLLVALLLAFVLWACQNGNVRCQICI

SEQ ID NO: 419437 - protein, 571 aa, Influenza virus
  MOD_RES (1)..(18): Any amino acid
  MOD_RES (29)..(34): Any amino acid
  MOD_RES (45)..(46): Any amino acid
  MOD_RES (57)..(63): Any amino acid
  MOD_RES (74)..(76): Any amino acid
  MOD_RES (92)..(107): Any amino acid
  MOD_RES (139)..(141): Any amino acid
  MOD_RES (157)..(157): Any amino acid
  MOD_RES (168)..(174): Any amino acid
  MOD_RES (195)..(207): Any amino acid
  MOD_RES (222)..(233): Any amino acid
  MOD_RES (268)..(288): Any amino acid
  MOD_RES (299)..(317): Any amino acid
  MOD_RES (332)..(382): Any amino acid
  MOD_RES (402)..(413): Any amino acid
  MOD_RES (443)..(448): Any amino acid
  MOD_RES (471)..(480): Any amino acid
  MOD_RES (505)..(505): Any amino acid
  MOD_RES (545)..(549): Any amino acid
  MOD_RES (568)..(571): Any amino acid
XXXXXXXXXXXXXXXXXXHTGNPVICLGXXXXXXNGTMVKTLTGXXVEVVAAQELVXXXXXXXLCPSPLKLVDXXXCDIVNAALGSPGCDHXXXXXXXXXXXXXXXXDTCYPFDVPNYQSLRSILANNGKLEFIAEEFXXXTIKQNGKSGACKRADXNDFFKRLNWLXXXXXXXYPIQNLTKVNSGDYARLYIWXXXXXXXXXXXXXLYENNPGRVTVSTQXXXXXXXXXXXXGPWVRGQSGRISFYWTIVKPGDLILFNTIGNLIAXXXXXXXXXXXXXXXXXXXXXIGSCVSRCHTXXXXXXXXXXXXXXXXXXXGDCPRYVKQGSLKLXXXXXXXXXXXXXXXXXXXXXXXXXXXXXXXXXXXXXXXXXXXXXXXXXXXKSTQAAIDQVNGKLNRLIEXXXXXXXXXXXXFEQVEGRIQYLEKYVEDTKVDLWSYNAELXXXXXXQHIIDVTDSEMNRLFERVRRQLXXXXXXXXXXCFEIFHQCNNNCIESIRNGTYNHNXYRDEAINSRFQIQGVKLAQGYKDIILWFSFSISCFLLIAXXXXXALLLAFMLWACQNGNIRWXXXX

SEQ ID NO: 419438 - protein, 571 aa, Influenza virus
  MOD_RES (1)..(18): Any amino acid
  MOD_RES (29)..(34): Any amino acid
  MOD_RES (45)..(46): Any amino acid
  MOD_RES (59)..(63): Any amino acid
  MOD_RES (74)..(108): Any amino acid
  MOD_RES (119)..(127): Any amino acid
  MOD_RES (139)..(141): Any amino acid
  MOD_RES (152)..(177): Any amino acid
  MOD_RES (197)..(207): Any amino acid
  MOD_RES (222)..(233): Any amino acid
  MOD_RES (264)..(288): Any amino acid
  MOD_RES (299)..(317): Any amino acid
  MOD_RES (329)..(382): Any amino acid
  MOD_RES (399)..(413): Any amino acid
  MOD_RES (434)..(450): Any amino acid
  MOD_RES (476)..(487): Any amino acid
  MOD_RES (499)..(506): Any amino acid
  MOD_RES (569)..(571): Any amino acid
XXXXXXXXXXXXXXXXXXYPGNPVICLGXXXXXXNGTVVKTLTDXXVEVITAQELVESXXXXXLCPKPLKLVDXXXXXXXXXXXXXXXXXXXXXXXXXXXXXXXXXXXTCYPFDVPDHXXXXXXXXXNGKFEFIAEDFXXXAVKQNGKSGAXXXXXXXXXXXXXXXXXXXXXXXXXXQNLTKVNNGNYARLYIWGVXXXXXXXXXXXLYKSNPGRVTVSTRXXXXXXXXXXXXRPWVRGLSSRISFYWTIVEPGNLIVFNTIGXXXXXXXXXXXXXXXXXXXXXXXXXIGSCISKCHTXXXXXXXXXXXXXXXXXXXGNCPKYVKQGSXXXXXXXXXXXXXXXXXXXXXXXXXXXXXXXXXXXXXXXXXXXXXXXXXXXXXXKSTQAAINQINGKLNRXXXXXXXXXXXXXXXFEQIEGRIQDLENYVEDTKIXXXXXXXXXXXXXXXXXTIDVTDSEMDKLFERVRHQLRENAEXXXXXXXXXXXXCGNNCIESIRNXXXXXXXXRDDAINNRFQIQGVKLIQGYKDIILWISFSMSRQASPSCLVVRKLFLAFILWACQTGNIRCQXXX

SEQ ID NO: 419439 - protein, 571 aa, Influenza virus
  MOD_RES (1)..(24): Any amino acid
  MOD_RES (35)..(113): Any amino acid
  MOD_RES (128)..(236): Any amino acid
  MOD_RES (254)..(254): Any amino acid
  MOD_RES (265)..(384): Any amino acid
  MOD_RES (403)..(414): Any amino acid
  MOD_RES (425)..(450): Any amino acid
  MOD_RES (468)..(488): Any amino acid
  MOD_RES (501)..(535): Any amino acid
  MOD_RES (548)..(549): Any amino acid
  MOD_RES (560)..(571): Any amino acid
XXXXXXXXXXXXXXXXXXXXXXXXWICMGHHAVAXXXXXXXXXXXXXXXXXXXXXXXXXXXXXXXXXXXXXXXXXXXXXXXXXXXXXXXXXXXXXXXXXXXXXXXXXXXXXXXDVPDYQSIRSILANXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKGQSGRISFYWTVVEPXDVIVFNTIGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTQTAIDQITGKLNRLIEKXXXXXXXXXXXXNKIEGRVQDLXXXXXXXXXXXXXXXXXXXXXXXXXXTIDVTDSEMSKLFERVRXXXXXXXXXXXXXXXXXXXXXDNTCIESIRNGTXXXXXXXXXXXXXXXXXXXXXXXXXXXXXXXXXXXVTTRQASPSCLVXXALFLAFILWAXXXXXXXXXXXX

SEQ ID NO: 419440 - protein, 571 aa, Influenza virus
  MOD_RES (1)..(385): Any amino acid
  MOD_RES (401)..(415): Any amino acid
  MOD_RES (426)..(541): Any amino acid
  MOD_RES (564)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQAAIDQISGKLNRLIXXXXXXXXXXXXXXXQVEGRIQNLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSISCFLLVALFLTFILWACQNGXXXXXXXX

SEQ ID NO: 419441 - protein, 571 aa, Influenza virus
  MOD_RES (1)..(541): Any amino acid
  MOD_RES (562)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSISCFLLAALLLTFILWACQXXXXXXXXXX

SEQ ID NO: 419442 - protein, 571 aa, Influenza virus
  MOD_RES (1)..(541): Any amino acid
  MOD_RES (554)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSISCFLLIALLLXXXXXXXXXXXXXXXXXX

SEQ ID NO: 419443 - protein, 571 aa, Influenza virus
  MOD_RES (1)..(543): Any amino acid
  MOD_RES (554)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSCFLLVALLIXXXXXXXXXXXXXXXXXX

SEQ ID NO: 419444 - protein, 608 aa, Influenza virus
  MOD_RES (13)..(18): Any amino acid
  MOD_RES (29)..(35): Any amino acid
  MOD_RES (57)..(72): Any amino acid
  MOD_RES (92)..(93): Any amino acid
  MOD_RES (104)..(138): Any amino acid
  MOD_RES (149)..(163): Any amino acid
  MOD_RES (174)..(222): Any amino acid
  MOD_RES (235)..(266): Any amino acid
  MOD_RES (283)..(302): Any amino acid
  MOD_RES (339)..(352): Any amino acid
  MOD_RES (414)..(415): Any amino acid
  MOD_RES (431)..(456): Any amino acid
  MOD_RES (516)..(516): Any amino acid
  MOD_RES (527)..(552): Any amino acid
  MOD_RES (581)..(581): Any amino acid
ICQMEKIVLLFAXXXXXXSDQICIGYHAXXXXXXXQVDTIMEKNVTVTHAQDILEKXXXXXXXXXXXXXXXXLRDCSVAGWLLGNPMCDEFXXVPEWSYIVEKXXXXXXXXXXXXXXXXXXXXXXXXXXXXXXXXXXXADHPPKVAWSXXXXXXXXXXXXXXXNGRSSFFRNVXXXXXXXXXXXXXXXXXXXXXXXXXXXXXXXXXXXXXXXXXXXXXXXXXYISVGTSTLNQRXXXXXXXXXXXXXXXXXXXXXXXXXXXXXXXXFESNGNFIAPEYAYKIXXXXXXXXXXXXXXXXXXXXPSVKLPMGAIGAIDSSMPFHNIHPLTIGECPKYVKSXXXXXXXXXXXXXXREREGGRRRKRGLFGARGLFGAIAGFIEGGWQGMVDGWYGYHHSNEQGSGYAADKESTQKAXXGVTNKVNSIIDKMNTXXXXXXXXXXXXXXXXXXXXXXXXXXFLDVWTYNAELLVLMENERTLDFHDSNVKNLYDKVRLQLRDNAKELGNGCFEFYHKCDNXCMESVRNGTYXXXXXXXXXXXXXXXXXXXXXXXXXXYQILSIYSTVASSLSTGNHGSLVLSLWMXGLSLWMCSNGSLQCRICIRFVNSDCSK

SEQ ID NO: 419445 - protein, 608 aa, Influenza virus
  MOD_RES (13)..(18): Any amino acid
  MOD_RES (29)..(35): Any amino acid
  MOD_RES (51)..(72): Any amino acid
  MOD_RES (92)..(93): Any amino acid
  MOD_RES (104)..(163): Any amino acid
  MOD_RES (174)..(222): Any amino acid
  MOD_RES (235)..(266): Any amino acid
  MOD_RES (283)..(319): Any amino acid
  MOD_RES (339)..(358): Any amino acid
  MOD_RES (369)..(377): Any amino acid
  MOD_RES (414)..(415): Any amino acid
  MOD_RES (431)..(456): Any amino acid
  MOD_RES (469)..(469): Any amino acid
  MOD_RES (516)..(516): Any amino acid
  MOD_RES (527)..(552): Any amino acid
  MOD_RES (567)..(581): Any amino acid
  MOD_RES (608)..(608): Any amino acid
SVKMEKIVLLLAXXXXXXGDQICIGYHAXXXXXXXQIDTIMEKNVTVTQAXXXXXXXXXXXXXXXXXXXXXXLKDCSVAGWLLGNPLCDEFXXVSEWSYIVEKXXXXXXXXXXXXXXXXXXXXXXXXXXXXXXXXXXXXXXXXXXXXXXXXXXXXXXXXXXXXTGRSSFFRNVXXXXXXXXXXXXXXXXXXXXXXXXXXXXXXXXXXXXXXXXXXXXXXXXXYVSVGTSTLNLRXXXXXXXXXXXXXXXXXXXXXXXXXXXXXXXXFESTGNFIAPEYAYIVXXXXXXXXXXXXXXXXXXXXXXXXXXXXXXXXXXXXXPFHNVHPLTIGKCPKYVKSXXXXXXXXXXXXXXXXXXXXRRKKRGLFGAXXXXXXXXXFIEGGWQGMIDGWYGYHHSKEQGSGYAADQESTQKAXXGITNKVNSIINKMNTXXXXXXXXXXXXXXXXXXXXXXXXXXFLNVWTYNAELLXLMENERTLDLHDSNVKNLYEKVRLQLKDNAKELGNGCFEFYHRCDNXCMESIRNGTYXXXXXXXXXXXXXXXXXXXXXXXXXXYQILSIYSTAASSLXXXXXXXXXXXXXXXGLSFWMCSNGSLQCKICIKICESRLRX

SEQ ID NO: 419446 - protein, 608 aa, Influenza virus
  MOD_RES (1)..(18): Any amino acid
  MOD_RES (29)..(35): Any amino acid
  MOD_RES (57)..(72): Any amino acid
  MOD_RES (92)..(93): Any amino acid
  MOD_RES (104)..(163): Any amino acid
  MOD_RES (174)..(222): Any amino acid
  MOD_RES (235)..(266): Any amino acid
  MOD_RES (283)..(319): Any amino acid
  MOD_RES (336)..(358): Any amino acid
  MOD_RES (369)..(383): Any amino acid
  MOD_RES (414)..(415): Any amino acid
  MOD_RES (431)..(456): Any amino acid
  MOD_RES (468)..(475): Any amino acid
  MOD_RES (503)..(504): Any amino acid
  MOD_RES (516)..(516): Any amino acid
  MOD_RES (527)..(552): Any amino acid
  MOD_RES (576)..(581): Any amino acid
  MOD_RES (596)..(597): Any amino acid
  MOD_RES (608)..(608): Any amino acid
XXXXXXXXXXXXXXXXXXSDHICIGYHAXXXXXXXQVDTIMERNVTVTHAQDLLEKXXXXXXXXXXXXXXXXLKDCSIAGWLLGNPMCDKFXXVPEWSYIVERXXXXXXXXXXXXXXXXXXXXXXXXXXXXXXXXXXXXXXXXXXXXXXXXXXXXXXXXXXXXSGRSSFFRNVXXXXXXXXXXXXXXXXXXXXXXXXXXXXXXXXXXXXXXXXXXXXXXXXXYISIGTSTLNQRXXXXXXXXXXXXXXXXXXXXXXXXXXXXXXXXFDSNGNFIAPENAYKIXXXXXXXXXXXXXXXXXXXXXXXXXXXXXXXXXXXXXPFHNVHPFTIGECPKYXXXXXXXXXXXXXXXXXXXXXXXRRKRGLFGAIXXXXXXXXXXXXXXXQGMVDGWYGFHHSNGQGSGYAADKKSTQKAXXGITNKINSIIDKMNTXXXXXXXXXXXXXXXXXXXXXXXXXXFIDVWTYNAELXXXXXXXXTLDFHDSNVRNLYDKVRHQLRDNAKELXXGCFEFYHKCNNXCMESVKNGTYXXXXXXXXXXXXXXXXXXXXXXXXXXYQILSLYSTVASFPSTGNHGSLVXXXXXXGLFLWMCSNGSYNAXXAFKFVSSDCSX

SEQ ID NO: 419447 - protein, 608 aa, Influenza virus
  MOD_RES (1)..(18): Any amino acid
  MOD_RES (29)..(35): Any amino acid
  MOD_RES (56)..(72): Any amino acid
  MOD_RES (91)..(93): Any amino acid
  MOD_RES (104)..(222): Any amino acid
  MOD_RES (233)..(266): Any amino acid
  MOD_RES (283)..(319): Any amino acid
  MOD_RES (339)..(358): Any amino acid
  MOD_RES (369)..(386): Any amino acid
  MOD_RES (411)..(415): Any amino acid
  MOD_RES (431)..(456): Any amino acid
  MOD_RES (469)..(479): Any amino acid
  MOD_RES (516)..(516): Any amino acid
  MOD_RES (527)..(553): Any amino acid
  MOD_RES (567)..(581): Any amino acid
  MOD_RES (608)..(608): Any amino acid
XXXXXXXXXXXXXXXXXXGDRICIGYHAXXXXXXXQVDTIMEKNITVTHAQDILGXXXXXXXXXXXXXXXXXLKDCSVSGWLLGNPMCDAXXXAPEWSYIVEKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYVSIGTSTLNXXXXXXXXXXXXXXXXXXXXXXXXXXXXXXXXXXFESNGNFITPEYAYKIXXXXXXXXXXXXXXXXXXXXXXXXXXXXXXXXXXXXXPLHNIHPLTIGECPRYVKSXXXXXXXXXXXXXXXXXXXXKRKKRGLFGAXXXXXXXXXXXXXXXXXXVDGWYGYHHNNDQGSGYAADKESSXXXXXGITNRVNSIIGKMNTXXXXXXXXXXXXXXXXXXXXXXXXXXFLGVWTYNAELLXXXXXXXXXXXHDSNVKNLYNKVRLQLKDNARELGNGCFEFYHKCDDXCIESVRNGTYXXXXXXXXXXXXXXXXXXXXXXXXXXXQILSIYSTVVSSLXXXXXXXXXXXXXXXGLLLWMCSNGSLQCRVCIKFVSSDCSX

SEQ ID NO: 419448 - protein, 608 aa, Influenza virus
  MOD_RES (1)..(18): Any amino acid
  MOD_RES (29)..(35): Any amino acid
  MOD_RES (57)..(72): Any amino acid
  MOD_RES (92)..(222): Any amino acid
  MOD_RES (235)..(272): Any amino acid
  MOD_RES (283)..(319): Any amino acid
  MOD_RES (338)..(358): Any amino acid
  MOD_RES (369)..(386): Any amino acid
  MOD_RES (414)..(420): Any amino acid
  MOD_RES (431)..(456): Any amino acid
  MOD_RES (469)..(480): Any amino acid
  MOD_RES (503)..(516): Any amino acid
  MOD_RES (527)..(553): Any amino acid
  MOD_RES (567)..(581): Any amino acid
  MOD_RES (599)..(608): Any amino acid
XXXXXXXXXXXXXXXXXXSDQICVGYHAXXXXXXXRVDTIMEKNVAVTHAQDILERXXXXXXXXXXXXXXXXLGDCSVAGWLLGNPTCDEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHISVGTSTLNQKXXXXXXXXXXXXXXXXXXXXXXXXXXXXXXXXXXXXXXFIAPEYAYKVXXXXXXXXXXXXXXXXXXXXXXXXXXXXXXXXXXXXXPFHNVHPLAIGECPKYVKXXXXXXXXXXXXXXXXXXXXXRRKRRGLFGAXXXXXXXXXXXXXXXXXXVDGWYGYHHINEQGSGYAADRESTQKAXXXXXXXVNSIIDKMNIXXXXXXXXXXXXXXXXXXXXXXXXXXFLDIWTYNAELLXXXXXXXXXXXXDSNVKNLYDRVRLQLRDNARELXXXXXXXXXXXXXXCMDSVRNGTYXXXXXXXXXXXXXXXXXXXXXXXXXXXQILSIYSTVTSSLXXXXXXXXXXXXXXXGLSLWMCFNGSLQCRICXXXXXXXXXX

SEQ ID NO: 419449 - protein, 608 aa, Influenza virus
  MOD_RES (1)..(21): Any amino acid
  MOD_RES (36)..(41): Any amino acid
  MOD_RES (57)..(324): Any amino acid
  MOD_RES (336)..(360): Any amino acid
  MOD_RES (371)..(398): Any amino acid
  MOD_RES (409)..(457): Any amino acid
  MOD_RES (475)..(555): Any amino acid
  MOD_RES (567)..(584): Any amino acid
  MOD_RES (595)..(608): Any amino acid
XXXXXXXXXXXXXXXXXXXXXDQICIGYHANNSTEXXXXXXEKNVTVTHAKDILEKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHPFTIGECPRYXXXXXXXXXXXXXXXXXXXXXXXXXKKKRGLFGAIXXXXXXXXXXXXXXXXXXXXXXXXXXXXQGSGYAADRKXXXXXXXXXXXXXXXXXXXXXXXXXXXXXXXXXXXXXXXXXXXXXXXXXLDVWTYNAEILVLMENEXXXXXXXXXXXXXXXXXXXXXXXXXXXXXXXXXXXXXXXXXXXXXXXXXXXXXXXXXXXXXXXXXXXXXXXXXXXXXXXXXLSVYSTVASSLXXXXXXXXXXXXXXXXXXLWMCSNGALQXXXXXXXXXXXXXX

SEQ ID NO: 419450 - protein, 608 aa, Influenza virus
  MOD_RES (1)..(21): Any amino acid
  MOD_RES (36)..(42): Any amino acid
  MOD_RES (57)..(362): Any amino acid
  MOD_RES (377)..(402): Any amino acid
  MOD_RES (414)..(563): Any amino acid
  MOD_RES (574)..(588): Any amino acid
  MOD_RES (599)..(608): Any amino acid
XXXXXXXXXXXXXXXXXXXXXDHICIGYHANNSTKXXXXXXXKNVTVTHAQNILEKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRRKKRGLFGAIAGXXXXXXXXXXXXXXXXXXXXXXXXXXYAADKESTQRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPSTGNHGSXXXXXXXXXXXXXXXSNGSLQCRIAXXXXXXXXXX

SEQ ID NO: 419451 - protein, 608 aa, Influenza virus
  MOD_RES (1)..(21): Any amino acid
  MOD_RES (36)..(362): Any amino acid
  MOD_RES (376)..(608): Any amino acid
XXXXXXXXXXXXXXXXXXXXXDRICIGYHANNSTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRRQKRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419452 - protein, 608 aa, Influenza virus
  MOD_RES (1)..(21): Any amino acid
  MOD_RES (36)..(366): Any amino acid
  MOD_RES (377)..(608): Any amino acid
XXXXXXXXXXXXXXXXXXXXXDQICVGYHANNSTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419453 - protein, 608 aa, Influenza virus
  MOD_RES (1)..(366): Any amino acid
  MOD_RES (377)..(608): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419454 - protein, 608 aa, Influenza virus
  MOD_RES (1)..(367): Any amino acid
  MOD_RES (378)..(608): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419455 - protein, 599 aa, Influenza virus
  MOD_RES (13)..(18): Any amino acid
  MOD_RES (57)..(66): Any amino acid
  MOD_RES (92)..(92): Any amino acid
  MOD_RES (104)..(115): Any amino acid
  MOD_RES (130)..(135): Any amino acid
  MOD_RES (146)..(217): Any amino acid
  MOD_RES (232)..(260): Any amino acid
  MOD_RES (285)..(298): Any amino acid
  MOD_RES (346)..(348): Any amino acid
  MOD_RES (432)..(432): Any amino acid
  MOD_RES (507)..(507): Any amino acid
  MOD_RES (518)..(541): Any amino acid
  MOD_RES (599)..(599): Any amino acid
ICQMEKIVLLFAXXXXXXSDQICIGYHAHANNSTEQVDTIMEKNVTVTHAQDILEKXXXXXXXXXXGVKPLILRDCSVAGWLLGNPMCDEFXNVPEWSYIVEKXXXXXXXXXXXXFNDYEELKHLLSRIXXXXXXADHPPKVAWSXXXXXXXXXXXXXXXXXXXXXXXXXXXXXXXXXXXXXXXXXXXXXXXXXXXXXXXXXXXXXXXXXXXXXXXXTYISVGTSTLNQRLXXXXXXXXXXXXXXXXXXXXXXXXXXXXXINFESNGNFIAPEYAYKIVKKGDSXXXXXXXXXXXXXXPSVKLPMGAIGAIDSSMPFHNIHPLTIGECPKYVKSNRLVLATGLRNXXXREREGGRRRKRGLFGAIAGGFIEGGWQGMVDGWYGYHHSNEQGSGYAADKESTQKAIDGVTNKVNSIIDKMNTQFEAVGREFNXLERRIENLNKKMEDGFLDVWTYNAELLVLMENERTLDFHDSNVKNLYDKVRLQLRDNAKELGNGCFEFYHKCDNXCMESVRNGTYXXXXXXXXXXXXXXXXXXXXXXXXGTYQILSIYSTVASSLALAIHGSLVLSLWMAGLSLWMCSNGSLQCRICIKFVSSDCSX

SEQ ID NO: 419456 - protein, 599 aa, Influenza virus
  MOD_RES (13)..(18): Any amino acid
  MOD_RES (57)..(66): Any amino acid
  MOD_RES (92)..(92): Any amino acid
  MOD_RES (104)..(115): Any amino acid
  MOD_RES (130)..(217): Any amino acid
  MOD_RES (232)..(260): Any amino acid
  MOD_RES (285)..(300): Any amino acid
  MOD_RES (333)..(335): Any amino acid
  MOD_RES (346)..(355): Any amino acid
  MOD_RES (426)..(432): Any amino acid
  MOD_RES (451)..(466): Any amino acid
  MOD_RES (507)..(507): Any amino acid
  MOD_RES (518)..(541): Any amino acid
  MOD_RES (562)..(571): Any amino acid
SVKMEKIVLLLAXXXXXXSDHICIGYHAHANNSTKQVDTIMEKNITVTHAQDILERXXXXXXXXXXGVKPLILKDCSVAGWLLGNPLCDEFXNVSEWSYIVEKXXXXXXXXXXXXFNNYEELKHLLSSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYISIGTSTLNQRLXXXXXXXXXXXXXXXXXXXXXXXXXXXXXIHFESNGNFIAPENAYKIVKEGDSXXXXXXXXXXXXXXXXCQTPIGAINSINSSMPFHNIHPLTIGKCPKYVXXXKLVLATGLRNXXXXXXXXXXRKKRGLFGAIAAGFIEGGWQGMIDGWYGYHHSKEQGSGYAADQESTQKAIDGITNKVNSIIDKMNTRFEAXXXXXXXLEKRIENLNKKMEDGFLNXXXXXXXXXXXXXXXXTLDFHDSNVRNLYDKVRLQLKDNAKELGNGCFEFYHRCDNXCMESIRNGTYXXXXXXXXXXXXXXXXXXXXXXXXGIYQILSIYSTAASSLALAIXXXXXXXXXXAGLFLWMCSNGSLQCKICIRFVNSDCSK

SEQ ID NO: 419457 - protein, 599 aa, Influenza virus
  MOD_RES (1)..(18): Any amino acid
  MOD_RES (56)..(66): Any amino acid
  MOD_RES (79)..(80): Any amino acid
  MOD_RES (92)..(92): Any amino acid
  MOD_RES (103)..(115): Any amino acid
  MOD_RES (130)..(217): Any amino acid
  MOD_RES (232)..(260): Any amino acid
  MOD_RES (285)..(300): Any amino acid
  MOD_RES (346)..(355): Any amino acid
  MOD_RES (432)..(432): Any amino acid
  MOD_RES (452)..(470): Any amino acid
  MOD_RES (490)..(495): Any amino acid
  MOD_RES (507)..(507): Any amino acid
  MOD_RES (518)..(541): Any amino acid
  MOD_RES (562)..(571): Any amino acid
  MOD_RES (599)..(599): Any amino acid
XXXXXXXXXXXXXXXXXXGDQICIGYHAHANNSTVQVDTIMEKNVTVTHAKDILEXXXXXXXXXXXGVRPLILKDCSVXXWLLGNPMCDKFXDVPEWSYIVEXXXXXXXXXXXXXLNDYEELKHLMSSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYVSVGTSTLNQRSXXXXXXXXXXXXXXXXXXXXXXXXXXXXXISFESNGNFIAPEYAYIVKKGDSAXXXXXXXXXXXXXXXXCQTPMGAINSINSSMPFHNVHPLTIGECPKYVKSDRLILATGLRNXXXXXXXXXXRKRGLFGAIAIAGFIEGGWQGMVDGWYGFHHSNEQGSGYAADRESTQKAINGVTNKVNSIINKMNTQFEAIGREFNXLERRIESLNKKMEDGFLDIXXXXXXXXXXXXXXXXXXXHDSNVKNLYEKVRLQLRDNXXXXXXGCFEFYHKCNNXCMESVKNGTYXXXXXXXXXXXXXXXXXXXXXXXXVTYQILSIYSTVVSSLALAIXXXXXXXXXXAGLSFWMCSNGSLQCRVCIKICESRLRX

SEQ ID NO: 419458 - protein, 599 aa, Influenza virus
  MOD_RES (1)..(18): Any amino acid
  MOD_RES (57)..(66): Any amino acid
  MOD_RES (79)..(92): Any amino acid
  MOD_RES (103)..(115): Any amino acid
  MOD_RES (127)..(217): Any amino acid
  MOD_RES (230)..(260): Any amino acid
  MOD_RES (279)..(300): Any amino acid
  MOD_RES (321)..(325): Any amino acid
  MOD_RES (346)..(357): Any amino acid
  MOD_RES (374)..(377): Any amino acid
  MOD_RES (432)..(432): Any amino acid
  MOD_RES (452)..(471): Any amino acid
  MOD_RES (491)..(496): Any amino acid
  MOD_RES (507)..(507): Any amino acid
  MOD_RES (518)..(541): Any amino acid
  MOD_RES (571)..(571): Any amino acid
  MOD_RES (599)..(599): Any amino acid
XXXXXXXXXXXXXXXXXXSDQICVGYHAHANNSTEHVDTIMEKNVTVTHAQNILEKXXXXXXXXXXGVRPLILRDCSVXXXXXXXXXXXXXXKVPEWSYIVEXXXXXXXXXXXXXFSDYEELKHLMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYVSIGTSTLNQXXXXXXXXXXXXXXXXXXXXXXXXXXXXXXXINFDSNGNFIAPEYAYKVXXXXXXXXXXXXXXXXXXXXXXCQTPVGAINSVNSSMPFHNIXXXXXGECPKYVKSSKLILATGLRNXXXXXXXXXXXXKKRGLFGAIAGFIEGGXXXXVDGWYGYHHNNEQGSGYAADKESSQRAIDGVTNKVNSIIGKMNTQFEAVGKEFNXLERRIENLNRKMEDGFLDVXXXXXXXXXXXXXXXXXXXXDSNVKNLYDRVRLQLRDNAXXXXXXCFEFYHKCDDXCIESVRNGTYXXXXXXXXXXXXXXXXXXXXXXXXGVYQILSIYSTVTSSLSTGNHGSLVLSLWXAGLLLWMCSNGSLQCRIAFKFVSSDCSX

SEQ ID NO: 419459 - protein, 599 aa, Influenza virus
  MOD_RES (1)..(21): Any amino acid
  MOD_RES (53)..(66): Any amino acid
  MOD_RES (78)..(115): Any amino acid
  MOD_RES (127)..(217): Any amino acid
  MOD_RES (232)..(260): Any amino acid
  MOD_RES (285)..(300): Any amino acid
  MOD_RES (336)..(357): Any amino acid
  MOD_RES (368)..(379): Any amino acid
  MOD_RES (430)..(434): Any amino acid
  MOD_RES (447)..(507): Any amino acid
  MOD_RES (518)..(549): Any amino acid
  MOD_RES (562)..(571): Any amino acid
  MOD_RES (590)..(599): Any amino acid
XXXXXXXXXXXXXXXXXXXXXDQICIGYHANNSTEQVDTIMERNVTVTHAQDXXXXXXXXXXXXXXGVKPLILRNCSXXXXXXXXXXXXXXXXXXXXXXXXXXXXXXXXXXXXXXFRDYEELKHLMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTHISVGTSTLNLRLXXXXXXXXXXXXXXXXXXXXXXXXXXXXXVNFESNGNFITPEYAYKIVKTGDSXXXXXXXXXXXXXXXXCQTPLGAINSINSSMPLHNIHPLTIGECPKYVKSTXXXXXXXXXXXXXXXXXXXXXXRKRGLFGAIAXXXXXXXXXXXXGWYGYHHSNGQGSGYAADKESTQRAIDGVTNKINSIIDKMNTQFETVGKEXXXXXRRVENLNKKMEDXXXXXXXXXXXXXXXXXXXXXXXXXXXXXXXXXXXXXXXXXXXXXXXXXXXXXXXXXXXXXCMDSVRNGTYXXXXXXXXXXXXXXXXXXXXXXXXXXXXXXXXYSTVASSLVLAIXXXXXXXXXXAGLSLWMCFNGSLQCRICXXXXXXXXXX

SEQ ID NO: 419460 - protein, 599 aa, Influenza virus
  MOD_RES (1)..(21): Any amino acid
  MOD_RES (37)..(68): Any amino acid
  MOD_RES (82)..(117): Any amino acid
  MOD_RES (130)..(274): Any amino acid
  MOD_RES (285)..(300): Any amino acid
  MOD_RES (311)..(358): Any amino acid
  MOD_RES (369)..(398): Any amino acid
  MOD_RES (415)..(417): Any amino acid
  MOD_RES (432)..(549): Any amino acid
  MOD_RES (562)..(574): Any amino acid
  MOD_RES (587)..(599): Any amino acid
XXXXXXXXXXXXXXXXXXXXXDHICIGYHANNSTKQXXXXXXXXXXXXXXXXXXXXXXXXXXXXXXXXRPLILKDCSIAGWXXXXXXXXXXXXXXXXXXXXXXXXXXXXXXXXXXXXDYEELKHLLNRIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYKIIKKGDSXXXXXXXXXXXXXXXXCQTPMGAVNSXXXXXXXXXXXXXXXXXXXXXXXXXXXXXXXXXXXXXXXXXXXXXXXXTRGLFGAIAGXXXXXXXXXXXXXXXXXXXXXXXXXXXXXXESTQKAMDGVTNKVNSXXXKMNIQFEAVGREFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYSTVASSLTLAIXXXXXXXXXXXXXSLWMCSNGSYNAXXXXXXXXXXXXX

SEQ ID NO: 419461 - protein, 599 aa, Influenza virus
  MOD_RES (1)..(21): Any amino acid
  MOD_RES (46)..(119): Any amino acid
  MOD_RES (130)..(308): Any amino acid
  MOD_RES (320)..(358): Any amino acid
  MOD_RES (369)..(403): Any amino acid
  MOD_RES (418)..(554): Any amino acid
  MOD_RES (567)..(575): Any amino acid
  MOD_RES (586)..(599): Any amino acid
XXXXXXXXXXXXXXXXXXXXXDQICVGYHANNSTERVDTIMEKNVXXXXXXXXXXXXXXXXXXXXXXXXXXXXXXXXXXXXXXXXXXXXXXXXXXXXXXXXXXXXXXXXXXXXXXXXXXEELKHLLSRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAINSSMPFHNXXXXXXXXXXXXXXXXXXXXXXXXXXXXXXXXXXXXXXXRRGLFGAIAGXXXXXXXXXXXXXXXXXXXXXXXXXXXXXXXXXXXAIDGITNKINSIIDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPSTGNHGSLVXXXXXXXXXLWMCSNGALQXXXXXXXXXXXXXX

SEQ ID NO: 419462 - protein, 599 aa, Influenza virus
  MOD_RES (1)..(25): Any amino acid
  MOD_RES (37)..(308): Any amino acid
  MOD_RES (320)..(599): Any amino acid
XXXXXXXXXXXXXXXXXXXXXXXXXIGYHANNSTVQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAVNSSMPFHNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419463 - protein, 599 aa, Influenza virus
  MOD_RES (1)..(26): Any amino acid
  MOD_RES (37)..(308): Any amino acid
  MOD_RES (320)..(599): Any amino acid
XXXXXXXXXXXXXXXXXXXXXXXXXXGYHANNSTEHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAINSSMPLHNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419464 - protein, 599 aa, Influenza virus
  MOD_RES (1)..(308): Any amino acid
  MOD_RES (320)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAISSSMPFHNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419465 - protein, 500 aa, Influenza virus
  MOD_RES (31)..(41): Any amino acid
  MOD_RES (55)..(74): Any amino acid
  MOD_RES (86)..(118): Any amino acid
  MOD_RES (182)..(182): Any amino acid
  MOD_RES (239)..(240): Any amino acid
  MOD_RES (267)..(271): Any amino acid
  MOD_RES (290)..(292): Any amino acid
  MOD_RES (310)..(310): Any amino acid
  MOD_RES (330)..(335): Any amino acid
  MOD_RES (354)..(366): Any amino acid
  MOD_RES (388)..(388): Any amino acid
  MOD_RES (403)..(417): Any amino acid
  MOD_RES (456)..(457): Any amino acid
  MOD_RES (472)..(472): Any amino acid
LVFREQKQEFKMNPNKKIITDITIGSICMVXXXXXXXXXXXNLDLNMGQPFYSHXXXXXXXXXXXXXXXXXXXXYENNTWVNQTYXXXXXXXXXXXXXXXXXXXXXXXXXXXXXXXXXYSKDNSIRIGSKGDVFVIREPFISCSHLECRTFFLTQGALLNDKHSNGTVKDRSPHRTLMSCPXGEAPSPYNSRFESVAWSASACHDGTSWLTIGISGPDNGAVAVLKYNGIITDTIKSWXXNILRTQESECACVNGSCFTVMTDGPSXXXXXYKYKIFKNGKKGKWLNQSXXXAPNYHYEECSCYPDAGEXTCVCRDNWHGSNRPWVSFNXXXXXXIGYICSGVFGDNPRPNDGXXXXXXXXXXXXXGVKGFSFKYGNGVWIGRTKSTXSRSGFEMIWDPNGWXXXXXXXXXXXXXXXITDWSGYSGSFVQHPELTGLDCIRPCFWVELIRGRPKEXXIWTSGSSISFCGVNXIFLWCKIVTTVGWSWPDGAELPFTIDKY

SEQ ID NO: 419466 - protein, 500 aa, Influenza virus
  MOD_RES (1)..(1): Any amino acid
  MOD_RES (31)..(51): Any amino acid
  MOD_RES (62)..(74): Any amino acid
  MOD_RES (86)..(118): Any amino acid
  MOD_RES (182)..(182): Any amino acid
  MOD_RES (239)..(240): Any amino acid
  MOD_RES (267)..(279): Any amino acid
  MOD_RES (290)..(292): Any amino acid
  MOD_RES (310)..(310): Any amino acid
  MOD_RES (330)..(335): Any amino acid
  MOD_RES (354)..(366): Any amino acid
  MOD_RES (388)..(388): Any amino acid
  MOD_RES (403)..(417): Any amino acid
  MOD_RES (456)..(457): Any amino acid
  MOD_RES (472)..(484): Any amino acid
XGLREQKQEFKMNPNQKIITIITIGSICMVXXXXXXXXXXXXXXXXXXXXXGPSHSIHTGNXXXXXXXXXXXXXYENTTWVNQTYXXXXXXXXXXXXXXXXXXXXXXXXXXXXXXXXXHSKDNSIRIGSRGDVFVVREPFISCSHMECRTFFLTQGSLLNDKHSNGTIKDRSPYRTLMSCPXGEAPSPYNSKFESVAWSASACHDGISWLTIGVSGPDNGAVAVVKYNGMITDTIKSWXXNIMRTQESECACINGSCFTIMTDGPSXXXXXXXXXXXXXGKRGKWVKSVXXXAPDYHYEECSCYPNAGEXICVCRDNWHGSNRPWISFNXXXXXXIGYICSGIFGDNPRPSDGXXXXXXXXXXXXXGIKGFSFKYGDGVWIGRTKSPXSRSGFEMVWDPNGWXXXXXXXXXXXXXXXLTDWSGYSGSFIQHPELTGLNCIRPCFWVELVRGRPKEXXVWTSGSSISFCGVSXXXXXXXXXXXXXWSWPDDAELPFTIDKS

SEQ ID NO: 419467 - protein, 500 aa, Influenza virus
  MOD_RES (1)..(1): Any amino acid
  MOD_RES (21)..(74): Any amino acid
  MOD_RES (86)..(118): Any amino acid
  MOD_RES (156)..(156): Any amino acid
  MOD_RES (182)..(182): Any amino acid
  MOD_RES (195)..(197): Any amino acid
  MOD_RES (239)..(240): Any amino acid
  MOD_RES (267)..(292): Any amino acid
  MOD_RES (310)..(310): Any amino acid
  MOD_RES (330)..(335): Any amino acid
  MOD_RES (354)..(366): Any amino acid
  MOD_RES (388)..(388): Any amino acid
  MOD_RES (401)..(417): Any amino acid
  MOD_RES (456)..(457): Any amino acid
  MOD_RES (472)..(485): Any amino acid
  MOD_RES (496)..(500): Any amino acid
XFSGSQKQEFKMNPNQKIMTXXXXXXXXXXXXXXXXXXXXXXXXXXXXXXXXXXXXXXXXXXXXXXXXXXXXXXYKNNTWVNQTYXXXXXXXXXXXXXXXXXXXXXXXXXXXXXXXXXYSKDNGIRIGSKGDVFVTREPFISCSHSECRTFFLTQXALLNDKHSNETVKDRSPHRALMSCPXGEVPSPYNSRFEXXXWSASACHDGSSWLTIGISGPDSGAVAVLKYDGIITDTIRSWXXNTLRTQESECACANGFCFTVMTDGPNXXXXXXXXXXXXXXXXXXXXXXXXXXAPNYYYEECSCYPDSGEXMCVCRDNWHGSNRPWLSFNXXXXXXIGYICSGFFGDNPRPDDGXXXXXXXXXXXXXGVKGFSFRYGNGVWIGRTKSIXSRSGFEIIWDPNXXXXXXXXXXXXXXXXXTTDWSGYSGSFVQHPEMTGLDCMRPCFWVELIRGQPKEXXVWTSGSIISFCGVNXXXXXXXXXXXXXXSWPDGAELPSXXXXX

SEQ ID NO: 419468 - protein, 500 aa, Influenza virus
  MOD_RES (1)..(5): Any amino acid
  MOD_RES (30)..(74): Any amino acid
  MOD_RES (85)..(118): Any amino acid
  MOD_RES (182)..(182): Any amino acid
  MOD_RES (194)..(198): Any amino acid
  MOD_RES (239)..(240): Any amino acid
  MOD_RES (251)..(254): Any amino acid
  MOD_RES (266)..(298): Any amino acid
  MOD_RES (310)..(310): Any amino acid
  MOD_RES (330)..(335): Any amino acid
  MOD_RES (346)..(366): Any amino acid
  MOD_RES (388)..(390): Any amino acid
  MOD_RES (403)..(417): Any amino acid
  MOD_RES (456)..(457): Any amino acid
  MOD_RES (472)..(485): Any amino acid
  MOD_RES (496)..(500): Any amino acid
XXXXXQKQEIKMNPNQKIMRDITIGSICMXXXXXXXXXXXXXXXXXXXXXXXXXXXXXXXXXXXXXXXXXXXXXNQNSTWVSQTXXXXXXXXXXXXXXXXXXXXXXXXXXXXXXXXXXHSKDNNIRIGSKGDVFIIREPFVSCSHLECRTFFLAHGALLNDKHSNGTAKDRSPQRTLMSCPXGVAPSPYNSRFXXXXXSASACHDGTNWLTIGISGPDNEAVAVLKYNGLITDTIKSWXXSILRTQESECXXXXGYCFTVMTDGPXXXXXXXXXXXXXXXXXXXXXXXXXXXXXXXXXEECSCYPDASEXTCVCRDSWHGSNRPWVSFDXXXXXXIGYICSGVLGXXXXXXXXXXXXXXXXXXXXXGVKGFAFKYGNGAWIGRTKSTXXXSGFEMIWDPDGWXXXXXXXXXXXXXXXITEWSGYSGSFVQHPELTGVDCIRPCFWIELIRGRPKEXXIWASGSSISFCGVDXXXXXXXXXXXXXXSWPDRAELPFXXXXX

SEQ ID NO: 419469 - protein, 500 aa, Influenza virus
  MOD_RES (1)..(9): Any amino acid
  MOD_RES (30)..(75): Any amino acid
  MOD_RES (86)..(118): Any amino acid
  MOD_RES (179)..(198): Any amino acid
  MOD_RES (236)..(240): Any amino acid
  MOD_RES (252)..(255): Any amino acid
  MOD_RES (266)..(299): Any amino acid
  MOD_RES (310)..(335): Any amino acid
  MOD_RES (354)..(366): Any amino acid
  MOD_RES (377)..(377): Any amino acid
  MOD_RES (388)..(417): Any amino acid
  MOD_RES (428)..(428): Any amino acid
  MOD_RES (456)..(457): Any amino acid
  MOD_RES (468)..(485): Any amino acid
  MOD_RES (496)..(500): Any amino acid
XXXXXXXXXIKMNPNQKIIEIITIGSICMXXXXXXXXXXXXXXXXXXXXXXXXXXXXXXXXXXXXXXXXXXXXXXENNTWVNQTFXXXXXXXXXXXXXXXXXXXXXXXXXXXXXXXXXHSKDNGIRIGSRGDVFIIREPFISCSQMECRTFFLTHGALLNDKHSNGTVNDRSPHRTLMXXXXXXXXXXXXXXXXXXXXSASACHDGASWLTIGISGPDDGAVAVLKYKGIITDTIXXXXXNVLRTQESECAXXXXSCFTLMTDGPXXXXXXXXXXXXXXXXXXXXXXXXXXXXXXXXXXECSCYPDAGKXXXXXXXXXXXXXXXXXXXXXXXXXXLGYICSGVFGDTPRPNDGXXXXXXXXXXXXXGIKGFSFRYGXGVWIGRTKSAXXXXXXXXXXXXXXXXXXXXXXXXXXXXXXITNWSGYSGSXVQHPELTGLNCMRPCFWVELIRGRPEEXXIWTSGSIISFXXXXXXXXXXXXXXXXXXSWPDGADLPFXXXXX

SEQ ID NO: 419470 - protein, 500 aa, Influenza virus
  MOD_RES (1)..(18): Any amino acid
  MOD_RES (29)..(75): Any amino acid
  MOD_RES (86)..(130): Any amino acid
  MOD_RES (156)..(170): Any amino acid
  MOD_RES (182)..(207): Any amino acid
  MOD_RES (220)..(228): Any amino acid
  MOD_RES (239)..(337): Any amino acid
  MOD_RES (354)..(368): Any amino acid
  MOD_RES (383)..(438): Any amino acid
  MOD_RES (451)..(500): Any amino acid
XXXXXXXXXXXXXXXXXXNRDITIGSICXXXXXXXXXXXXXXXXXXXXXXXXXXXXXXXXXXXXXXXXXXXXXXXENNTWGNQTYXXXXXXXXXXXXXXXXXXXXXXXXXXXXXXXXXXXXXXXXXXXXXGDVFAIREPFISCSYLECRTFFLTHXXXXXXXXXXXXXXXRSPHRSLMSCPXXXXXXXXXXXXXXXXXXXXXXXXXXSWLIIGISGPDNXXXXXXXXXGVITDTIKSWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYICSGVFGDSPRPNDGXXXXXXXXXXXXXXXKGFSYKYGNGVWIGXXXXXXXXXXXXXXXXXXXXXXXXXXXXXXXXXXXXXXXXXXXXXXXXXXXXXXXXCIKPCFWVELIRXXXXXXXXXXXXXXXXXXXXXXXXXXXXXXXXXXXXXXXXXXXXXXXXXX

SEQ ID NO: 419471 - protein, 500 aa, Influenza virus
  MOD_RES (1)..(136): Any amino acid
  MOD_RES (148)..(500): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAPFISCSYLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419472 - protein, 573 aa, Influenza virus
  MOD_RES (1)..(16): Any amino acid
  MOD_RES (47)..(73): Any amino acid
  MOD_RES (84)..(88): Any amino acid
  MOD_RES (102)..(152): Any amino acid
  MOD_RES (171)..(229): Any amino acid
  MOD_RES (240)..(257): Any amino acid
  MOD_RES (274)..(287): Any amino acid
  MOD_RES (299)..(339): Any amino acid
  MOD_RES (380)..(381): Any amino acid
  MOD_RES (401)..(441): Any amino acid
  MOD_RES (478)..(478): Any amino acid
  MOD_RES (497)..(497): Any amino acid
  MOD_RES (511)..(536): Any amino acid
  MOD_RES (549)..(549): Any amino acid
XXXXXXXXXXXXXXXXDQICIGYHANNSTEQVDTIMEKNVTVTHAQXXXXXXXXXXXXXXXXXXXXXXXXXXXAGWLLGNPMCXXXXXVPEWSYIVEKDNPXXXXXXXXXXXXXXXXXXXXXXXXXXXXXXXXXXXXXXXXXXXXXXXXXXXYYNGRSSFFRNVVWLIKKXXXXXXXXXXXXXXXXXXXXXXXXXXXXXXXXXXXXXXXXXXXXXXXXXXXXXXXXXXXIATRPKVNGQXXXXXXXXXXXXXXXXXXFESNGNFIAPEYAYKIXXXXXXXXXXXXXXYGNCDTKCQTPXXXXXXXXXXXXXXXXXXXXXXXXXXXXXXXXXXXXXXXXXRKRKRKTRGLFGALFGAIAGFIEGGWQGMVDGWYGYHHSNXXGSGYAADKESTQKAIDGITXXXXXXXXXXXXXXXXXXXXXXXXXXXXXXXXXXXXXXXXXVWTYNAELLVLMENERTLDFHDSNVKNLYDKVRLQLXDNAKELGNGCFEFYHKCDXECMESVRNGTYDYXXXXXXXXXXXXXXXXXXXXXXXXXXILSIYSTVASSLXLAIMIAGLSFWMCSNGSLQCRICI

SEQ ID NO: 419473 - protein, 573 aa, Influenza virus
  MOD_RES (1)..(16): Any amino acid
  MOD_RES (44)..(73): Any amino acid
  MOD_RES (84)..(88): Any amino acid
  MOD_RES (102)..(152): Any amino acid
  MOD_RES (170)..(229): Any amino acid
  MOD_RES (240)..(257): Any amino acid
  MOD_RES (274)..(287): Any amino acid
  MOD_RES (299)..(344): Any amino acid
  MOD_RES (380)..(381): Any amino acid
  MOD_RES (401)..(441): Any amino acid
  MOD_RES (478)..(478): Any amino acid
  MOD_RES (497)..(497): Any amino acid
  MOD_RES (511)..(536): Any amino acid
  MOD_RES (549)..(549): Any amino acid
XXXXXXXXXXXXXXXXDRICIGYHANNSKKQIDTIMEKNVIFTXXXXXXXXXXXXXXXXXXXXXXXXXXXXXXAGWLIGNPKCXXXXXAPEWSYIVEKNNPXXXXXXXXXXXXXXXXXXXXXXXXXXXXXXXXXXXXXXXXXXXXXXXXXXXYHTGRSSFFRNIVWLIKXXXXXXXXXXXXXXXXXXXXXXXXXXXXXXXXXXXXXXXXXXXXXXXXXXXXXXXXXXXXIATRPQVNGQXXXXXXXXXXXXXXXXXXFESTGNFIAPEYAFKIXXXXXXXXXXXXXXYGNCNTKCQTPXXXXXXXXXXXXXXXXXXXXXXXXXXXXXXXXXXXXXXXXXXXXXXEKRRKKRGLFGAIAGFIEGGWQGLVDGWYGYHHINXXGSGYAADKKSTQKAINGITXXXXXXXXXXXXXXXXXXXXXXXXXXXXXXXXXXXXXXXXXVWTYNTELLVLMENEITLDFHDSNVRNLYDKVRHQLXDNARELGNGCFEFYHRCDXECMESVKNGTYDYXXXXXXXXXXXXXXXXXXXXXXXXXXILSIYSTVVSSLXLAIMVAGLSFWMCSNGSLQCTICI

SEQ ID NO: 419474 - protein, 573 aa, Influenza virus
  MOD_RES (1)..(16): Any amino acid
  MOD_RES (47)..(73): Any amino acid
  MOD_RES (84)..(88): Any amino acid
  MOD_RES (102)..(157): Any amino acid
  MOD_RES (171)..(229): Any amino acid
  MOD_RES (240)..(262): Any amino acid
  MOD_RES (274)..(287): Any amino acid
  MOD_RES (299)..(344): Any amino acid
  MOD_RES (356)..(359): Any amino acid
  MOD_RES (379)..(381): Any amino acid
  MOD_RES (401)..(441): Any amino acid
  MOD_RES (478)..(478): Any amino acid
  MOD_RES (497)..(497): Any amino acid
  MOD_RES (511)..(536): Any amino acid
  MOD_RES (549)..(549): Any amino acid
XXXXXXXXXXXXXXXXDQICIGHHANNSTEQVDTIMERNVTVTHAQXXXXXXXXXXXXXXXXXXXXXXXXXXXAGLVLGNPMCXXXXXTPEWSYIVEKANPXXXXXXXXXXXXXXXXXXXXXXXXXXXXXXXXXXXXXXXXXXXXXXXXXXXXXXXXSSFYRNVVWLIKKXXXXXXXXXXXXXXXXXXXXXXXXXXXXXXXXXXXXXXXXXXXXXXXXXXXXXXXXXXXIATRPRVNGQXXXXXXXXXXXXXXXXXXXXXXXNFIAPEYAYRIXXXXXXXXXXXXXXYGNCNAKCQTPXXXXXXXXXXXXXXXXXXXXXXXXXXXXXXXXXXXXXXXXXXXXXXERRRKKRGLFGXXXXFIEGGWQGMIDGWYGYHHSXXXGSGYAADRKSTQKAIDGVTXXXXXXXXXXXXXXXXXXXXXXXXXXXXXXXXXXXXXXXXXVWTYNAELFVLMENERTLYFHDSNVKNLYNKVRLQLXDNAKEMGNGCFEFYHKCNXKCMESVRNGTYNYXXXXXXXXXXXXXXXXXXXXXXXXXXILSIYSSVASSLXLAIMMAGLSFWMCSNGSLQCRVCI

SEQ ID NO: 419475 - protein, 573 aa, Influenza virus
  MOD_RES (1)..(16): Any amino acid
  MOD_RES (47)..(73): Any amino acid
  MOD_RES (84)..(90): Any amino acid
  MOD_RES (102)..(157): Any amino acid
  MOD_RES (171)..(229): Any amino acid
  MOD_RES (240)..(287): Any amino acid
  MOD_RES (299)..(348): Any amino acid
  MOD_RES (360)..(368): Any amino acid
  MOD_RES (380)..(381): Any amino acid
  MOD_RES (401)..(443): Any amino acid
  MOD_RES (478)..(478): Any amino acid
  MOD_RES (489)..(497): Any amino acid
  MOD_RES (511)..(536): Any amino acid
  MOD_RES (549)..(549): Any amino acid
  MOD_RES (568)..(573): Any amino acid
XXXXXXXXXXXXXXXXDRICVGYHANNSTKQVDTIREKNVTVTHARXXXXXXXXXXXXXXXXXXXXXXXXXXXAGWILGNPMCXXXXXXXEWSYIVEKDSPXXXXXXXXXXXXXXXXXXXXXXXXXXXXXXXXXXXXXXXXXXXXXXXXXXXXXXXXPSFFRNVVWLTKKXXXXXXXXXXXXXXXXXXXXXXXXXXXXXXXXXXXXXXXXXXXXXXXXXXXXXXXXXXXIAIRPKVNGQXXXXXXXXXXXXXXXXXXXXXXXXXXXXXXXXXXXXXXXXXXXXXXXXYGNCDAKCQTPXXXXXXXXXXXXXXXXXXXXXXXXXXXXXXXXXXXXXXXXXXXXXXXXXXETRGLFGAIAGXXXXXXXXXVDGWYGYHHTNXXGGGYAADKESTQRAIDGITXXXXXXXXXXXXXXXXXXXXXXXXXXXXXXXXXXXXXXXXXXXTYNAELLVLIENERTLDLHDSNVKNLYDKVRFQLXNNAKELGNGCXXXXXXXXXVCMESVRNGTYKYXXXXXXXXXXXXXXXXXXXXXXXXXXILTIYSTVASSLXLAIMIAGLFFWMCSNGSLXXXXXX

SEQ ID NO: 419476 - protein, 573 aa, Influenza virus
  MOD_RES (1)..(20): Any amino acid
  MOD_RES (47)..(90): Any amino acid
  MOD_RES (102)..(158): Any amino acid
  MOD_RES (171)..(229): Any amino acid
  MOD_RES (240)..(348): Any amino acid
  MOD_RES (359)..(368): Any amino acid
  MOD_RES (380)..(381): Any amino acid
  MOD_RES (401)..(445): Any amino acid
  MOD_RES (463)..(467): Any amino acid
  MOD_RES (478)..(479): Any amino acid
  MOD_RES (494)..(497): Any amino acid
  MOD_RES (509)..(536): Any amino acid
  MOD_RES (549)..(549): Any amino acid
  MOD_RES (568)..(573): Any amino acid
XXXXXXXXXXXXXXXXXXXXIGYHANNSTKQIDTIMEKIVTVTHAQXXXXXXXXXXXXXXXXXXXXXXXXXXXXXXXXXXXXXXXXXXXXEWSYIVEKDKPXXXXXXXXXXXXXXXXXXXXXXXXXXXXXXXXXXXXXXXXXXXXXXXXXXXXXXXXXSFFRNVVWLVKKXXXXXXXXXXXXXXXXXXXXXXXXXXXXXXXXXXXXXXXXXXXXXXXXXXXXXXXXXXXIATRSKVNGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTRGLFGAIAXXXXXXXXXXVDGWYGYHHNNXXGSGYGEDNESTQKAVDGITXXXXXXXXXXXXXXXXXXXXXXXXXXXXXXXXXXXXXXXXXXXXXNAEFFVLMENERTLDLHXXXXXKLYDRVRLQLXXNAKEWGNGCFEFYHXXXXECIESVRNGTYXXXXXXXXXXXXXXXXXXXXXXXXXXXXILSVYSTVASSLXLAIIIAGLSFWRCSNGSLXXXXXX

SEQ ID NO: 419477 - protein, 573 aa, Influenza virus
  MOD_RES (1)..(30): Any amino acid
  MOD_RES (41)..(348): Any amino acid
  MOD_RES (359)..(382): Any amino acid
  MOD_RES (395)..(446): Any amino acid
  MOD_RES (459)..(481): Any amino acid
  MOD_RES (492)..(500): Any amino acid
  MOD_RES (511)..(553): Any amino acid
  MOD_RES (564)..(573): Any amino acid
XXXXXXXXXXXXXXXXXXXXXXXXXXXXXXQVDTIMEKIVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXETKGLFGAIAXXXXXXXXXXXXXXXXXXXXXXXXSGYAADKASTQKXXXXXXXXXXXXXXXXXXXXXXXXXXXXXXXXXXXXXXXXXXXXXXXXXXXXAELLVLMETERTXXXXXXXXXXXXXXXXXXXXXXXNELGNGCFEFXXXXXXXXXESVKNGTYNYXXXXXXXXXXXXXXXXXXXXXXXXXXXXXXXXXXXXXXXXXXXVAGLSFWRCSXXXXXXXXXX

SEQ ID NO: 419478 - protein, 573 aa, Influenza virus
  MOD_RES (1)..(32): Any amino acid
  MOD_RES (47)..(382): Any amino acid
  MOD_RES (393)..(447): Any amino acid
  MOD_RES (463)..(556): Any amino acid
  MOD_RES (567)..(573): Any amino acid
XXXXXXXXXXXXXXXXXXXXXXXXXXXXXXXXDTTMEKNVTVTHTQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGYAANKESTXXXXXXXXXXXXXXXXXXXXXXXXXXXXXXXXXXXXXXXXXXXXXXXXXXXXXXXELLVLMVNERTLDFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSLCMCSNGSXXXXXXX

SEQ ID NO: 419479 - protein, 573 aa, Influenza virus
  MOD_RES (1)..(33): Any amino acid
  MOD_RES (44)..(383): Any amino acid
  MOD_RES (394)..(452): Any amino acid
  MOD_RES (463)..(557): Any amino acid
  MOD_RES (568)..(573): Any amino acid
XXXXXXXXXXXXXXXXXXXXXXXXXXXXXXXXXTIVEKNVTVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYAEGQESPPXXXXXXXXXXXXXXXXXXXXXXXXXXXXXXXXXXXXXXXXXXXXXXXXXXXXXXXXXXXIENERTLDFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSYWMCSNGSLXXXXXX

SEQ ID NO: 419480 - protein, 573 aa, Influenza virus
  MOD_RES (1)..(33): Any amino acid
  MOD_RES (44)..(385): Any amino acid
  MOD_RES (396)..(558): Any amino acid
  MOD_RES (569)..(573): Any amino acid
XXXXXXXXXXXXXXXXXXXXXXXXXXXXXXXXXTIMEKSVTVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAADKDSTQKAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLWMCSNGSLQXXXXX

SEQ ID NO: 419481 - protein, 471 aa, Influenza virus
  MOD_RES (1)..(88): Any amino acid
  MOD_RES (113)..(113): Any amino acid
  MOD_RES (126)..(127): Any amino acid
  MOD_RES (142)..(142): Any amino acid
  MOD_RES (199)..(216): Any amino acid
  MOD_RES (235)..(236): Any amino acid
  MOD_RES (249)..(269): Any amino acid
  MOD_RES (283)..(283): Any amino acid
  MOD_RES (314)..(315): Any amino acid
  MOD_RES (334)..(334): Any amino acid
  MOD_RES (358)..(368): Any amino acid
  MOD_RES (383)..(403): Any amino acid
  MOD_RES (416)..(417): Any amino acid
  MOD_RES (436)..(436): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCQITGFAPFSKDNSIRLSAGGXIWVTREPYVSCDXXKCYQFALGQGTTLDXKHSNGTIHDRIPHRTLLMNELGVPFHLGTKQVCIAWSSSSCHDGKAWLHVCVTGDDXXXXXXXXXXXXXXXXXXSWSQNILRTQESECVCINXXCTVVMTDGSASGXXXXXXXXXXXXXXXXXXXXXGSAQHIEECSCYPXSYPNVRCVCRDNWKGSNRPVKLDINMADYSXXSSYVCSGLVGDTPRNDDSXSSSNCRDPNNERGNPGVKGWAFDXXXXXXXXXXXSKDSRSGYETFRVIXXXXXXXXXXXXXXXXXXXXXNWSGYSGIFSVEXXSCINRCFYVELIRGRPQEXRVWWTSNSIVVFCGTSGTYGTGSWPDGANINFMPX

SEQ ID NO: 419482 - protein, 471 aa, Influenza virus
  MOD_RES (1)..(88): Any amino acid
  MOD_RES (113)..(113): Any amino acid
  MOD_RES (126)..(127): Any amino acid
  MOD_RES (142)..(142): Any amino acid
  MOD_RES (199)..(216): Any amino acid
  MOD_RES (235)..(236): Any amino acid
  MOD_RES (249)..(269): Any amino acid
  MOD_RES (283)..(283): Any amino acid
  MOD_RES (304)..(315): Any amino acid
  MOD_RES (334)..(334): Any amino acid
  MOD_RES (358)..(368): Any amino acid
  MOD_RES (383)..(403): Any amino acid
  MOD_RES (416)..(417): Any amino acid
  MOD_RES (435)..(436): Any amino acid
  MOD_RES (451)..(455): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCQVTGFAPFSKDNSIQLSAGGXIWITREPYVSCDXXRCYQFALGQGTTLNXNHSNGTIHDRTPHRTLLMSELGVPFHLGTRQVCIAWSSSSCYDGKAWLHICVTGDDXXXXXXXXXXXXXXXXXXSWSKNILRTQESECICINXXCAVVMTDGSASRXXXXXXXXXXXXXXXXXXXXXGSAQHVEECSCYPXSYLNVRCVCRDNWMGSNRPVXXXXXXXXXXXXSSYICSGLVGDTPRNNDSXSNSNCKDPNNERGNSGVKGWAFDXXXXXXXXXXXSKNSRSGYETFKVIXXXXXXXXXXXXXXXXXXXXXNWSGYSGVFSVEXXGCINRCFYVEMIRGRPKXXRVWWTSNSIIVLCGXXXXXGTGSWPDGADINFMPX

SEQ ID NO: 419483 - protein, 471 aa, Influenza virus
  MOD_RES (1)..(88): Any amino acid
  MOD_RES (111)..(115): Any amino acid
  MOD_RES (126)..(131): Any amino acid
  MOD_RES (142)..(142): Any amino acid
  MOD_RES (199)..(216): Any amino acid
  MOD_RES (235)..(236): Any amino acid
  MOD_RES (249)..(269): Any amino acid
  MOD_RES (280)..(287): Any amino acid
  MOD_RES (304)..(315): Any amino acid
  MOD_RES (334)..(334): Any amino acid
  MOD_RES (358)..(368): Any amino acid
  MOD_RES (381)..(403): Any amino acid
  MOD_RES (415)..(417): Any amino acid
  MOD_RES (436)..(436): Any amino acid
  MOD_RES (452)..(458): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCQIAGFAPFSKDNSVRLSAXXXXXVTREPYVSCSXXXXXXFALGQGTPLNXRHSNGTIHDRSSYRTLLMNELGIPFHLGTKQVCMAWSSSSCHDGRAWLHVCITGDDXXXXXXXXXXXXXXXXXXSWSLNILRTQESECVCVNXXCTVIMTDGSASGXXXXXXXXXXXXXXXXXXXXXGNAQHIEECSXXXXXXXXIRCVCRDNWKGSNRPIXXXXXXXXXXXXSRYICSGLVGDTPRNDDGXSNSNCRDPNNESGSQGVKGWAFDXXXXXXXXXXXSRDSRSGYETFKXXXXXXXXXXXXXXXXXXXXXXXNRSGYSGIFSVXXXSCVNRCFYVELIRGRPKEXRVWWTTNSIVVFCGTXXXXXXXSWPDGANINLMPX

SEQ ID NO: 419484 - protein, 471 aa, Influenza virus
  MOD_RES (1)..(88): Any amino acid
  MOD_RES (101)..(115): Any amino acid
  MOD_RES (126)..(143): Any amino acid
  MOD_RES (198)..(216): Any amino acid
  MOD_RES (229)..(236): Any amino acid
  MOD_RES (249)..(270): Any amino acid
  MOD_RES (281)..(287): Any amino acid
  MOD_RES (301)..(315): Any amino acid
  MOD_RES (334)..(334): Any amino acid
  MOD_RES (346)..(346): Any amino acid
  MOD_RES (358)..(368): Any amino acid
  MOD_RES (383)..(404): Any amino acid
  MOD_RES (416)..(417): Any amino acid
  MOD_RES (436)..(437): Any amino acid
  MOD_RES (457)..(460): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCEITGFAPFXXXXXXXXXXXXXXXVTREPYVSCGXXXXXXXXXXXXXXXXXXHSNDTIHDRTSHRTLLMNELGVPFHMGTKQVCVAWSSSSCHDGNAWLHVCVTGHXXXXXXXXXXXXXXXXXXXTWSQNILRTQEPXXXXXXXXCAVVMTDGNASGXXXXXXXXXXXXXXXXXXXXXXSAQATEECSRXXXXXXXVRCICRDNWKGSNXXXXXXXXXXXXXXXSHYVCSGLVGDTPRNDDIXSSSNCKDPNNEXGSPGVKGWAFDXXXXXXXXXXXSEDSRSGYETFRVTXXXXXXXXXXXXXXXXXXXXXXWSGYSGIFSIEXXNCINRCFYVELTRGRPQEXXVWWTSNSIVAFCGTSGTYGXXXXPDGANINFMAX

SEQ ID NO: 419485 - protein, 471 aa, Influenza virus
  MOD_RES (1)..(88): Any amino acid
  MOD_RES (101)..(153): Any amino acid
  MOD_RES (164)..(166): Any amino acid
  MOD_RES (194)..(217): Any amino acid
  MOD_RES (228)..(238): Any amino acid
  MOD_RES (249)..(287): Any amino acid
  MOD_RES (304)..(334): Any amino acid
  MOD_RES (357)..(372): Any amino acid
  MOD_RES (383)..(417): Any amino acid
  MOD_RES (428)..(460): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCKITGFAPFXXXXXXXXXXXXXXXXXXXXXXXXXXXXXXXXXXXXXXXXXXXXXXXXXXXXXPYRTLLMNELXXXFHLGTKQVCVAWSRSSCHDGKAWLHICXXXXXXXXXXXXXXXXXXXXXXXXWSQNILRTHEXXXXXXXXXXXVVITDGSASGXXXXXXXXXXXXXXXXXXXXXXXXXXXXXXXXXXXXXXXVTCVCRDNWKSSNRPVXXXXXXXXXXXXXXXXXXXXXXXXXXXXXXXSSSNCRDSNNERRNPGVKGWAFXXXXXXXXXXXXXXXXRSGYETFRVLXXXXXXXXXXXXXXXXXXXXXXXXXXXXXXXXXXXHCINRCFYVEXXXXXXXXXXXXXXXXXXXXXXXXXXXXXXXXXPDGGNINFMPX

SEQ ID NO: 419486 - protein, 471 aa, Influenza virus
  MOD_RES (1)..(159): Any amino acid
  MOD_RES (170)..(175): Any amino acid
  MOD_RES (194)..(224): Any amino acid
  MOD_RES (235)..(336): Any amino acid
  MOD_RES (347)..(372): Any amino acid
  MOD_RES (383)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMTELGVPFHLXXXXXXIAWSRSSCHDGRAWLHICXXXXXXXXXXXXXXXXXXXXXXXXXXXXXXXTQESECVCISXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSNCRDPNNEKXXXXXXXXXXXXXXXXXXXXXXXXXXRSGYETFRIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419487 - protein, 471 aa, Influenza virus
  MOD_RES (1)..(224): Any amino acid
  MOD_RES (235)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTQESECVCIDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419488 - protein, 570 aa, Influenza virus
  MOD_RES (1)..(14): Any amino acid
  MOD_RES (52)..(73): Any amino acid
  MOD_RES (85)..(157): Any amino acid
  MOD_RES (168)..(189): Any amino acid
  MOD_RES (200)..(247): Any amino acid
  MOD_RES (274)..(277): Any amino acid
  MOD_RES (288)..(306): Any amino acid
  MOD_RES (321)..(329): Any amino acid
  MOD_RES (343)..(344): Any amino acid
  MOD_RES (391)..(413): Any amino acid
  MOD_RES (424)..(431): Any amino acid
  MOD_RES (463)..(471): Any amino acid
  MOD_RES (495)..(498): Any amino acid
  MOD_RES (510)..(527): Any amino acid
  MOD_RES (550)..(554): Any amino acid
XXXXXXXXXXXXXXKSDKICIGYHANNSTTQVDTILEKNVTVTHSVELLENXXXXXXXXXXXXXXXXXXXXXXEGWILGNPQCDXXXXXXXXXXXXXXXXXXXXXXXXXXXXXXXXXXXXXXXXXXXXXXXXXXXXXXXXXXXXXXXXXXXXXXXXXSSFYRNLLWIXXXXXXXXXXXXXXXXXXXXXXILYFWGVHHPXXXXXXXXXXXXXXXXXXXXXXXXXXXXXXXXXXXXXXXXXXXXXXXXWSVLKPGETLNVESNGNLIAPWYAYKXXXXNNNKGAVFKSXXXXXXXXXXXXXXXXXXXTNKTFQNVSPLWIGXXXXXXXXXSLRLATGLRNVPQXXTRGLFGAIAGFIEGGWTGMIDGWYGYHHENSQGSGYAADKESTQKAXXXXXXXXXXXXXXXXXXXXXXXHEFSNLERRIXXXXXXXXDGFLDVWTYNAELLVLLENERTLDLHDANVKXXXXXXXXXLRDNANDLGNGCFEFWHKCDNECXXXXKNGTYDYPKYQXXXXXXXXXXXXXXXXXXGVYQILAIYSTVSSSLVLVGLIXXXXXWMCSNGSMQCRICIGS

SEQ ID NO: 419489 - protein, 570 aa, Influenza virus
  MOD_RES (1)..(14): Any amino acid
  MOD_RES (52)..(73): Any amino acid
  MOD_RES (85)..(157): Any amino acid
  MOD_RES (168)..(189): Any amino acid
  MOD_RES (200)..(247): Any amino acid
  MOD_RES (274)..(306): Any amino acid
  MOD_RES (321)..(329): Any amino acid
  MOD_RES (343)..(344): Any amino acid
  MOD_RES (373)..(374): Any amino acid
  MOD_RES (391)..(413): Any amino acid
  MOD_RES (424)..(431): Any amino acid
  MOD_RES (463)..(471): Any amino acid
  MOD_RES (495)..(498): Any amino acid
  MOD_RES (510)..(527): Any amino acid
  MOD_RES (550)..(554): Any amino acid
  MOD_RES (569)..(570): Any amino acid
XXXXXXXXXXXXXXRSDKICIGYHANNSTTKVDTILERNVTVTHSVELLESXXXXXXXXXXXXXXXXXXXXXXEGWILGNPRCDXXXXXXXXXXXXXXXXXXXXXXXXXXXXXXXXXXXXXXXXXXXXXXXXXXXXXXXXXXXXXXXXXXXXXXXXXPSFYRNLLWIXXXXXXXXXXXXXXXXXXXXXXVLYFWGVHHPXXXXXXXXXXXXXXXXXXXXXXXXXXXXXXXXXXXXXXXXXXXXXXXXWSILKPGETLKVESNGNLIAPWYAFRXXXXXXXXXXXXXXXXXXXXXXXXXXXXXXXXXTNKTFQNISPVWIGXXXXXXXXXSLKLATGLRNVPKXXTRGIFGAIAGFIEGGWTGLIDGWYGYHHXXSQGSGYAADRESTQKAXXXXXXXXXXXXXXXXXXXXXXXHEFSSLERRIXXXXXXXXDGFLNVWTYNAELLILLENERTLDMHDANVKXXXXXXXXXLRDNAKDLGNGCFEFWHKCNNECXXXXKNGTYNYPKYQXXXXXXXXXXXXXXXXXXDVYQILAIYSTISSSLVLMGLIXXXXXWMCSNSSMQCRICIXX

SEQ ID NO: 419490 - protein, 570 aa, Influenza virus
  MOD_RES (1)..(14): Any amino acid
  MOD_RES (52)..(73): Any amino acid
  MOD_RES (84)..(157): Any amino acid
  MOD_RES (168)..(189): Any amino acid
  MOD_RES (200)..(247): Any amino acid
  MOD_RES (274)..(306): Any amino acid
  MOD_RES (321)..(329): Any amino acid
  MOD_RES (343)..(344): Any amino acid
  MOD_RES (374)..(379): Any amino acid
  MOD_RES (391)..(413): Any amino acid
  MOD_RES (424)..(431): Any amino acid
  MOD_RES (463)..(471): Any amino acid
  MOD_RES (495)..(498): Any amino acid
  MOD_RES (510)..(527): Any amino acid
  MOD_RES (550)..(554): Any amino acid
  MOD_RES (569)..(570): Any amino acid
XXXXXXXXXXXXXXKSDRICIGYHANNSTTQIDTILEKNITVTHSVELLEDXXXXXXXXXXXXXXXXXXXXXXDGWILGNPQCXXXXXXXXXXXXXXXXXXXXXXXXXXXXXXXXXXXXXXXXXXXXXXXXXXXXXXXXXXXXXXXXXXXXXXXXXXSSFYRNLVWIXXXXXXXXXXXXXXXXXXXXXXVLYFWGIHHPXXXXXXXXXXXXXXXXXXXXXXXXXXXXXXXXXXXXXXXXXXXXXXXXWSVLRPGETLNVESNGNLVAPWYAYKXXXXXXXXXXXXXXXXXXXXXXXXXXXXXXXXXTNRTFQNVSPLWVGXXXXXXXXXNLKLATGLRNIPQXXNRGLFGAIAGFIEGGWTGMVDGWYGYHHEXXXXXXYAADRESTQRAXXXXXXXXXXXXXXXXXXXXXXXHEFSNLEKRIXXXXXXXXDGFMDVWTYNAELLVLLEDERTLDMHDVNVKXXXXXXXXXLKDNAKDLGNGCFEFWHKCDDECXXXXKKGTYDYPKYQXXXXXXXXXXXXXXXXXXGIYQILAIYSTVSSSLVLAGLIXXXXXWMCLNGSMQCRVCIXX

SEQ ID NO: 419491 - protein, 570 aa, Influenza virus
  MOD_RES (1)..(14): Any amino acid
  MOD_RES (52)..(73): Any amino acid
  MOD_RES (85)..(157): Any amino acid
  MOD_RES (168)..(247): Any amino acid
  MOD_RES (274)..(306): Any amino acid
  MOD_RES (317)..(330): Any amino acid
  MOD_RES (342)..(344): Any amino acid
  MOD_RES (355)..(379): Any amino acid
  MOD_RES (391)..(413): Any amino acid
  MOD_RES (424)..(431): Any amino acid
  MOD_RES (461)..(471): Any amino acid
  MOD_RES (483)..(483): Any amino acid
  MOD_RES (495)..(498): Any amino acid
  MOD_RES (510)..(527): Any amino acid
  MOD_RES (550)..(555): Any amino acid
  MOD_RES (569)..(570): Any amino acid
XXXXXXXXXXXXXXRSHKICIGYHANNSTTQVNTILEKNVTVTHSIELLENXXXXXXXXXXXXXXXXXXXXXXEGWILGNPKCDXXXXXXXXXXXXXXXXXXXXXXXXXXXXXXXXXXXXXXXXXXXXXXXXXXXXXXXXXXXXXXXXXXXXXXXXXSSFYRNLLWMXXXXXXXXXXXXXXXXXXXXXXXXXXXXXXXXXXXXXXXXXXXXXXXXXXXXXXXXXXXXXXXXXXXXXXXXXXXXXXXXWSMLKPGETLNIESNGNLIAPWYAYRXXXXXXXXXXXXXXXXXXXXXXXXXXXXXXXXXTNKTFQNASPXXXXXXXXXXXXXXLRLATGLRNIPXXXARGLFGAIAGXXXXXXXXXXXXXXXXXXXXXXXXXYAADKESTQRAXXXXXXXXXXXXXXXXXXXXXXXHEFSNLERRVXXXXXXXXNGFLDVWTYNAELLVLLENGRTLDMHDANXXXXXXXXXXXLKDNANDLGNGXFEFWHKCDNDCXXXXKNGTYKYPKYQXXXXXXXXXXXXXXXXXXGVYQILSIYSTVSSSLVLVGLVXXXXXXMCSNGSMQCKICIXX

SEQ ID NO: 419492 - protein, 570 aa, Influenza virus
  MOD_RES (1)..(25): Any amino acid
  MOD_RES (52)..(73): Any amino acid
  MOD_RES (85)..(157): Any amino acid
  MOD_RES (168)..(247): Any amino acid
  MOD_RES (258)..(263): Any amino acid
  MOD_RES (274)..(307): Any amino acid
  MOD_RES (321)..(413): Any amino acid
  MOD_RES (424)..(431): Any amino acid
  MOD_RES (444)..(448): Any amino acid
  MOD_RES (463)..(471): Any amino acid
  MOD_RES (488)..(498): Any amino acid
  MOD_RES (509)..(536): Any amino acid
  MOD_RES (549)..(555): Any amino acid
  MOD_RES (569)..(570): Any amino acid
XXXXXXXXXXXXXXXXXXXXXXXXXNNSTTQVDTLLEKNVTVTHSIELLESXXXXXXXXXXXXXXXXXXXXXXKGWILGNPRCGXXXXXXXXXXXXXXXXXXXXXXXXXXXXXXXXXXXXXXXXXXXXXXXXXXXXXXXXXXXXXXXXXXXXXXXXXSSFYRSLLWIXXXXXXXXXXXXXXXXXXXXXXXXXXXXXXXXXXXXXXXXXXXXXXXXXXXXXXXXXXXXXXXXXXXXXXXXXXXXXXXXWSVLQPGETLXXXXXXNLVAPWYAYRXXXXXXXXXXXXXXXXXXXXXXXXXXXXXXXXXXNKTFQNVSPVWIGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYEFSNLERRIXXXXXXXXDGLLDVWTYNAEXXXXXENERTLDQHDANVKXXXXXXXXXLRDNAMILGNGCFEFWXXXXXXXXXXXENGTYDYPKYXXXXXXXXXXXXXXXXXXXXXXXXXXXXSTVSSGLVLVGLXXXXXXXMCSNGSMQCNVCIXX

SEQ ID NO: 419493 - protein, 570 aa, Influenza virus
  MOD_RES (1)..(31): Any amino acid
  MOD_RES (42)..(307): Any amino acid
  MOD_RES (321)..(434): Any amino acid
  MOD_RES (446)..(449): Any amino acid
  MOD_RES (460)..(499): Any amino acid
  MOD_RES (510)..(570): Any amino acid
XXXXXXXXXXXXXXXXXXXXXXXXXXXXXXXVDTILEKNITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNKTFQNVSPIWIGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGVWTYNAELLXXXXNERTLDMHDVXXXXXXXXXXXXXXXXXXXXXXXXXXXXXXXXXXXXXXXXNGTYNYPKYHXXXXXXXXXXXXXXXXXXXXXXXXXXXXXXXXXXXXXXXXXXXXXXXXXXXXXXXXXXXXX

SEQ ID NO: 419494 - protein, 570 aa, Influenza virus
  MOD_RES (1)..(452): Any amino acid
  MOD_RES (463)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLDLHDANVRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419495 - protein, 619 aa, Influenza virus
  MOD_RES (14)..(23): Any amino acid
  MOD_RES (42)..(48): Any amino acid
  MOD_RES (67)..(93): Any amino acid
  MOD_RES (105)..(170): Any amino acid
  MOD_RES (185)..(253): Any amino acid
  MOD_RES (264)..(273): Any amino acid
  MOD_RES (289)..(341): Any amino acid
  MOD_RES (355)..(356): Any amino acid
  MOD_RES (388)..(393): Any amino acid
  MOD_RES (449)..(465): Any amino acid
  MOD_RES (480)..(483): Any amino acid
  MOD_RES (539)..(539): Any amino acid
  MOD_RES (552)..(571): Any amino acid
  MOD_RES (591)..(602): Any amino acid
  MOD_RES (614)..(619): Any amino acid
SKSRGYKMNTQILXXXXXXXXXXGCDHSDNADKICLGHHAVXXXXXXXTLTERGIEVVNATETVETXXXXXXXXXXXXXXXXXXXXXXXXXXXGPPQCDQFLEFXXXXXXXXXXXXXXXXXXXXXXXXXXXXXXXXXXXXXXXXXXXXXXXXXXXXXXXXXXXXXXXXXXSSSFYAEMKWLLSNXXXXXXXXXXXXXXXXXXXXXXXXXXXXXXXXXXXXXXXXXXXXXXXXXXXXXXXXXXXXXXXXXXXXXGQSGRIDFHWXXXXXXXXXXFTFNGAFIAPDRASFXXXXXXXXXXXXXXXXXXXXXXXXXXXXXXXXXXXXXXXXXXXXXXXXXXXXXSLLLATGMRNVPEXXTHKQLTHHMRKKRGLFGAIRETRGLFGAIAGXXXXXXLFGAIAGFIENGWEGLIDGWYGFRHQNAQGEGTAADYKSTQSAIDQITGKLNRLIXXXXXXXXXXXXXXXXXEQQIGNVINWTRDSXXXXWSYNAELLVAMENQHTIDLADSEMNKLYERVRKQLRENAEEDGTGCFEIFHKCDDXCMESIRNNTYDHXXXXXXXXXXXXXXXXXXXXSGYKDIILWFSFGASCFLLXXXXXXXXXXXXKNGNMRCTICIXXXXXX

SEQ ID NO: 419496 - protein, 619 aa, Influenza virus
  MOD_RES (14)..(30): Any amino acid
  MOD_RES (41)..(48): Any amino acid
  MOD_RES (67)..(93): Any amino acid
  MOD_RES (105)..(171): Any amino acid
  MOD_RES (185)..(253): Any amino acid
  MOD_RES (264)..(273): Any amino acid
  MOD_RES (289)..(341): Any amino acid
  MOD_RES (355)..(356): Any amino acid
  MOD_RES (387)..(400): Any amino acid
  MOD_RES (449)..(465): Any amino acid
  MOD_RES (480)..(483): Any amino acid
  MOD_RES (539)..(539): Any amino acid
  MOD_RES (552)..(571): Any amino acid
  MOD_RES (591)..(602): Any amino acid
  MOD_RES (614)..(619): Any amino acid
SKSRGYKMNNQILXXXXXXXXXXXXXXXXXGDKICLGHHAXXXXXXXXTLTERGVEVVNATETVERXXXXXXXXXXXXXXXXXXXXXXXXXXXGPPQCDLFLEFXXXXXXXXXXXXXXXXXXXXXXXXXXXXXXXXXXXXXXXXXXXXXXXXXXXXXXXXXXXXXXXXXXXPSFYAEMKWLLSSXXXXXXXXXXXXXXXXXXXXXXXXXXXXXXXXXXXXXXXXXXXXXXXXXXXXXXXXXXXXXXXXXXXXXGQSGRIDFYWXXXXXXXXXXFSFNGAFIAPNRASFXXXXXXXXXXXXXXXXXXXXXXXXXXXXXXXXXXXXXXXXXXXXXXXXXXXXXSLLLATGMKNVPEXXAHKQLTHHMRKKRGLFGAKRMTRGLFGAIAXXXXXXXXXXXXXXFIENGWEGLVDGWYGFRHQNSQGEGTAADYKSTQSAVDQITGKLNRIIXXXXXXXXXXXXXXXXXEKQIGNVINWTQDAXXXXWSYNAEFLVAVENQHTIDLTDSEMSKLYERVKKQLRENAEEDGNGCFEIFHQCDNXCMASIRNNTYDHXXXXXXXXXXXXXXXXXXXXSGYKDVILWFSFGASCFILXXXXXXXXXXXXKNGNMQCTICIXXXXXX

SEQ ID NO: 419497 - protein, 619 aa, Influenza virus
  MOD_RES (14)..(48): Any amino acid
  MOD_RES (67)..(93): Any amino acid
  MOD_RES (105)..(171): Any amino acid
  MOD_RES (185)..(253): Any amino acid
  MOD_RES (264)..(273): Any amino acid
  MOD_RES (289)..(341): Any amino acid
  MOD_RES (354)..(356): Any amino acid
  MOD_RES (367)..(375): Any amino acid
  MOD_RES (387)..(401): Any amino acid
  MOD_RES (448)..(465): Any amino acid
  MOD_RES (480)..(483): Any amino acid
  MOD_RES (504)..(504): Any amino acid
  MOD_RES (536)..(539): Any amino acid
  MOD_RES (552)..(571): Any amino acid
  MOD_RES (591)..(602): Any amino acid
  MOD_RES (613)..(619): Any amino acid
SKSRGYKMNIQILXXXXXXXXXXXXXXXXXXXXXXXXXXXXXXXXXXXTLTEKGIEVVNATETVEQXXXXXXXXXXXXXXXXXXXXXXXXXXXGPPQCDRFLEFXXXXXXXXXXXXXXXXXXXXXXXXXXXXXXXXXXXXXXXXXXXXXXXXXXXXXXXXXXXXXXXXXXXSSFYAEMEWLLSNXXXXXXXXXXXXXXXXXXXXXXXXXXXXXXXXXXXXXXXXXXXXXXXXXXXXXXXXXXXXXXXXXXXXXGQFGRINFHWXXXXXXXXXXFSFNGAFVAPDRVSFXXXXXXXXXXXXXXXXXXXXXXXXXXXXXXXXXXXXXXXXXXXXXXXXXXXXXSLMLATGMKNVPXXXIHKQLTHHMRXXXXXXXXXRKTRGLFGAIAXXXXXXXXXXXXXXXIENGWEGLINGWYGFRHQNAQGEGIAADYKSTQSAINQITGKLNRLXXXXXXXXXXXXXXXXXXERQIGNVINWTRDAXXXXWSYNAELLIAMENQHTIDLTXSEMNKLYEKVRRQLRENAEEDGTGCFEILHKXXXXCMASIRNSTYDHXXXXXXXXXXXXXXXXXXXXSGYKEVILWFSFGASCLILXXXXXXXXXXXXRNGNMRCTICXXXXXXX

SEQ ID NO: 419498 - protein, 619 aa, Influenza virus
  MOD_RES (14)..(48): Any amino acid
  MOD_RES (67)..(93): Any amino acid
  MOD_RES (105)..(253): Any amino acid
  MOD_RES (264)..(273): Any amino acid
  MOD_RES (289)..(342): Any amino acid
  MOD_RES (355)..(375): Any amino acid
  MOD_RES (396)..(406): Any amino acid
  MOD_RES (426)..(430): Any amino acid
  MOD_RES (449)..(465): Any amino acid
  MOD_RES (479)..(487): Any amino acid
  MOD_RES (508)..(513): Any amino acid
  MOD_RES (525)..(528): Any amino acid
  MOD_RES (539)..(540): Any amino acid
  MOD_RES (552)..(571): Any amino acid
  MOD_RES (591)..(604): Any amino acid
  MOD_RES (616)..(619): Any amino acid
MKSRGYKMNTRILXXXXXXXXXXXXXXXXXXXXXXXXXXXXXXXXXXXTLTEREVEVVNATETVENXXXXXXXXXXXXXXXXXXXXXXXXXXXGPPQCDKFLEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGQSGRINFHWXXXXXXXXXXFIFNGAFIAPDRVSFXXXXXXXXXXXXXXXXXXXXXXXXXXXXXXXXXXXXXXXXXXXXXXXXXXXXXXLLLATGMRNIPEXXXXXXXXXXXXXXXXXXXXXQMTRGLFGAIGLFGAIAGFIXXXXXXXXXXXEGLIDGWYGYRHQNAQGEGXXXXXKSTQSAIDQVTGKLNRLIXXXXXXXXXXXXXXXXXEKQLGNVINWTRDXXXXXXXXXAELLVALENQHTIDLADSEIXXXXXXVKRQLRENAEEXXXXCFEIFHKCDNXXMESIRNNTYNHXXXXXXXXXXXXXXXXXXXXGGYKDIILWFSFGASCFLFXXXXXXXXXXXXXXETCSALFVYSLXXXX

SEQ ID NO: 419499 - protein, 619 aa, Influenza virus
  MOD_RES (1)..(1): Any amino acid
  MOD_RES (14)..(48): Any amino acid
  MOD_RES (67)..(253): Any amino acid
  MOD_RES (264)..(277): Any amino acid
  MOD_RES (289)..(342): Any amino acid
  MOD_RES (353)..(377): Any amino acid
  MOD_RES (388)..(407): Any amino acid
  MOD_RES (427)..(433): Any amino acid
  MOD_RES (449)..(465): Any amino acid
  MOD_RES (477)..(487): Any amino acid
  MOD_RES (527)..(540): Any amino acid
  MOD_RES (552)..(571): Any amino acid
  MOD_RES (591)..(608): Any amino acid
XKSRGYKMNTKILXXXXXXXXXXXXXXXXXXXXXXXXXXXXXXXXXXXTHTERGVEVVDATETVERXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGQTGRIDFHWXXXXXXXXXXXXXXGAFIAPDRATFXXXXXXXXXXXXXXXXXXXXXXXXXXXXXXXXXXXXXXXXXXXXXXXXXXXXXXILLATGMRNVXXXXXXXXXXXXXXXXXXXXXXXXXPRGLFGAIAGXXXXXXXXXXXXXXXXXXXXGLIDGWYGFKHQNAQGEGTXXXXXXXPSAIDQITGKLNHLIXXXXXXXXXXXXXXXXXEKQIGNLINWTXXXXXXXXXXXAEFLVAMENQHIIDLADSEMDKLYERVKRLLRENAEEDGXXXXXXXXXXXXXXMASIRNNTYNHXXXXXXXXXXXXXXXXXXXXNGYKDVILWFSFGASCFTLXXXXXXXXXXXXXXXXXXCSALFVYSLRK

SEQ ID NO: 419500 - protein, 619 aa, Influenza virus
  MOD_RES (1)..(49): Any amino acid
  MOD_RES (60)..(377): Any amino acid
  MOD_RES (388)..(411): Any amino acid
  MOD_RES (426)..(437): Any amino acid
  MOD_RES (448)..(489): Any amino acid
  MOD_RES (504)..(504): Any amino acid
  MOD_RES (515)..(619): Any amino acid
XXXXXXXXXXXXXXXXXXXXXXXXXXXXXXXXXXXXXXXXXXXXXXXXXLTERGVEVVDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRGLFGAIAGXXXXXXXXXXXXXXXXXXXXXXXXGWYGYKHQNAQGEGXXXXXXXXXXXXNQITGKLNRIXXXXXXXXXXXXXXXXXXXXXXXXXXXXXXXXXXXXXXXXXXLLVAIENQHTIDLAXSEMKKLYERVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419501 - protein, 619 aa, Influenza virus
  MOD_RES (1)..(377): Any amino acid
  MOD_RES (388)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419502 - protein, 619 aa, Influenza virus
  MOD_RES (1)..(378): Any amino acid
  MOD_RES (395)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKPRPRRGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419503 - protein, 573 aa, Influenza virus
  MOD_RES (17)..(22): Any amino acid
  MOD_RES (62)..(74): Any amino acid
  MOD_RES (98)..(98): Any amino acid
  MOD_RES (111)..(111): Any amino acid
  MOD_RES (134)..(138): Any amino acid
  MOD_RES (151)..(155): Any amino acid
  MOD_RES (175)..(191): Any amino acid
  MOD_RES (202)..(205): Any amino acid
  MOD_RES (219)..(232): Any amino acid
  MOD_RES (246)..(255): Any amino acid
  MOD_RES (279)..(300): Any amino acid
  MOD_RES (316)..(316): Any amino acid
  MOD_RES (568)..(573): Any amino acid
SKSRGYKMNTQILILAXXXXXXAKGDKICLGHHAVANGTKVNTLTERGIEVVNATETVETAXXXXXXXXXXXXXDLGQCGLLGTLIGPPQCDQFLEFXSDLIIERREGTDXCYPGKFTNEESLRQILRRSGGIXXXXXGFTYSGIRTNGAXXXXXRSGSSFYAEMKWLLSNSDNXXXXXXXXXXXXXXXXXALIIWGVHHSXXXXEQTKLYGSGNKLIXXXXXXXXXXXXXXPGARRIDFHWLLLXXXXXXXXXXNDTVTFTFNGAFIAPDRASFFRGXXXXXXXXXXXXXXXXXXXXXXGGTIVSSLPFQNINPXTVGKCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFLLLAIAMGLVFICIKNGNMQCTICIXXXXXX

SEQ ID NO: 419504 - protein, 573 aa, Influenza virus
  MOD_RES (1)..(22): Any amino acid
  MOD_RES (62)..(74): Any amino acid
  MOD_RES (96)..(98): Any amino acid
  MOD_RES (111)..(111): Any amino acid
  MOD_RES (134)..(138): Any amino acid
  MOD_RES (151)..(155): Any amino acid
  MOD_RES (175)..(191): Any amino acid
  MOD_RES (202)..(205): Any amino acid
  MOD_RES (219)..(232): Any amino acid
  MOD_RES (254)..(255): Any amino acid
  MOD_RES (279)..(300): Any amino acid
  MOD_RES (316)..(316): Any amino acid
  MOD_RES (385)..(393): Any amino acid
  MOD_RES (462)..(462): Any amino acid
  MOD_RES (479)..(482): Any amino acid
  MOD_RES (568)..(573): Any amino acid
XXXXXXXXXXXXXXXXXXXXXXVKGDKICLGHHAVSNGTKVNTLTEKGIEVVNATETVERTXXXXXXXXXXXXXDLGRCGLLGTLTGPPQCDQFLXXXADLIIERREGNDXCYPGRFTNEESLRQVLRRSGGIXXXXXGFTYNGIRTNGAXXXXXRLGSSFYAEMKWLLSSSDNXXXXXXXXXXXXXXXXXALIIWGIHHSXXXXEQTKLYGNGNKLVXXXXXXXXXXXXXXPGARPQVNGQSGRIDFHWLLLXXNDTVTFSFNGAFIAPDRASFLRGXXXXXXXXXXXXXXXXXXXXXXGGTIISNLPFQNINSXTVGRCPRYVKQTSLLLATGMRNIPENPKKRGLFGAIAGFIENGWEGLVDGWYGFRHQNTQGEGTAADYXXXXXXXXXITGKLNRLIDKTNQQFELINNEFNEVEQQIGNVINWTQDAMTEVWSYNAELLVALENQHTIDLADSEIXKLYERVRKQLRENAEEXXXXCFEIFHKCDNQCMESIRNNTYNHTQYRTGSLQNRIQIDSVKLSSGYKDVILWFSFGASCFILLAIAMGLGFICIKNGNMRCTICIXXXXXX

SEQ ID NO: 419505 - protein, 573 aa, Influenza virus
  MOD_RES (1)..(22): Any amino acid
  MOD_RES (62)..(74): Any amino acid
  MOD_RES (98)..(98): Any amino acid
  MOD_RES (111)..(111): Any amino acid
  MOD_RES (134)..(138): Any amino acid
  MOD_RES (151)..(155): Any amino acid
  MOD_RES (168)..(191): Any amino acid
  MOD_RES (202)..(205): Any amino acid
  MOD_RES (219)..(232): Any amino acid
  MOD_RES (245)..(255): Any amino acid
  MOD_RES (279)..(300): Any amino acid
  MOD_RES (316)..(316): Any amino acid
  MOD_RES (355)..(355): Any amino acid
  MOD_RES (374)..(393): Any amino acid
  MOD_RES (480)..(483): Any amino acid
  MOD_RES (536)..(537): Any amino acid
  MOD_RES (566)..(573): Any amino acid
XXXXXXXXXXXXXXXXXXXXXXTNADKICLGHHAVSNGTKINTLTERGVEVVNATETVETTXXXXXXXXXXXXXDLGQCGLLGILIGPPQCDKFLEFXSDLIIERKEGTDXCYPGKFVNEEALRQILRGSGGIXXXXXGFIYSGIRTNGAXXXXXRSGSSFYAELKWXXXXXXXXXXXXXXXXXXXXXXXXALIVWGIHHSXXXXEQTKLYGSGSKLIXXXXXXXXXXXXXXPGTRRIDFHWLLXXXXXXXXXXXNDTVTFIFNGAFIAPDRASFFKGXXXXXXXXXXXXXXXXXXXXXXGGTIISSLPFQNINSXAVGKCPRYVKQESLLLATGMKNVPEIPKTRGLFGAIAGXIENGWEGLIDGWYGFRHQXXXXXXXXXXXXXXXXXXXXITGKLNRLISKTNQQFELIDSEFTEVEKQIGNVINWTRDSMTEVWSYNAELLVAIENQHTIDLTDSEMSKLYERVRRQLRENAEEDXXXXFEIFHKCDDHCMESIRNNTYDHSKYREEAMQNRIQIDPVKLSGGYKDIILWFXXGASCFLLLAVVMGLVFICIKNGNVRCTIXXXXXXXX

SEQ ID NO: 419506 - protein, 573 aa, Influenza virus
  MOD_RES (1)..(22): Any amino acid
  MOD_RES (33)..(39): Any amino acid
  MOD_RES (51)..(51): Any amino acid
  MOD_RES (62)..(78): Any amino acid
  MOD_RES (98)..(99): Any amino acid
  MOD_RES (111)..(111): Any amino acid
  MOD_RES (134)..(138): Any amino acid
  MOD_RES (149)..(155): Any amino acid
  MOD_RES (175)..(191): Any amino acid
  MOD_RES (202)..(208): Any amino acid
  MOD_RES (219)..(232): Any amino acid
  MOD_RES (246)..(255): Any amino acid
  MOD_RES (279)..(300): Any amino acid
  MOD_RES (315)..(316): Any amino acid
  MOD_RES (341)..(342): Any amino acid
  MOD_RES (355)..(393): Any amino acid
  MOD_RES (424)..(424): Any amino acid
  MOD_RES (444)..(447): Any amino acid
  MOD_RES (470)..(483): Any amino acid
  MOD_RES (531)..(538): Any amino acid
  MOD_RES (566)..(573): Any amino acid
XXXXXXXXXXXXXXXXXXXXXXTKGDKICLGHXXXXXXXKVNTLTERGVEXVNATETVETVXXXXXXXXXXXXXXXXXCGLLGTITGPPHCDQFLEFXXDLIIERREGADXCYPGKFVNGEALRQILRESGGIXXXXXGFTYSEIRTNXXXXXXXRSSSSFYAEMKWLLSNTDNXXXXXXXXXXXXXXXXXALIVWGVHHSXXXXXXXKLYGSGNKLVXXXXXXXXXXXXXXTGARRIDFHWLFLXXXXXXXXXXNDTITFSFNGAFIAPNRASFFRGXXXXXXXXXXXXXXXXXXXXXXRGTIVSSLPFQSINXXTVGKCPRYIKQESLMLATGMKNVPXXPKGRGLFGAIAGXXXXXXXXXXXXXXXXXXXXXXXXXXXXXXXXXXXXXXXITGKLNRLIEKTNQQFELIDNEFTEVEKQIXNVINWTRDSITEVWSYNAEXXXXMENQHTIDLTDSEMNKLYERVRXXXXXXXXXXXXXXFEIFHKCDDDCMASIRNNTYDHTKYRTESLQNRIQIDQVKLSSGYKDXXXXXXXXASCFLLLAIVMGLVFICVKNGNMRCTIXXXXXXXX

SEQ ID NO: 419507 - protein, 573 aa, Influenza virus
  MOD_RES (1)..(22): Any amino acid
  MOD_RES (34)..(78): Any amino acid
  MOD_RES (90)..(99): Any amino acid
  MOD_RES (111)..(111): Any amino acid
  MOD_RES (129)..(140): Any amino acid
  MOD_RES (151)..(155): Any amino acid
  MOD_RES (175)..(191): Any amino acid
  MOD_RES (202)..(208): Any amino acid
  MOD_RES (219)..(232): Any amino acid
  MOD_RES (246)..(261): Any amino acid
  MOD_RES (272)..(300): Any amino acid
  MOD_RES (316)..(316): Any amino acid
  MOD_RES (345)..(397): Any amino acid
  MOD_RES (419)..(427): Any amino acid
  MOD_RES (441)..(453): Any amino acid
  MOD_RES (479)..(497): Any amino acid
  MOD_RES (521)..(538): Any amino acid
XXXXXXXXXXXXXXXXXXXXXXARGDKICLGHHXXXXXXXXXXXXXXXXXXXXXXXXXXXXXXXXXXXXXXXXXXXXXCGLLGTVTGPPXXXXXXXXXXDLIIERREGSDXCYPGGFTNEESLRQIIRXXXXXXXXXXXXTYSGIRTNGTXXXXXRPGSSFYAEMKWLLSSTDNXXXXXXXXXXXXXXXXXALVIWGVHHSXXXXXXXKLYGNGNKLIXXXXXXXXXXXXXXPGARRIDFNWLLLXXXXXXXXXXXXXXXXTFNGAFIAPNXXXXXXXXXXXXXXXXXXXXXXXXXXXXXGGTIASSLPFQNISPXAVGKCPKYVKQESLMLATGMRNVPENPKXXXXXXXXXXXXXXXXXXXXXXXXXXXXXXXXXXXXXXXXXXXXXXXXXXXXXLNHLIGKTNQQFGLIDNEFNEXXXXXXXXXNWTRDAMTEVWSYXXXXXXXXXXXXXIDLADSEMNKLYERVKRQLRENAEEXXXXXXXXXXXXXXXXXXXIRNNTYDHSRYREEAMQNRLKIDXXXXXXXXXXXXXXXXXXASCFILLAIVMGLVFMCVKNGNMRCSALFVYSLRK

SEQ ID NO: 419508 - protein, 573 aa, Influenza virus
  MOD_RES (1)..(85): Any amino acid
  MOD_RES (96)..(116): Any amino acid
  MOD_RES (134)..(140): Any amino acid
  MOD_RES (151)..(156): Any amino acid
  MOD_RES (167)..(233): Any amino acid
  MOD_RES (254)..(304): Any amino acid
  MOD_RES (315)..(324): Any amino acid
  MOD_RES (345)..(400): Any amino acid
  MOD_RES (427)..(453): Any amino acid
  MOD_RES (470)..(509): Any amino acid
  MOD_RES (528)..(543): Any amino acid
  MOD_RES (547)..(547): Ile or Leu
  MOD_RES (561)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXIGPPHCDQFLXXXXXXXXXXXXXXXXXXXXXFANEESLRQILRKSGGIXXXXXXXTYSGIRTNGVXXXXXXSDSSFYAEMKXXXXXXXXXXXXXXXXXXXXXXXXXXXXXXXXXXXXXXXXXXXXXXXXXXXXXXXXXXXXXXXXXXXGARPQVNGQFGRIDFHWLMLXXXXXXXXXXXXXXXXXXXXXXXXXXXXXXXXXXXXXXXXXXXXXXXXXXXVSSLPFQNISXXXXXXXXXXVKQKSILLATGMRNIPEKPKXXXXXXXXXXXXXXXXXXXXXXXXXXXXXXXXXXXXXXXXXXXXXXXXXXXXXXXXLIGRTNQQFELIDNEFSEIEQQIGNVXXXXXXXXXXXXXXXXXXXXXXXXXXXIDLADSEMKKLYERVRXXXXXXXXXXXXXXXXXXXXXXXXXXXXXXXXXXXXXXXXKEAMQNRIQINPVKLSSGXXXXXXXXXXXXXXXXLLAXVMGLVFICMKNGNXXXXXXXXXXXXX

SEQ ID NO: 419509 - protein, 573 aa, Influenza virus
  MOD_RES (1)..(118): Any amino acid
  MOD_RES (129)..(242): Any amino acid
  MOD_RES (253)..(404): Any amino acid
  MOD_RES (424)..(457): Any amino acid
  MOD_RES (468)..(545): Any amino acid
  MOD_RES (558)..(558): Any amino acid
  MOD_RES (570)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNEEPLRQILRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGRIDFHWLMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTNQQFEMIDNEFTEIEQQIXXXXXXXXXXXXXXXXXXXXXXXXXXXXXXXXXXDSEMDKLYERXXXXXXXXXXXXXXXXXXXXXXXXXXXXXXXXXXXXXXXXXXXXXXXXXXXXXXXXXXXXXXXXXXXXXXXXXXXXXXAIAMGLVFMCVKXETCSALFVYSLXXXX

SEQ ID NO: 419510 - protein, 573 aa, Influenza virus
  MOD_RES (1)..(242): Any amino acid
  MOD_RES (254)..(406): Any amino acid
  MOD_RES (417)..(547): Any amino acid
  MOD_RES (558)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGRIDFHWLILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQRFELIDNEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAMGLVFICVKXXXXXXXXXXXXXXXX

SEQ ID NO: 419511 - protein, 573 aa, Influenza virus
  MOD_RES (1)..(242): Any amino acid
  MOD_RES (254)..(547): Any amino acid
  MOD_RES (558)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGRIDFHWLVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAMGLVFICMKXXXXXXXXXXXXXXXX

SEQ ID NO: 419512 - protein, 469 aa, Influenza virus
  MOD_RES (20)..(58): Any amino acid
  MOD_RES (72)..(83): Any amino acid
  MOD_RES (210)..(210): Any amino acid
  MOD_RES (253)..(258): Any amino acid
  MOD_RES (308)..(311): Any amino acid
  MOD_RES (338)..(338): Any amino acid
  MOD_RES (392)..(393): Any amino acid
  MOD_RES (414)..(414): Any amino acid
  MOD_RES (468)..(469): Any amino acid
MNPNQKIITIGSVSLTIATXXXXXXXXXXXXXXXXXXXXXXXXXXXXXXXXXXXXXXXERNITEIVYLNNTXXXXXXXXXXXXYRSWSKPQCQITGFAPFSKDNSIRLSAGGDIWITREPYVSCDTSKCYQFALGQGTTLDNKHSNGTIHDRIPHRTLLMNELGVPFHLGTKQVCIAWSSSSCHDGKAWLHVCVTGDDRNATASFIYNGXLVDSIGSWSQNILRTQESECVCINGSCTVVMTDGSASGKADTXXXXXXEGKIVHISPLSGSAQHIEECSCYPRYPNVRCVCRDNWKGSNRPVIDINMXXXXIDSSYVCSGLVGDTPRNEDGSSSSNCXDPNEERGNPGVKGWAFDSGDDVWMGRTISRDSRSGYETFRVIGGWTTANSKSQXXRQVIVDNNNWSGYSGIFSVEXKSCINRCFYVELIRGRPKETRVWWTSNSIVVFCGTSGTYGTGSWPDGANINFMXX

SEQ ID NO: 419513 - protein, 469 aa, Influenza virus
  MOD_RES (1)..(4): Any amino acid
  MOD_RES (18)..(58): Any amino acid
  MOD_RES (72)..(83): Any amino acid
  MOD_RES (182)..(182): Any amino acid
  MOD_RES (208)..(210): Any amino acid
  MOD_RES (226)..(226): Any amino acid
  MOD_RES (253)..(258): Any amino acid
  MOD_RES (273)..(273): Any amino acid
  MOD_RES (308)..(311): Any amino acid
  MOD_RES (338)..(338): Any amino acid
  MOD_RES (392)..(393): Any amino acid
  MOD_RES (411)..(414): Any amino acid
  MOD_RES (454)..(455): Any amino acid
  MOD_RES (468)..(469): Any amino acid
XXXXQKIITIGSISLTIXXXXXXXXXXXXXXXXXXXXXXXXXXXXXXXXXXXXXXXXXEKNITEIVYLNSTXXXXXXXXXXXXYRNWSKPQCQISGFAPFAKDNSIRLSAGGHIWVTREPYVSCDNNKCYQFALGQGTTLYNKHSNGTIHDRTPHRTLLMNELGVPFHLGTRQVCIAWSSSXCHDGKAWLHICVTGDDRNATASLIYXXXLVDSIVSWSQNILRTXESECVCINGTCTVVMTDGSASGRADTXXXXXXEGKIIHISPLSGSAXHIEECSCYPQYPNVRCVCRDNWKGSNRPIIDINMXXXXINSSYVCSGLVGDTPRNDDSSSSSNCXDPNDERGNPGVKGWAFDNGDDVWMGRTISKDSRSGYETFKVIGGWTIANSKSQXXRQVIVDNSNWSGYSGIFXXXXKSCVNRCFYVELIRGMPQETRVWWTSNSIIVFCGTSGTYXXGSWPDGANISFMXX

SEQ ID NO: 419514 - protein, 469 aa, Influenza virus
  MOD_RES (1)..(6): Any amino acid
  MOD_RES (20)..(58): Any amino acid
  MOD_RES (72)..(83): Any amino acid
  MOD_RES (164)..(167): Any amino acid
  MOD_RES (210)..(210): Any amino acid
  MOD_RES (222)..(228): Any amino acid
  MOD_RES (253)..(258): Any amino acid
  MOD_RES (273)..(276): Any amino acid
  MOD_RES (308)..(311): Any amino acid
  MOD_RES (338)..(338): Any amino acid
  MOD_RES (392)..(393): Any amino acid
  MOD_RES (414)..(414): Any amino acid
  MOD_RES (454)..(455): Any amino acid
  MOD_RES (468)..(469): Any amino acid
XXXXXXIITIGSVSLIIATXXXXXXXXXXXXXXXXXXXXXXXXXXXXXXXXXXXXXXXKRNITEIVYLNHTXXXXXXXXXXXXYRDWSKPQCQIIGFAPFSKDNSVRLSASGDIWITREPYVSCGPGKCYQFALGQGTTLENKHSNGTTHDRISHRTLLMNELXXXXHLGTKQVCMAWSSSSCHDGKAWLHVCITGDDRNATASFIYDGXLIDSIGSWSQNXXXXXXXECVCINGSCAVVMTDGSASRKADTXXXXXXEGKIAHISPLSGSAXXXXECSCYPRYPDVRCVCRDNWKGSNRPVVDINMXXXXIGSSYVCSGLVGDTPRNEDSSSSSNCXDPNNERGNPGVKGWAFDYGNDVWMGRTISMDSRSGYETFRVISGWTTANSKSKXXRQIIVDNNNWFGYFGIFFVEXKRCINRCFYVELIRGRPQENRVWWTSNSIVVFCGTSATYXXGSWPDGANIDFVXX

SEQ ID NO: 419515 - protein, 469 aa, Influenza virus
  MOD_RES (1)..(8): Any amino acid
  MOD_RES (20)..(58): Any amino acid
  MOD_RES (72)..(83): Any amino acid
  MOD_RES (97)..(102): Any amino acid
  MOD_RES (163)..(189): Any amino acid
  MOD_RES (210)..(228): Any amino acid
  MOD_RES (253)..(258): Any amino acid
  MOD_RES (273)..(295): Any amino acid
  MOD_RES (308)..(311): Any amino acid
  MOD_RES (338)..(338): Any amino acid
  MOD_RES (367)..(371): Any amino acid
  MOD_RES (391)..(393): Any amino acid
  MOD_RES (410)..(415): Any amino acid
  MOD_RES (426)..(430): Any amino acid
  MOD_RES (453)..(456): Any amino acid
  MOD_RES (468)..(469): Any amino acid
XXXXXXXXTIGSVSLTITTXXXXXXXXXXXXXXXXXXXXXXXXXXXXXXXXXXXXXXXEKNITKIVYLNSTXXXXXXXXXXXXYRIWSKPQCQIAGXXXXXXDNSVRLSAGGDIWVTREPYVSCSLDKCYQFALGQGTTLNNKHSNGTTHDRTSHRTLLMNEXXXXXXXXXXXXXXXXXXXXXXXXXXXLHVCVTGDDKNATASFIYNEXXXXXXXXXXXXXXXXXXXECVCINGTCAVVMTDGSASGKAETXXXXXXEGKISHISPLSGSAXXXXXXXXXXXXXXXXXXXXXXXKGSNRPVIDVNMXXXXIDSSYLCSGLVGDTPRNDDSSSNSNCXDPNNEKGNPGVKGWAFDYGSDVWMGRTIXXXXXSGYETFRVIDGWTTANSKSXXXRQVIVDNNSWSGYSGIXXXXXXNCINRCFYVEXXXXXPQETGVWWTSNSIVVFCGTSRTXXXXSWPDGANINLMXX

SEQ ID NO: 419516 - protein, 469 aa, Influenza virus
  MOD_RES (1)..(9): Any amino acid
  MOD_RES (20)..(58): Any amino acid
  MOD_RES (72)..(83): Any amino acid
  MOD_RES (95)..(103): Any amino acid
  MOD_RES (163)..(189): Any amino acid
  MOD_RES (210)..(228): Any amino acid
  MOD_RES (248)..(258): Any amino acid
  MOD_RES (272)..(313): Any amino acid
  MOD_RES (324)..(324): Any amino acid
  MOD_RES (338)..(338): Any amino acid
  MOD_RES (366)..(374): Any amino acid
  MOD_RES (392)..(393): Any amino acid
  MOD_RES (409)..(431): Any amino acid
  MOD_RES (444)..(444): Any amino acid
  MOD_RES (455)..(469): Any amino acid
XXXXXXXXXIGSVSLTIAIXXXXXXXXXXXXXXXXXXXXXXXXXXXXXXXXXXXXXXXERNVTETLYLNHTXXXXXXXXXXXXYKSWSKPQCQIXXXXXXXXXNSIRLSAGGNIWITREPYVSCSPNRCYQFALGQGTTLDNEHSNGTIHDRIPHRTLLMSEXXXXXXXXXXXXXXXXXXXXXXXXXXXLHVCVTGDDGNATASFIYGGXXXXXXXXXXXXXXXXXXXECVCINGSCIVVMTDGSASXXXXXXXXXXXEGKVVHISPLSGSXXXXXXXXXXXXXXXXXXXXXXXXXXXXXXXXXXXXXXXXXXSGYVCSGLVGXTPRNEDSSSNSNCXDPNEERGSPGVKGWAFDNGNDVWMGRTXXXXXXXXXETFRVIGGWATANSKSQXXRQVIVDNNNRSGYSGXXXXXXXXXXXXXXXXXXXXXXXQEARVWWTSNSIXVFCGTSGNYGXXXXXXXXXXXXXXX

SEQ ID NO: 419517 - protein, 469 aa, Influenza virus
  MOD_RES (1)..(9): Any amino acid
  MOD_RES (20)..(86): Any amino acid
  MOD_RES (97)..(115): Any amino acid
  MOD_RES (126)..(141): Any amino acid
  MOD_RES (153)..(235): Any amino acid
  MOD_RES (253)..(396): Any amino acid
  MOD_RES (413)..(431): Any amino acid
  MOD_RES (445)..(469): Any amino acid
XXXXXXXXXIGSVSLTIAAXXXXXXXXXXXXXXXXXXXXXXXXXXXXXXXXXXXXXXXXXXXXXXXXXXXXXXXXXXXXXXXXXXXWSKPQCKITGXXXXXXXXXXXXXXXXXXXVTREPYVSCGXXXXXXXXXXXXXXXXNEHSNGTTHDRXXXXXXXXXXXXXXXXXXXXXXXXXXXXXXXXXXXXXXXXXXXXXXXXXXXXXXXXXXXXXXXXXXXXXXXXXXXXXXXXXXXSCTVVMTDGNASGKADTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVNNNNWSGYSGVFSVXXXXXXXXXXXXXXXXXXXKETTVWWTSNSIVXXXXXXXXXXXXXXXXXXXXXXXXX

SEQ ID NO: 419518 - protein, 469 aa, Influenza virus
  MOD_RES (1)..(432): Any amino acid
  MOD_RES (443)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXETKVWWTSNSXXXXXXXXXXXXXXXXXXXXXXXXXXX

SEQ ID NO: 419519 - protein, 597 aa, Influenza virus
  MOD_RES (17)..(24): Any amino acid
  MOD_RES (61)..(74): Any amino acid
  MOD_RES (99)..(112): Any amino acid
  MOD_RES (123)..(125): Any amino acid
  MOD_RES (137)..(163): Any amino acid
  MOD_RES (174)..(197): Any amino acid
  MOD_RES (209)..(216): Any amino acid
  MOD_RES (228)..(228): Any amino acid
  MOD_RES (244)..(245): Any amino acid
  MOD_RES (259)..(262): Any amino acid
  MOD_RES (284)..(307): Any amino acid
  MOD_RES (335)..(335): Any amino acid
  MOD_RES (352)..(352): Any amino acid
  MOD_RES (372)..(377): Any amino acid
  MOD_RES (523)..(523): Any amino acid
  MOD_RES (578)..(582): Any amino acid
SKSRGYKMNTQILVFAXXXXXXXXGDKICLGHHAVANGTKVNTLTERGIEVVNATETVETXXXXXXXXXXXXXXTDLGQCGLLGTLIGPPQCDQFLEFXXXXXXXXXXXXXXDVCYPGKFTNXXXLRQILRGSGGIXXXXXXXXXXXXXXXXXXXXXXXXXXXGSSFYAEMKWXXXXXXXXXXXXXXXXXXXXXXXXPALIIWGVHHSXXXXXXXXLYGSGNKLITVXSSKYQQSFTPSPGARXXVNGQSGRIDFHWLXXXXNDTVTFTFNGAFIAPDRASFFXXXXXXXXXXXXXXXXXXXXXXXXGGTIVSSLPFQNINPRTVGKCPRYVKQXSLLLATGMRNVPENPKXCSPLSRCRETRGLFGAIAGXXXXXXLFGAIAGFIENGWEGLIDGWYGFRHQNAQGEGTAADYKSTQSAIDQITGKLNRLIDKTNQQFELIDNEFNEIEQQIGNVINWTRDSMTEVWSYNAELLVAMENQHTIDLADSEMNKLYERVRKQLRENAEEDGTGCFEIFHKCDDXCMESIRNNTYDHTQYRTESLQNRIQIDPVKLSSGYKDIILWFSFGASCFLLLAIXXXXXFICIKNGNMRCTICI

SEQ ID NO: 419520 - protein, 597 aa, Influenza virus
  MOD_RES (17)..(24): Any amino acid
  MOD_RES (61)..(74): Any amino acid
  MOD_RES (97)..(112): Any amino acid
  MOD_RES (123)..(125): Any amino acid
  MOD_RES (137)..(163): Any amino acid
  MOD_RES (174)..(197): Any amino acid
  MOD_RES (209)..(216): Any amino acid
  MOD_RES (228)..(228): Any amino acid
  MOD_RES (244)..(245): Any amino acid
  MOD_RES (259)..(262): Any amino acid
  MOD_RES (284)..(307): Any amino acid
  MOD_RES (335)..(335): Any amino acid
  MOD_RES (352)..(352): Any amino acid
  MOD_RES (371)..(384): Any amino acid
  MOD_RES (443)..(445): Any amino acid
  MOD_RES (477)..(482): Any amino acid
  MOD_RES (510)..(512): Any amino acid
  MOD_RES (523)..(523): Any amino acid
  MOD_RES (578)..(582): Any amino acid
  MOD_RES (596)..(597): Any amino acid
SKSRGYKMNNQILILAXXXXXXXXADKICLGHHAVSNGTKVDTLTEKGIEVVNATETVERXXXXXXXXXXXXXXVDLGQCGLLGIITGPPQCDQFLXXXXXXXXXXXXXXXXDVCYPGKFVNXXXLRQILRESGGIXXXXXXXXXXXXXXXXXXXXXXXXXXXESSFYAEMKWXXXXXXXXXXXXXXXXXXXXXXXXPALIIWGIHHSXXXXXXXXLYGSGAKLITVXSSNYQQSFVPSPGARXXVNGQFGRINFHWLXXXXNDTVTFSFNGAFIAPDRVSFLXXXXXXXXXXXXXXXXXXXXXXXXGGTIISNLPFQNINSRAIGKCPRYVKQXSLLLATGMKNVPEIPKXCSPLSRCRKTRGLFGAIAXXXXXXXXXXXXXXFIENGWEGLVDGWYGFRHQNAQGEGIAADYKSTQSAVDQITGKLNRIIEKTNQQFELIXXXFTEVEKQIGNVINWTRDAMTEIWSYNAELLVXXXXXXTIDLADSEMDKLYERVRRQLRENAEEDXXXCFEIFHKCDNXCMASIRNNTYDHSKYREEAMQNRIQINPVKLSSGYKEVILWFSFGASCFILLAIXXXXXFICVKNGNMRCTIXX

SEQ ID NO: 419521 - protein, 597 aa, Influenza virus
  MOD_RES (1)..(1): Any amino acid
  MOD_RES (17)..(26): Any amino acid
  MOD_RES (61)..(74): Any amino acid
  MOD_RES (99)..(112): Any amino acid
  MOD_RES (123)..(125): Any amino acid
  MOD_RES (137)..(163): Any amino acid
  MOD_RES (174)..(197): Any amino acid
  MOD_RES (209)..(216): Any amino acid
  MOD_RES (228)..(228): Any amino acid
  MOD_RES (244)..(245): Any amino acid
  MOD_RES (259)..(262): Any amino acid
  MOD_RES (284)..(307): Any amino acid
  MOD_RES (324)..(324): Any amino acid
  MOD_RES (335)..(335): Any amino acid
  MOD_RES (352)..(352): Any amino acid
  MOD_RES (380)..(385): Any amino acid
  MOD_RES (405)..(408): Any amino acid
  MOD_RES (477)..(482): Any amino acid
  MOD_RES (509)..(523): Any amino acid
  MOD_RES (578)..(582): Any amino acid
  MOD_RES (594)..(597): Any amino acid
XKSRGYKMNTRILILTXXXXXXXXXXKICLGHHAVPNGTKVDTLTGRGIEVVNATETVEQXXXXXXXXXXXXXXIDLGQCGLLGTITGPPQCDLFLEFXXXXXXXXXXXXXXDVCYPGKFANXXXLRQILRRSGGIXXXXXXXXXXXXXXXXXXXXXXXXXXXGPSFYAEMKWXXXXXXXXXXXXXXXXXXXXXXXXPALIVWGIHHSXXXXXXXXLYGSGSKLITVXSSNYHQSFVPSPGVRXXVDGQSGRIDFHWMXXXXNDTITFSFNGAFVAPDRVSFFXXXXXXXXXXXXXXXXXXXXXXXXGGTITSPLPFQNINPRXVGKCPRYVRQXSLMLATGMKNVPETPKXKRKRGLFGAIAKPRPRRGLFGAIAGFIXXXXXXIENGWEGLINGWYGFRHQNXXXXGTAADYKSTPSAIDQITGKLNRLIEKTNQQFKLIDNEFSEIEQQIGNVINWTRDSITEVWSYNAELLIXXXXXXTIDLANSEMNKLYERVKRQLRENAEEXXXXXXXXXXXXXXXCMASIRNSTYDHSRYREEAMQNRMQINPVKLNSGYKDIILWFSFGASCFLFLAIXXXXXFMCVKNGNMRCXXXX

SEQ ID NO: 419522 - protein, 597 aa, Influenza virus
  MOD_RES (1)..(4): Any amino acid
  MOD_RES (17)..(26): Any amino acid
  MOD_RES (61)..(74): Any amino acid
  MOD_RES (99)..(112): Any amino acid
  MOD_RES (123)..(125): Any amino acid
  MOD_RES (137)..(163): Any amino acid
  MOD_RES (174)..(197): Any amino acid
  MOD_RES (209)..(216): Any amino acid
  MOD_RES (228)..(228): Any amino acid
  MOD_RES (244)..(245): Any amino acid
  MOD_RES (259)..(262): Any amino acid
  MOD_RES (284)..(307): Any amino acid
  MOD_RES (335)..(339): Any amino acid
  MOD_RES (352)..(353): Any amino acid
  MOD_RES (364)..(391): Any amino acid
  MOD_RES (411)..(412): Any amino acid
  MOD_RES (477)..(483): Any amino acid
  MOD_RES (505)..(526): Any amino acid
  MOD_RES (578)..(582): Any amino acid
  MOD_RES (596)..(597): Any amino acid
XXXXGYKMNTQILIFTXXXXXXXXXXKICLGHHAVTNGTKVNTLTERGVEVVNATETVENXXXXXXXXXXXXXXTDLGQCGILGILTGPPQCDRFLEFXXXXXXXXXXXXXXDVCYPGKFSNXXXLRQVLRESGGIXXXXXXXXXXXXXXXXXXXXXXXXXXXDSSFYAEMKWXXXXXXXXXXXXXXXXXXXXXXXXPALIVWGVHHSXXXXXXXXLYGSGNKLVTVXSSKCQQSFTPSPGTRXXVNGQTGRIDFHWLXXXXNDTVIFSFNGAFIAPDRATFLXXXXXXXXXXXXXXXXXXXXXXXXGGTITSNLPFQNVNSRAVGRCPRYVKQXXXXXATGMRNVPEKPKXXRRRGLFGAIAXXXXXXXXXXXXXXXXXXXXXXXXXXXXGLIDGWYGFKHQNAQGEGTXXDYKSTQSAINQITGKLNRLIDRTNHQFELIDNEFIEVEKQIGNVINWTRDSVTELWSYNAELLVXXXXXXXIDLADSEMNNLYERVRKQLRAXXXXXXXXXXXXXXXXXXXXXXSIRNNTYDHNQYRAESLQNRIRIDPVKLSGGYKDIILWFGFGASCFLLIAIXXXXXFICVKNGNHAVHYXX

SEQ ID NO: 419523 - protein, 597 aa, Influenza virus
  MOD_RES (1)..(30): Any amino acid
  MOD_RES (61)..(74): Any amino acid
  MOD_RES (94)..(112): Any amino acid
  MOD_RES (123)..(126): Any amino acid
  MOD_RES (137)..(163): Any amino acid
  MOD_RES (182)..(216): Any amino acid
  MOD_RES (227)..(228): Any amino acid
  MOD_RES (242)..(245): Any amino acid
  MOD_RES (259)..(262): Any amino acid
  MOD_RES (273)..(273): Any amino acid
  MOD_RES (284)..(307): Any amino acid
  MOD_RES (335)..(341): Any amino acid
  MOD_RES (352)..(353): Any amino acid
  MOD_RES (364)..(421): Any amino acid
  MOD_RES (473)..(484): Any amino acid
  MOD_RES (505)..(536): Any amino acid
  MOD_RES (576)..(582): Any amino acid
XXXXXXXXXXXXXXXXXXXXXXXXXXXXXXGHHAVANGTRVNTLTEKGIEVVDATETVERXXXXXXXXXXXXXXTDMGQCGLLGTVTGPPQCDXXXXXXXXXXXXXXXXXXXDICYPGKFTNXXXXRQILRGSGGVXXXXXXXXXXXXXXXXXXXXXXXXXXXGSSSFYAEMKWLLSNSDNXXXXXXXXXXXXXXXXXXXXXXXXXXXXXXXXXXXLYGNGNKLITXXSSKYLQSFTPSPGXXXXVNGQSGRINFHWLXXXXNDTVTGSFNGXFIAPDRASFLXXXXXXXXXXXXXXXXXXXXXXXXGGTIASSLPFQNINSRTLGKCPRYVKQXXXXXXXGMKNVPEIPRXXKKRGLFGAIAXXXXXXXXXXXXXXXXXXXXXXXXXXXXXXXXXXXXXXXXXXXXXXXXXXXXXXXXXXNQITGKLNRIIDKTNQQFEMIDNEFNEVEKQIGNIINWTRDSMTEIWSYNAXXXXXXXXXXXXDLADSEMSKLYERVKKQLREXXXXXXXXXXXXXXXXXXXXXXXXXXXXXXXXTYREEAMQNRVKIDPVKLSNGYKDVILWFSFGASCFLLIXXXXXXXFICIKDGNMRCTICI

SEQ ID NO: 419524 - protein, 597 aa, Influenza virus
  MOD_RES (1)..(41): Any amino acid
  MOD_RES (59)..(86): Any amino acid
  MOD_RES (97)..(165): Any amino acid
  MOD_RES (182)..(217): Any amino acid
  MOD_RES (228)..(231): Any amino acid
  MOD_RES (242)..(267): Any amino acid
  MOD_RES (278)..(314): Any amino acid
  MOD_RES (325)..(355): Any amino acid
  MOD_RES (371)..(423): Any amino acid
  MOD_RES (440)..(447): Any amino acid
  MOD_RES (473)..(485): Any amino acid
  MOD_RES (509)..(554): Any amino acid
  MOD_RES (578)..(583): Any amino acid
  MOD_RES (597)..(597): Any amino acid
XXXXXXXXXXXXXXXXXXXXXXXXXXXXXXXXXXXXXXXXXNTLAERGVEVVDATETVXXXXXXXXXXXXXXXXXXXXXXXXXXXXIGPPQCDLFLXXXXXXXXXXXXXXXXXXXXXXXXXXXXXXXXXXXXXXXXXXXXXXXXXXXXXXXXXXXXXXXXXXXXXPSFYAEMKWLLSNTDNXXXXXXXXXXXXXXXXXXXXXXXXXXXXXXXXXXXXYGSENKLITVXXXXYQQSFTPSPEXXXXXXXXXXXXXXXXXXXXXXXXXXFNFNGAFIAPXXXXXXXXXXXXXXXXXXXXXXXXXXXXXXXXXXXXXLPFQNINSRVXXXXXXXXXXXXXXXXXXXXXXXXXXXXXXXAYRKRMTRGLFGAIAXXXXXXXXXXXXXXXXXXXXXXXXXXXXXXXXXXXXXXXXXXXXXXXXXXXXXITGKLNRFIEKTNQQFXXXXXXXXEVERQIGNVINWTRDSITELWSYNAXXXXXXXXXXXXXQADSEMNKLYTRVKRQLRENAEKXXXXXXXXXXXXXXXXXXXXXXXXXXXXXXXXXXXXXXXXXXXXXXSSGYKDVILWFSFGASCFIFLAIXXXXXXICIKNGNMQCTICX

SEQ ID NO: 419525 - protein, 597 aa, Influenza virus
  MOD_RES (1)..(43): Any amino acid
  MOD_RES (55)..(86): Any amino acid
  MOD_RES (97)..(169): Any amino acid
  MOD_RES (182)..(233): Any amino acid
  MOD_RES (244)..(267): Any amino acid
  MOD_RES (279)..(355): Any amino acid
  MOD_RES (368)..(459): Any amino acid
  MOD_RES (481)..(486): Any amino acid
  MOD_RES (499)..(597): Any amino acid
XXXXXXXXXXXXXXXXXXXXXXXXXXXXXXXXXXXXXXXXXXXLTERGVEVVDAXXXXXXXXXXXXXXXXXXXXXXXXXXXXXXXXIGPPQCDRFLXXXXXXXXXXXXXXXXXXXXXXXXXXXXXXXXXXXXXXXXXXXXXXXXXXXXXXXXXXXXXXXXXXXXXXXXXAEMKWLLSNNDNXXXXXXXXXXXXXXXXXXXXXXXXXXXXXXXXXXXXXXXXXXXXXXXXXXXXQSFVPSPGSRXXXXXXXXXXXXXXXXXXXXXXXXFSSNGAFIAPDXXXXXXXXXXXXXXXXXXXXXXXXXXXXXXXXXXXXXXXXXXXXXXXXXXXXXXXXXXXXXXXXXXXXXXXXXXXXXAYQKRMTRGLFGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRDSMTEVMVVYAELLVAMENXXXXXXADSEMDKLYTRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419526 - protein, 597 aa, Influenza virus
  MOD_RES (1)..(169): Any amino acid
  MOD_RES (182)..(355): Any amino acid
  MOD_RES (370)..(493): Any amino acid
  MOD_RES (504)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAEMKWLLSNADNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYQKQMTRGLFGAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLHERVRKQLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419527 - protein, 597 aa, Influenza virus
  MOD_RES (1)..(171): Any amino acid
  MOD_RES (182)..(361): Any amino acid
  MOD_RES (372)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMKWLLSNSNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419528 - protein, 597 aa, Influenza virus
  MOD_RES (1)..(361): Any amino acid
  MOD_RES (373)..(597): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTTKPRPRRGLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419529 - protein, 515 aa, Influenza virus
  MOD_RES (1)..(10): Any amino acid
  MOD_RES (38)..(62): Any amino acid
  MOD_RES (79)..(84): Any amino acid
  MOD_RES (113)..(113): Any amino acid
  MOD_RES (127)..(127): Any amino acid
  MOD_RES (149)..(149): Any amino acid
  MOD_RES (198)..(255): Any amino acid
  MOD_RES (309)..(318): Any amino acid
  MOD_RES (418)..(425): Any amino acid
  MOD_RES (458)..(460): Any amino acid
  MOD_RES (478)..(478): Any amino acid
XXXXXXXXXXGVVNTTLSTIALLIGVGNLVFNTVIHEXXXXXXXXXXXXXXXXXXXXXXXXXITYNNTVINNITTTIIXXXXXXFKSPLPLCPFRGFFPFHKDNAIRLGENKXVIVTREPYVSCDNXNCWSFALAQGALLGTKHSNGTXKDRTPYRSLIRFPIGTAPVLGNYKEICIAWSSSSCFDGKEWMHVCMTGXXXXXXXXXXXXXXXXXXXXXXXXXXXXXXXXXXXXXXXXXXXXXXXXXXXXXXXXXXGRMTDSIKSWRKDILRTQESECQCIDGTCVVAVTDGPAANSADHRVYWIREGRXXXXXXXXXXKIQHLEECSCYVDIDVYCICRDNWKGSNRPWMRINNETILETGYVCSKFHSDTPRPADPSTVSCDSPSNVNGGPGVKGFGFKAGNDVWLGRTVSTSGRSXXXXXXXXEGWINSPNHAKSVTQTLVSNNDWSGYSGSFIVXXXDCFQPCFYVELIRGRPNXNDDVSWTSNSIVTFCGLDNEPGSGNWPDGSNIGFMPK

SEQ ID NO: 419530 - protein, 515 aa, Influenza virus
  MOD_RES (1)..(10): Any amino acid
  MOD_RES (38)..(62): Any amino acid
  MOD_RES (79)..(84): Any amino acid
  MOD_RES (113)..(113): Any amino acid
  MOD_RES (127)..(127): Any amino acid
  MOD_RES (148)..(149): Any amino acid
  MOD_RES (197)..(255): Any amino acid
  MOD_RES (309)..(318): Any amino acid
  MOD_RES (418)..(425): Any amino acid
  MOD_RES (457)..(460): Any amino acid
  MOD_RES (478)..(478): Any amino acid
XXXXXXXXXXGIVNTTLSTIALIIGVGNLIFNTVIHGXXXXXXXXXXXXXXXXXXXXXXXXXITYNSTVVNNITTTIVXXXXXXFKSSLPLCPFRGFFPFHKGNSARLIHHTXVIVTREPYISCDNXDCWSFALAQGVLLGTKHSNGXXKDRTSYRSLIRFPIGVAPVLGNYKEMCAAWSSSSCFDGKEWLHVCITXXXXXXXXXXXXXXXXXXXXXXXXXXXXXXXXXXXXXXXXXXXXXXXXXXXXXXXXXXXGKMTDSIKSWRRDILRTQESECLCIDGTCVVTVTDGPAANSAHHRVYWIREGKXXXXXXXXXXKIKHLEECSCYVDVDVYCICRDNWKGSNRPWIRINNETILETRYVCSKFHSDTPRPDDPSTMSCDSPSNINGGLGVKGFGFKTGDDVWLGRTVSNSGRSXXXXXXXXEGWINSPNHVKSITQTLVSNNDWSGYSGSFVXXXXGCFQPCFYIELIRGRPNXNDNVSWTSNSIVTFCGLNNEPGSGNWPDGANIGFMPK

SEQ ID NO: 419531 - protein, 515 aa, Influenza virus
  MOD_RES (1)..(10): Any amino acid
  MOD_RES (37)..(62): Any amino acid
  MOD_RES (79)..(84): Any amino acid
  MOD_RES (113)..(113): Any amino acid
  MOD_RES (127)..(127): Any amino acid
  MOD_RES (149)..(149): Any amino acid
  MOD_RES (198)..(255): Any amino acid
  MOD_RES (268)..(270): Any amino acid
  MOD_RES (309)..(318): Any amino acid
  MOD_RES (418)..(425): Any amino acid
  MOD_RES (458)..(460): Any amino acid
  MOD_RES (475)..(478): Any amino acid
  MOD_RES (491)..(493): Any amino acid
  MOD_RES (504)..(504): Any amino acid
  MOD_RES (515)..(515): Any amino acid
XXXXXXXXXXGAVNTTLSTIALFIGVGNLAFNTVIHXXXXXXXXXXXXXXXXXXXXXXXXXXITYNNTVVNNITTTIIXXXXXXFKPPLPLCPFKGFFPFHKDNALRLAENKXVIITREPYVSCDYXHCWSFALAQGALVGTKHSNGTXEDRTPYRSLIQFPIGTAPILGNYKEICVAWSSSSCFDGKEWMHICMTGXXXXXXXXXXXXXXXXXXXXXXXXXXXXXXXXXXXXXXXXXXXXXXXXXXXXXXXXXXGRVTDSIKSWRKXXXRTQESECQRIDGICVVAVTDGPADNKADHRIYWIREGKXXXXXXXXXXRIQHLEECSCYMDIDVYCVCRDNWKGSNRPWVRINNETILETGYICSKFHSDTPRPTDPSTISCDSPSNVKGGPGVKGFGFKKGSDVWLGRTVSINGRSXXXXXXXXEGWINSPSQAKSITQTLVSNSDWSGYSGSFIIXXXGCFQPCFYVELTRGXXXXNDEVSWTSNSIVXXXGLDNEPGSGKXPDGSDIGFMPX

SEQ ID NO: 419532 - protein, 515 aa, Influenza virus
  MOD_RES (1)..(10): Any amino acid
  MOD_RES (38)..(62): Any amino acid
  MOD_RES (77)..(84): Any amino acid
  MOD_RES (113)..(113): Any amino acid
  MOD_RES (124)..(127): Any amino acid
  MOD_RES (149)..(149): Any amino acid
  MOD_RES (198)..(255): Any amino acid
  MOD_RES (269)..(271): Any amino acid
  MOD_RES (309)..(318): Any amino acid
  MOD_RES (342)..(343): Any amino acid
  MOD_RES (363)..(365): Any amino acid
  MOD_RES (403)..(404): Any amino acid
  MOD_RES (418)..(425): Any amino acid
  MOD_RES (447)..(447): Any amino acid
  MOD_RES (458)..(462): Any amino acid
  MOD_RES (478)..(478): Any amino acid
  MOD_RES (513)..(515): Any amino acid
XXXXXXXXXXGVVNTALSTIALLIGIGNLVFNTVIHGXXXXXXXXXXXXXXXXXXXXXXXXXITYNKTVINNITTTXXXXXXXXFKPSLPLCPFQGFFPFHKDNAIRPGENKXVLVTREPYISXXXXGCWSFALAQGALLGTNHSNGTXKDRAPYRSLIQFPMGTAPVLGNYREICIAWSSTSCFDGKEWMHVSMTGXXXXXXXXXXXXXXXXXXXXXXXXXXXXXXXXXXXXXXXXXXXXXXXXXXXXXXXXXXGKMRDSIKSWRNNXXXTQESECQCIGGTCIVAVTDGPAANNADHRIYWIRKGRXXXXXXXXXXKIRHLEECSCYVDTDVYCICRDNXXGSNRPWMRISNETILETGYXXXKFHSDTPRPVDPSIMSCDSPSNANGEPGVKGFGFKVGXXVWLGRTVSISGRSXXXXXXXXDGWINSPNHAKSLTQTLVSNNXWSGYSGSFTVXXXXXFQSCFYVELIRGRLNXNDDVSWASNSIVTFCGLDNEPGSGHWPDGSNIGFXXX

SEQ ID NO: 419533 - protein, 515 aa, Influenza virus
  MOD_RES (1)..(10): Any amino acid
  MOD_RES (38)..(62): Any amino acid
  MOD_RES (79)..(84): Any amino acid
  MOD_RES (104)..(114): Any amino acid
  MOD_RES (125)..(133): Any amino acid
  MOD_RES (149)..(149): Any amino acid
  MOD_RES (182)..(185): Any amino acid
  MOD_RES (198)..(255): Any amino acid
  MOD_RES (269)..(271): Any amino acid
  MOD_RES (283)..(285): Any amino acid
  MOD_RES (309)..(320): Any amino acid
  MOD_RES (344)..(344): Any amino acid
  MOD_RES (361)..(375): Any amino acid
  MOD_RES (392)..(392): Any amino acid
  MOD_RES (403)..(407): Any amino acid
  MOD_RES (418)..(425): Any amino acid
  MOD_RES (456)..(465): Any amino acid
  MOD_RES (478)..(478): Any amino acid
  MOD_RES (489)..(499): Any amino acid
  MOD_RES (513)..(515): Any amino acid
XXXXXXXXXXGVVNTILSTKALLIGIGNLIFNTVIHEXXXXXXXXXXXXXXXXXXXXXXXXXVTYNNTVINNMTTTIIXXXXXXFKPSLPLCPVQGFFPFHKDXXXXXXXXXXXIVTREPCVSCXXXXXXXXXLAQGALLGTRHSNGTXKDKTPYRSLIRFPVGTAPVLGNYREVCIAWSSXXXXDGKEWMHVCITGXXXXXXXXXXXXXXXXXXXXXXXXXXXXXXXXXXXXXXXXXXXXXXXXXXXXXXXXXXGRMSDSIKSWRKDXXXTQESECQCISGXXXVSVTDGPAANSADHRIYWIREGRXXXXXXXXXXXXQHSEECSCYVDIDIYCICRDNWKXSNRPWVRMNNETILETXXXXXXXXXXXXXXXDPSVVSCDSPSNINGEXGVKGFGFKSGXXXXXGRTVSTSGRLXXXXXXXXEGWIDSPNHAKSITQTLVSNDDWSGYSGSFXXXXXXXXXXCFYIELIRGKPNXDDDVSWTSNSXXXXXXXXXXXGSGNWPDGSDIGFXXX

SEQ ID NO: 419534 - protein, 515 aa, Influenza virus
  MOD_RES (1)..(11): Any amino acid
  MOD_RES (38)..(65): Any amino acid
  MOD_RES (79)..(87): Any amino acid
  MOD_RES (98)..(168): Any amino acid
  MOD_RES (186)..(186): Any amino acid
  MOD_RES (198)..(257): Any amino acid
  MOD_RES (268)..(271): Any amino acid
  MOD_RES (282)..(293): Any amino acid
  MOD_RES (306)..(321): Any amino acid
  MOD_RES (332)..(351): Any amino acid
  MOD_RES (368)..(381): Any amino acid
  MOD_RES (392)..(434): Any amino acid
  MOD_RES (445)..(467): Any amino acid
  MOD_RES (478)..(479): Any amino acid
  MOD_RES (490)..(515): Any amino acid
XXXXXXXXXXXSVNTVLSIIALLIGIGNLAFNAVIHGXXXXXXXXXXXXXXXXXXXXXXXXXXXXNHTTINNITNVVLXXXXXXXXXSLPLCPFKGFXXXXXXXXXXXXXXXXXXXXXXXXXXXXXXXXXXXXXXXXXXXXXXXXXXXXXXXXXXXXXXXXXXXXXXXLGNYKEIRIAWSSSSCFXGKEWMHVCMAGXXXXXXXXXXXXXXXXXXXXXXXXXXXXXXXXXXXXXXXXXXXXXXXXXXXXXXXXXXXXMADSIKSWRKXXXXTQESECQCLYXXXXXXXXXXXXANNADHRVYWIRXXXXXXXXXXXXXXXXHLEECSCYTDXXXXXXXXXXXXXXXXXXXXINNETIVETGYVCSKFXXXXXXXXXXXXXXCSSPSGIEGRXXXXXXXXXXXXXXXXXXXXXXXXXXXXXXXXXXXXXXXXXXXVKSVTQTLVSXXXXXXXXXXXXXXXXXXXXXXXYVELIRGRPIXXEDVSWTSNSIXXXXXXXXXXXXXXXXXXXXXXXXXX

SEQ ID NO: 419535 - protein, 515 aa, Influenza virus
  MOD_RES (1)..(173): Any amino acid
  MOD_RES (187)..(435): Any amino acid
  MOD_RES (448)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEICVAWSSTSCFDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKAATQTLVSNNDXXXXXXXXXXXXXXXXXXXXXXXXXXXXXXXXXXXXXXXXXXXXXXXXXXXXXXXXXXXXXXXXXXXX

SEQ ID NO: 419536 - protein, 585 aa, Influenza virus
  MOD_RES (17)..(23): Any amino acid
  MOD_RES (42)..(42): Any amino acid
  MOD_RES (67)..(80): Any amino acid
  MOD_RES (91)..(91): Any amino acid
  MOD_RES (104)..(128): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(224): Any amino acid
  MOD_RES (235)..(241): Any amino acid
  MOD_RES (258)..(261): Any amino acid
  MOD_RES (282)..(313): Any amino acid
  MOD_RES (334)..(334): Any amino acid
  MOD_RES (348)..(349): Any amino acid
  MOD_RES (528)..(536): Any amino acid
  MOD_RES (566)..(568): Any amino acid
SKSRGYKMNTQILVFAXXXXXXXGCDHSDNADKICLGHHAVXNGTKVNTLTERGVEVVNATETVERXXXXXXXXXXXXXXDLGQCGLLGTXTGPPQCDQFLEFXXXXXXXXXXXXXXXXXXXXXXXXXLRQILRESGGXXXXXMGFTYSGIRTNGXXXXXXRSGSSFYAEMKWLLSNXXXXXFPQMTKSYKNXXXXPALIIWGIHHXXXXXXXXXXXXXXXXXXTVGSSNYQQSXXXXXXXRPQVNGQSGRIDFHWLXXXXNDTVTFSFNGAFIAPDRASFXXXXXXXXXXXXXXXXXXXXXXXXXXXXXXXXLPFQNINSRAVGKCPRYVKQXSLLLATGMKNVPEXXTHKQLTHHMRKKRGLFGAGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYRXXXXXXXXXIDPVKLSSGYKDVILWFSFGASCFILLAIXXXLVFICVKNGNMRCTICI

SEQ ID NO: 419537 - protein, 585 aa, Influenza virus
  MOD_RES (17)..(30): Any amino acid
  MOD_RES (42)..(42): Any amino acid
  MOD_RES (67)..(80): Any amino acid
  MOD_RES (91)..(91): Any amino acid
  MOD_RES (102)..(128): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(224): Any amino acid
  MOD_RES (235)..(241): Any amino acid
  MOD_RES (258)..(261): Any amino acid
  MOD_RES (282)..(313): Any amino acid
  MOD_RES (334)..(334): Any amino acid
  MOD_RES (347)..(349): Any amino acid
  MOD_RES (360)..(361): Any amino acid
  MOD_RES (528)..(536): Any amino acid
  MOD_RES (566)..(568): Any amino acid
  MOD_RES (584)..(585): Any amino acid
SKSRGYKMNIQILILAXXXXXXXXXXXXXXGDKICLGHHAAXNGTKVDTLTEKGIEVVNATETVEQXXXXXXXXXXXXXXDLGQCGLLGIXIGPPQCDQFLXXXXXXXXXXXXXXXXXXXXXXXXXXXLRQILRKSGGXXXXXMGFTYTGVRTNGXXXXXXRSRSSFYAEMKWLLSSXXXXXFPQTTKSYKNXXXXPALIVWGIHHXXXXXXXXXXXXXXXXXXTVGSSKYQQSXXXXXXXRPQINGQSGRIDFYWLXXXXNDTVTFTFNGAFIAPNRASFXXXXXXXXXXXXXXXXXXXXXXXXXXXXXXXXLPFQNINSRTIGKCPRYVKQXSLMLATGMKNVPXXXAHKQLTHHMRXXEKRGLFGAIAGFIENGWEGLVDGWYGFRHQNSQGEGTAADYKSTQAAIDQITGKLNRLIDKTNQQFELIDNKFNEIEKQIGNVINWTRDSITEMWSYNAELLIAMENQHTIDLTDSEMNKLYEKVRRQLRENAEEDCTGCFEIFHKCDDQCMESIRNNTYDHKKYRXXXXXXXXXIDAVKLSSGYKDIILWFSFGASCFLLLAIXXXLVFMCVKNGNMRCTSXX

SEQ ID NO: 419538 - protein, 585 aa, Influenza virus
  MOD_RES (17)..(30): Any amino acid
  MOD_RES (42)..(42): Any amino acid
  MOD_RES (67)..(80): Any amino acid
  MOD_RES (91)..(91): Any amino acid
  MOD_RES (104)..(128): Any amino acid
  MOD_RES (139)..(143): Any amino acid
  MOD_RES (156)..(161): Any amino acid
  MOD_RES (178)..(182): Any amino acid
  MOD_RES (193)..(196): Any amino acid
  MOD_RES (207)..(224): Any amino acid
  MOD_RES (235)..(241): Any amino acid
  MOD_RES (258)..(261): Any amino acid
  MOD_RES (282)..(313): Any amino acid
  MOD_RES (334)..(334): Any amino acid
  MOD_RES (348)..(349): Any amino acid
  MOD_RES (360)..(361): Any amino acid
  MOD_RES (372)..(378): Any amino acid
  MOD_RES (528)..(536): Any amino acid
  MOD_RES (566)..(568): Any amino acid
  MOD_RES (584)..(585): Any amino acid
MKSRGYKMNTKILVLAXXXXXXXXXXXXXXADKICLGRHAVXNGIKVDTLTEKEVEVVNATETVETXXXXXXXXXXXXXXDLSQCGLLGTXIGPPQCDLFLEFXXXXXXXXXXXXXXXXXXXXXXXXXLRQILRGSGGXXXXXTGFTYSGIRTDGXXXXXXRSESSFYAEMEWLLSNXXXXXFPQMTKSYRNXXXXPALIIWGVHHXXXXXXXXXXXXXXXXXXTVWSSKYQQSXXXXXXXRPQMNGQSGRIDFHWMXXXXNDTITFSFNGAFVAPDRVSFXXXXXXXXXXXXXXXXXXXXXXXXXXXXXXXXLPFQNINPRTVGKCPKYVKQXSLLLATGMRNVPEXXIHKQLTHHMRXXRRRGLFGAIAXXXXXXXEGLIDGWYGYRHQNAQGEGIAADYKSTQSAINQITGKLNRLIERTNQQFELIDNEFNEIEQQIGNVINWTRDSLTEVWSYNADLLVAMENQHIIDLADSEMNKLYERVKRQLRENAEEDGNGCFEIFHQCDNDCMTSIRNNTYDHTQYRXXXXXXXXXINPVKLSSGYKEVILWFSFGASCFTLLAIXXXLAFICIKNGNMRCTIXX

SEQ ID NO: 419539 - protein, 585 aa, Influenza virus
  MOD_RES (1)..(4): Any amino acid
  MOD_RES (17)..(31): Any amino acid
  MOD_RES (42)..(42): Any amino acid
  MOD_RES (63)..(80): Any amino acid
  MOD_RES (91)..(91): Any amino acid
  MOD_RES (102)..(128): Any amino acid
  MOD_RES (139)..(143): Any amino acid
  MOD_RES (155)..(161): Any amino acid
  MOD_RES (178)..(182): Any amino acid
  MOD_RES (193)..(196): Any amino acid
  MOD_RES (207)..(224): Any amino acid
  MOD_RES (235)..(241): Any amino acid
  MOD_RES (254)..(261): Any amino acid
  MOD_RES (282)..(313): Any amino acid
  MOD_RES (334)..(349): Any amino acid
  MOD_RES (372)..(379): Any amino acid
  MOD_RES (399)..(400): Any amino acid
  MOD_RES (419)..(419): Any amino acid
  MOD_RES (526)..(536): Any amino acid
  MOD_RES (566)..(568): Any amino acid
XXXXGYKMNTQILIFAXXXXXXXXXXXXXXXDKISLGHHAVXNGAKVNTLTERGIEVVNATEXXXXXXXXXXXXXXXXXXDLGRCGLLGTXTGPPQCDLFLXXXXXXXXXXXXXXXXXXXXXXXXXXXLRKILRKSGGXXXXXMRFTYSGIRTNXXXXXXXRSGPSFYAEMKWLLSDXXXXXFPQMTRSYKNXXXXPALITWGIHHXXXXXXXXXXXXXXXXXXTVWSSKYQRSXXXXXXXRPPVNGQSGRIDXXXXXXXXNDTVNFSFNGAFIAPDRAGFXXXXXXXXXXXXXXXXXXXXXXXXXXXXXXXXLPFQNVNSRAVGRCPRYVKQXXXXXXXXXXXXXXXXKKKKKKRGLFGARKRGLFGAIAXXXXXXXXGLIDGWYGYKHQNAQGEGTXXDYKSTQSAVNQITGKLNRXIDKTNQQFEMIDNEFNEVERQIGNVINWTRDSIIEVWSYNAEFLVAVENQHTIDLTNSEMNKLYERVRKQLRENAEEDGTACFEIFHKCDDRCMASIRNNSYDHSKXXXXXXXXXXXIDPVELSSGYKDVIIWFSFGASCFLFLAIXXXLVFICIKNGNMQCTICI

SEQ ID NO: 419540 - protein, 585 aa, Influenza virus
  MOD_RES (1)..(43): Any amino acid
  MOD_RES (58)..(80): Any amino acid
  MOD_RES (91)..(128): Any amino acid
  MOD_RES (139)..(143): Any amino acid
  MOD_RES (154)..(161): Any amino acid
  MOD_RES (173)..(224): Any amino acid
  MOD_RES (235)..(261): Any amino acid
  MOD_RES (277)..(323): Any amino acid
  MOD_RES (334)..(350): Any amino acid
  MOD_RES (372)..(382): Any amino acid
  MOD_RES (393)..(404): Any amino acid
  MOD_RES (424)..(425): Any amino acid
  MOD_RES (451)..(452): Any amino acid
  MOD_RES (464)..(465): Any amino acid
  MOD_RES (483)..(494): Any amino acid
  MOD_RES (528)..(536): Any amino acid
  MOD_RES (566)..(568): Any amino acid
  MOD_RES (584)..(585): Any amino acid
XXXXXXXXXXXXXXXXXXXXXXXXXXXXXXXXXXXXXXXXXXXGTKVNTLTEKGIEVXXXXXXXXXXXXXXXXXXXXXXXDLGKCGLLGTXXXXXXXXXXXXXXXXXXXXXXXXXXXXXXXXXXXXXXLRQILRRSGGXXXXXMGLTYNGIRTXXXXXXXXRLGSSFYAEMKXXXXXXXXXXXXXXXXXXXXXXXXXXXXXXXXXXXXXXXXXXXXXXXXXXXXTVWSSKYRRSXXXXXXXXXXXXXXXXXXXXXXXXXXXNDTVTFNFNGAFVAPXXXXXXXXXXXXXXXXXXXXXXXXXXXXXXXXXXXXXXXXXXXXXXXVGECPRYVKQXXXXXXXXXXXXXXXXXKKRKKRGLFGAKKRGLFGAIAXXXXXXXXXXXDGWYGFKHQNXXXXXXXXXXXXTQSAIDQITRKLNRLIEKTXXQFELIDNEFSEVEKQLGNVINWTRDXXIEIWSYNAEFLXXVENQHTIDSTDSEMNKLXXXXXXXXXXXXEEDGTGCFELFHKCDDDCMGSIRNNTYDHRKYKXXXXXXXXXIDPVKLSGGYKDVILWFSLGASCFLLIAIXXXLIFMCVKNGNMQCTIXX

SEQ ID NO: 419541 - protein, 585 aa, Influenza virus
  MOD_RES (1)..(45): Any amino acid
  MOD_RES (63)..(144): Any amino acid
  MOD_RES (156)..(363): Any amino acid
  MOD_RES (374)..(383): Any amino acid
  MOD_RES (401)..(405): Any amino acid
  MOD_RES (423)..(426): Any amino acid
  MOD_RES (437)..(466): Any amino acid
  MOD_RES (486)..(501): Any amino acid
  MOD_RES (512)..(512): Any amino acid
  MOD_RES (528)..(541): Any amino acid
  MOD_RES (558)..(570): Any amino acid
  MOD_RES (582)..(585): Any amino acid
XXXXXXXXXXXXXXXXXXXXXXXXXXXXXXXXXXXXXXXXXXXXXKVNTLTEREVEVVNATEXXXXXXXXXXXXXXXXXXXXXXXXXXXXXXXXXXXXXXXXXXXXXXXXXXXXXXXXXXXXXXXXXXXXXXXXXXXXXXXXXXGFTYTGVRTDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGLFGAIAGFXXXXXXXXXXGWYGFRHQKAQGEGTAAXXXXXQSAIDQITGTLNRLIDKXXXXFKLIDNEFTEXXXXXXXXXXXXXXXXXXXXXXXXXXXXXXENQHTIDLAESEMNKLYERXXXXXXXXXXXXXXXXFEIFHKCDDNXMANIRNNTYDHSTYRXXXXXXXXXXXXXXLSSGYKEIILWFSFGAXXXXXXXXXXXXXFICVKNGNMQCXXXX

SEQ ID NO: 419542 - protein, 585 aa, Influenza virus
  MOD_RES (1)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXICVKNGNHAVHYCI

SEQ ID NO: 419543 - protein, 585 aa, Influenza virus
  MOD_RES (1)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKNGNMRGTNWI

SEQ ID NO: 419544 - protein, 471 aa, Influenza virus
  MOD_RES (38)..(61): Any amino acid
  MOD_RES (73)..(81): Any amino acid
  MOD_RES (164)..(168): Any amino acid
  MOD_RES (251)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (454)..(454): Any amino acid
MNPNQKLFALSGVAIALSVLNLLIGISNVGLNVSLHLXXXXXXXXXXXXXXXXXXXXXXXXENTYVNNTTIIXXXXXXXXXSYLLLNKSLCNVEGWVVIAKDNAVRFGESEQIIVTREPYVSCDPTGCKMYALHQGTTIRNKHSNGTIHDRTAFRGLISTPLGXXXXXSNSDFMCVGWSSTTCHDGIGRMTICIQGNNDNATATVYYNRRLTTTIKTWARNILRTQESECVCHNGTCAVVMTDGSASSQAXXXXXXXXXXXXXXXXXLKGSARHIEECSCYGHNXXVTCVCRDNWQGANRPIIEIDMNXLEHTSRYVCTGILTDTSRPGDKXXGDCSNPITGSPGAPGVKGFGFLNGDNTWLGRTISPRSRSGFEMLKIPNAGTDPXXXXXXRQEIVDNNNWSGYSGSFIDYWNDXSECYNPCFYVELIRGRPEEAKYVWWTSNSLIALCGSPXPVGSGSFPDGAQIQYFS

SEQ ID NO: 419545 - protein, 471 aa, Influenza virus
  MOD_RES (38)..(61): Any amino acid
  MOD_RES (73)..(81): Any amino acid
  MOD_RES (115)..(116): Any amino acid
  MOD_RES (164)..(168): Any amino acid
  MOD_RES (251)..(267): Any amino acid
  MOD_RES (285)..(286): Any amino acid
  MOD_RES (309)..(309): Any amino acid
  MOD_RES (332)..(333): Any amino acid
  MOD_RES (387)..(392): Any amino acid
  MOD_RES (416)..(416): Any amino acid
  MOD_RES (427)..(430): Any amino acid
  MOD_RES (450)..(454): Any amino acid
MNPNQKLFASSGIAIVLGIINLLIGISNMSLNISLYSXXXXXXXXXXXXXXXXXXXXXXXXENTYVNNTTVIXXXXXXXXXNYLMLNKSLCKVEGWVVVAKDNAIRFGESEQIIXXREPYVSCDPLSCKMYALHQGTTIRNKHSNSTTHDRTAFRGLMSTPLGXXXXXSNSDFICVGWSSTSCHDGIARMTICVQGNNNNATATVYYDRRLTTTIRTWAKNILRTQESECVRHNGTCAVVMTDGPASSQAXXXXXXXXXXXXXXXXXLKGSAKHIEECSCYGHSXXATCVCRDNWQGANRPVIEIDMNXLEHTSRYICTGVLTDTSRPSDKXXGDCNNPITGSPGVPGVKGFGFLDSGNTWLGRTISPKLRSGFEMLKIHNAGTDPXXXXXXRQEIVSNDNWSGYSGSFIDYWDEXNECYNPCFYVXXXXGRPEEAKYVEWTSNSLIALXXXXXSVGSGSFPDGAQIKYFS

SEQ ID NO: 419546 - protein, 471 aa, Influenza virus
  MOD_RES (38)..(61): Any amino acid
  MOD_RES (72)..(81): Any amino acid
  MOD_RES (164)..(168): Any amino acid
  MOD_RES (251)..(267): Any amino acid
  MOD_RES (285)..(286): Any amino acid
  MOD_RES (297)..(298): Any amino acid
  MOD_RES (309)..(309): Any amino acid
  MOD_RES (332)..(333): Any amino acid
  MOD_RES (387)..(392): Any amino acid
  MOD_RES (416)..(432): Any amino acid
  MOD_RES (452)..(454): Any amino acid
  MOD_RES (468)..(471): Any amino acid
MNPSQKLFALSGVAIALSILNLLIGISNIGLNVSLHLXXXXXXXXXXXXXXXXXXXXXXXXKNTYVNNTTIXXXXXXXXXXGYLLLNKSLCSVEGWVVIEKDNAVRFGESEQVIVTREPYVSCDPSGCRMYALHQGTTIRNKHSNGTTHDRTAFRGLISTHLGXXXXXSNSDFLCVGWSSTSCHDGVGRMTICVQGDNENATATVYYNKRLTTTIKTWAKNILRTQDSECVSHNGTWAVVMTDGPANNQAXXXXXXXXXXXXXXXXXLRGSARHIEECSCYGHDXXITCVCRDNWQXXNRPIIEIDMTXMEHTSQYLCTGVLTDTSRPKDKXXGECFNPITGSPGSPGVKGFGFLSGSNTWLGRTISPRLRSGFEMLKIPNAETDPXXXXXXRQEIVGNDNWSGYSGSFIDYWDDXXXXXXXXXXXXXXXXXPEEAKYVWWASNSLIALCGXXXPVGPGSFPDGAQIXXXX

SEQ ID NO: 419547 - protein, 471 aa, Influenza virus
  MOD_RES (38)..(61): Any amino acid
  MOD_RES (73)..(81): Any amino acid
  MOD_RES (103)..(103): Any amino acid
  MOD_RES (115)..(116): Any amino acid
  MOD_RES (127)..(142): Any amino acid
  MOD_RES (164)..(168): Any amino acid
  MOD_RES (194)..(194): Any amino acid
  MOD_RES (248)..(268): Any amino acid
  MOD_RES (285)..(286): Any amino acid
  MOD_RES (298)..(298): Any amino acid
  MOD_RES (309)..(309): Any amino acid
  MOD_RES (332)..(335): Any amino acid
  MOD_RES (387)..(392): Any amino acid
  MOD_RES (410)..(437): Any amino acid
  MOD_RES (454)..(454): Any amino acid
MNPNQKLFTLSGVAIALSVLNLLIGVSNVGLNMSLHLXXXXXXXXXXXXXXXXXXXXXXXXENKYVNNTTIIXXXXXXXXXNYLLLNKSLCKIEGWVVVAKDXAIRFGESEQVIXXREPYVSCDPIXXXXXXXXXXXXXXXXHSNGTIHDRAAFRGLISTQLGXXXXXSNSEFICVGWSSTTCHDGVNRMTICXQGNNENATATVYYNGRLTTTIKTWAGNILRTQESECVCHNSTCVVVMTDGPANXXXXXXXXXXXXXXXXXXXXXKGSARHIEEWSCYGHSXXVSCVCRDNWQGXNRPIIEIDMSXLEHTSKYVCTGVLTDTSRPGDRXXXXCSNPITGSPCAPGIKGFGFLNENNTWLGRTISPRSRNGFEMLKIPNAGIDPXXXXXXRQEIVDNSNWSGYSGSFXXXXXXXXXXXXXXXXXXXXXXXXXXXXYVWWTSNSLVALCGSPXPIGSGFFPDGPQIQYFS

SEQ ID NO: 419548 - protein, 471 aa, Influenza virus
  MOD_RES (1)..(6): Any amino acid
  MOD_RES (38)..(61): Any amino acid
  MOD_RES (72)..(83): Any amino acid
  MOD_RES (127)..(143): Any amino acid
  MOD_RES (161)..(182): Any amino acid
  MOD_RES (194)..(198): Any amino acid
  MOD_RES (225)..(228): Any amino acid
  MOD_RES (251)..(286): Any amino acid
  MOD_RES (309)..(309): Any amino acid
  MOD_RES (321)..(345): Any amino acid
  MOD_RES (387)..(392): Any amino acid
  MOD_RES (410)..(471): Any amino acid
XXXXXXLFASSGIAIALGIINLLIGISNVVLNVSLHLXXXXXXXXXXXXXXXXXXXXXXXXGNTYVNNTTVXXXXXXXXXXXXLMLNKSLCKIEGWVVIAQDNAIRFGESEQIVVTREPYVSCDPKXXXXXXXXXXXXXXXXXSNGTIHDRTTFRGLISTXXXXXXXXXXXXXXXXXXXXXXCHDGVSRMTICXXXXXDNATATVYYDRRLTTTVKTWAGNILRXXXXECVCHNGTCVVIMTDGSASSRAXXXXXXXXXXXXXXXXXXXXXXXXXXXXXXXXXXXXVTCGCRDNWQGANRPVIEIDMSXMDHTSQYLCTGXXXXXXXXXXXXXXXXXXXXXXXXXAPGTKGFGFLNEDSTWLGRTISPRSRSGFEMLRIPNAGIDPXXXXXXRQEIVDNKNWSGYSGSFXXXXXXXXXXXXXXXXXXXXXXXXXXXXXXXXXXXXXXXXXXXXXXXXXXXXXXXXXXXXXX

SEQ ID NO: 419549 - protein, 471 aa, Influenza virus
  MOD_RES (1)..(62): Any amino acid
  MOD_RES (73)..(89): Any amino acid
  MOD_RES (100)..(148): Any amino acid
  MOD_RES (164)..(198): Any amino acid
  MOD_RES (209)..(217): Any amino acid
  MOD_RES (230)..(232): Any amino acid
  MOD_RES (251)..(315): Any amino acid
  MOD_RES (327)..(399): Any amino acid
  MOD_RES (412)..(471): Any amino acid
XXXXXXXXXXXXXXXXXXXXXXXXXXXXXXXXXXXXXXXXXXXXXXXXXXXXXXXXXXXXXXNTYINNATIIXXXXXXXXXXXXXXXXXLCNVEGWVVVXXXXXXXXXXXXXXXXXXXXXXXXXXXXXXXXXXXXXXXXXXXXXXXXXHDRTTFRGLLSTPLGXXXXXXXXXXXXXXXXXXXXXXXXXXXXXXXXXXXNNATATVYYNXXXXXXXXXWARNILRTQDSEXXXHNGTCVVVMTDGSASGQAXXXXXXXXXXXXXXXXXXXXXXXXXXXXXXXXXXXXXXXXXXXXXXXXXXXXXXXXXXXXXXXXXYICTGILTDTSXXXXXXXXXXXXXXXXXXXXXXXXXXXXXXXXXXXXXXXXXXXXXXXXXXXXXXXXXXXXXXXXXXXXXXXXXSNRSGYSGSFIDXXXXXXXXXXXXXXXXXXXXXXXXXXXXXXXXXXXXXXXXXXXXXXXXXXXXXXXXXXXX

SEQ ID NO: 419550 - protein, 471 aa, Influenza virus
  MOD_RES (1)..(62): Any amino acid
  MOD_RES (73)..(92): Any amino acid
  MOD_RES (103)..(471): Any amino acid
XXXXXXXXXXXXXXXXXXXXXXXXXXXXXXXXXXXXXXXXXXXXXXXXXXXXXXXXXXXXXXNTYINNTTIIXXXXXXXXXXXXXXXXXXXXVEGWVVIAQDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419551 - protein, 471 aa, Influenza virus
  MOD_RES (1)..(95): Any amino acid
  MOD_RES (109)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWVVIAKDNAIRFGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419552 - protein, 567 aa, Influenza virus
  MOD_RES (1)..(9): Any amino acid
  MOD_RES (180)..(183): Any amino acid
  MOD_RES (417)..(418): Any amino acid
XXXXXXXXXLLASTNAYDRICIGYQSNNSTDTVNTLIEQNVPVTQTMELVETEKHPAYCNTDLGTPLELRDCKIEAVIYGNPKCDIHLKDQGWSYIVERPSAPEGMCYPGSVENLEELRFVFSNAASYKRIRLFDYSRWNVTSSGTSKACNASTGGQSFYRSINWLTKKKPDTYDFNEGXXXXNNEDGDIIFLWGIHHPPDTKEQTTLYKNANTLSSVTTNTINRSFQPNIGPRPLVRGQQGRMDYYWGILKRGETLKIRTNGNLIAPEFGYLLKGESHGRIIQNEDIPIGNCHTKCQTYAGAINSSKPFQNASRHYMGECPKYVKKASLRLAVGLRNTPSIEPKGLFGAIAGFIEGGWSGMIDGWYGFHHSNSEGTGMAADQKSTQEAIDKITNKVNNIVDKMNREFEVVNHEFSXXEKRINMINDKIDDQIEDLWAYNAELLVLLENQKTLDEHDSNVKNLFDEVKRRLSANAIDAGNGCFDILHKCNNECMETIKNGTYNHKEYEEEAKLERSKINGVKLEENTTYKILSIYSTVAASLCLAILIAGGLILGMQNGSCRCMFCI

SEQ ID NO: 419553 - protein, 567 aa, Influenza virus
  MOD_RES (1)..(9): Any amino acid
  MOD_RES (75)..(76): Any amino acid
  MOD_RES (180)..(183): Any amino acid
  MOD_RES (245)..(265): Any amino acid
  MOD_RES (417)..(418): Any amino acid
XXXXXXXXXLLVSTNAYDRICIGYQSNNSTNTVNTLIEQKVPVTQTMELVEAEKHSAYCNTDLGAPLELRDCKIXXVIYGNPKCDVHLKDQDWSYIVERPSAPEGMCYPGFVENLEELRFVFSSAASYKRIRLFDYSKWNVTRSGTSKACNALTGGQSFYRSINWLTKKEPDTYDFNEGXXXXNNEDGNIIFLWGIHHPPNTKEQTALYKNANTLSSVNTNTINRSFQPNIGPRALVRGQQGRMXXXXXXXXXXXXXXXXXXXXXIAPEFGYLLRGESHGRTIQNEDIPIGSCNTKCQTYAGAVNSSKPFQNASRYYMGECPKYVRKASLRLAVGLRNTPSVEPKGLFGAIAGFIEGGWCGMIDGWYGFHHSNAEGTGMAADQKSTQEAINKITNKVNNIVDKMNREFGVVNHEFSXXEKRINVINDKIDDQIENLWAYNAELLVLLENQKILDEHDSNVKNLFDEVRRRLSANAIDTGNGCFDILHKCDNECMETIKNGTYDHKEYEEEAKLEKSRINGVKLEENTSYKILSIYSTVAASLCLAVLIAGGLILGMQNGSYRCMFCI

SEQ ID NO: 419554 - protein, 567 aa, Influenza virus
  MOD_RES (1)..(9): Any amino acid
  MOD_RES (102)..(102): Any amino acid
  MOD_RES (161)..(161): Any amino acid
  MOD_RES (183)..(183): Any amino acid
  MOD_RES (249)..(269): Any amino acid
  MOD_RES (353)..(381): Any amino acid
  MOD_RES (401)..(401): Any amino acid
  MOD_RES (417)..(418): Any amino acid
  MOD_RES (445)..(445): Any amino acid
  MOD_RES (558)..(567): Any amino acid
XXXXXXXXXLLASTNAHDRICIGYQSNNSTDTVDTLIEQNIPVTQTMELVETKKHPAYCNTDLGAPLELRDCKVEAVIYGNPKCDTHLKDQSWSYIVERPSXPEGMCYPGSIENLEELRFVFSIAASYKRIRLFDYSGWNVTSSGTSKACSASTGGQSFYXSINWLTKKKNPEAYNFNEGSYXNNEEGDIIFLWGIHHPPDAKEQTTLYKNANTLTSVTTNTINRIFQPNIGPRPLVREQQGRMDYYWXXXXXXXXXXXXXXXXXXXXXFGYLLKGESYGRIIQNEDIPIENCHTKCQTYTGAINSSKPLQNASRHYMGECPEYVKKESLRLAVGLRNTPSIDPKGLFGAIAXXXXXXXXXXXXXXXXXXXXXXXXXXXXXDQKSTQEAIGKITNKVNNIXDKMNREFEVMNHEFSXXEKRINMISDKIDDQIEGLWAYNAELLXLLENQKTLDKHDSNVKNLFDEVKRRLSTNAMDAGNGCFDILHKCDNKCMETIKNGTYNRKEYEEEAKLERSKINEVKLEENTTYRILSIYSTVAASLCLAILVAGGLILGMQXXXXXXXXXX

SEQ ID NO: 419555 - protein, 567 aa, Influenza virus
  MOD_RES (1)..(9): Any amino acid
  MOD_RES (20)..(27): Any amino acid
  MOD_RES (66)..(79): Any amino acid
  MOD_RES (99)..(121): Any amino acid
  MOD_RES (180)..(183): Any amino acid
  MOD_RES (253)..(270): Any amino acid
  MOD_RES (290)..(292): Any amino acid
  MOD_RES (355)..(381): Any amino acid
  MOD_RES (401)..(402): Any amino acid
  MOD_RES (417)..(418): Any amino acid
  MOD_RES (440)..(451): Any amino acid
  MOD_RES (486)..(496): Any amino acid
  MOD_RES (532)..(567): Any amino acid
XXXXXXXXXILVSTNAYDRXXXXXXXXNSTDTVNTLTEQNVPVTQAMELVEAEKHLAYCNTDLGTXXXXXXXXXXXXXXGNPKCDIHLRDQGWSYIVEXXXXXXXXXXXXXXXXXXXXXXXFSSAASYKRVRLFDYSRWNVSSSGTSKACNASTGAQSFYRSINWLTKKKPDIYDFNEGXXXXNNENGDIIFLWGIHHPPDETEQTKLYKNTNTLSSVTTNTINRNFQPNIGPRPLVRGQQGTMDYYWGILKXXXXXXXXXXXXXXXXXXGYLLKGESHCRIIQNEDIPXXXCKTKCQTYAGAINSSRPFQNASRHHMGECPKYAKKASLRLALGLRNTPSIEPRGLFGAIAGFXXXXXXXXXXXXXXXXXXXXXXXXXXXDQKSTQEAIEKITNKVNNIXXKMNREFEVVDHEFSXXEKKINMINDKINDQIEDLWAYXXXXXXXXXXXXTLDEHDSNVENLFDEVRRRLSTNAVDTGNGCFDIXXXXXXXXXXXIKNGTYNHKDYEEEAKLERSKINGVILEENTTYKIXXXXXXXXXXXXXXXXXXXXXXXXXXXXXXXXXXXX

SEQ ID NO: 419556 - protein, 567 aa, Influenza virus
  MOD_RES (1)..(9): Any amino acid
  MOD_RES (22)..(27): Any amino acid
  MOD_RES (75)..(86): Any amino acid
  MOD_RES (102)..(132): Any amino acid
  MOD_RES (143)..(148): Any amino acid
  MOD_RES (168)..(171): Any amino acid
  MOD_RES (183)..(183): Any amino acid
  MOD_RES (196)..(201): Any amino acid
  MOD_RES (212)..(218): Any amino acid
  MOD_RES (253)..(271): Any amino acid
  MOD_RES (291)..(292): Any amino acid
  MOD_RES (352)..(387): Any amino acid
  MOD_RES (407)..(418): Any amino acid
  MOD_RES (445)..(463): Any amino acid
  MOD_RES (490)..(496): Any amino acid
  MOD_RES (532)..(567): Any amino acid
XXXXXXXXXLLMSTNAYDRICXXXXXXNSTDTVNTLMEQNVPVTQTMELVETEKNPAYCNTDLGSPLELRDCKIXXXXXXXXXXXXHLKDQAWSYIVERPSXXXXXXXXXXXXXXXXXXXXXXXXXXXXXXXLFDYSKWNVSXXXXXXACNASTGGQAFYRSINWLTXXXXPDTYDFNEGSYXNNKDGDIIFLWGXXXXXXAKEQTALYKNXXXXXXXTTNTINRSFRPNIGPRPLVRGQQGWMDYYWGILKXXXXXXXXXXXXXXXXXXXYLLKGESHGKIIQNEDIPIXXCYTKCQTYAGAINSSKPFQNTSRHYMGECPNYVKKESLRLALGLRNTPSVEPRGLFGAIXXXXXXXXXXXXXXXXXXXXXXXXXXXXXXXXXXXXEAIDKITNKINNIVDKMNRXXXXXXXXXXXXEKRTNMINDKIDDQIEELWAYNAELLXXXXXXXXXXXXXXXXXXXFDEVRRRLSVNAIDTGKGCFDILHKCXXXXXXXIKNGTYDHKDYEEEAKLERSKINGVRLEENTTYKIXXXXXXXXXXXXXXXXXXXXXXXXXXXXXXXXXXXX

SEQ ID NO: 419557 - protein, 567 aa, Influenza virus
  MOD_RES (1)..(171): Any amino acid
  MOD_RES (183)..(298): Any amino acid
  MOD_RES (310)..(325): Any amino acid
  MOD_RES (344)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDTYDFNEGTYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYTGAINSSRPXXXXXXXXXXXXXXXXKKESLRLAIGLRNTPSIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419558 - protein, 567 aa, Influenza virus
  MOD_RES (1)..(171): Any amino acid
  MOD_RES (183)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDTYDFNEGAYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419559 - protein, 567 aa, Influenza virus
  MOD_RES (1)..(171): Any amino acid
  MOD_RES (183)..(567): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPDIYDFNEGSYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419560 - protein, 562 aa, Influenza virus
  MOD_RES (12)..(26): Any amino acid
  MOD_RES (37)..(77): Any amino acid
  MOD_RES (89)..(246): Any amino acid
  MOD_RES (267)..(323): Any amino acid
  MOD_RES (334)..(339): Any amino acid
  MOD_RES (372)..(425): Any amino acid
  MOD_RES (452)..(471): Any amino acid
  MOD_RES (486)..(487): Any amino acid
  MOD_RES (498)..(520): Any amino acid
  MOD_RES (538)..(562): Any amino acid
RWKHVTNTILLXXXXXXXXXXXXXXXYQSTNSTETVXXXXXXXXXXXXXXXXXXXXXXXXXXXXXXXXXXXXXXXXXEGLIYGNPSCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRIRSNGNLIAPWYXXXXXXXXXXXXXXXXXXXXXXXXXXXXXXXXXXXXXXXXXXXXXXXXXXXXXXXXXSLKLAVGLRNXXXXXXRGLFGAIAGFIEGGWSGLVAGWYGFQHSNDQGXXXXXXXXXXXXXXXXXXXXXXXXXXXXXXXXXXXXXXXXXXXXXXXXXXXXXXDQIQDIWAYNAELLVLLENQKTLDEHXXXXXXXXXXXXXXXXXXXXEDGKGCFELYHKCDXXCMETIRNGTYXXXXXXXXXXXXXXXXXXXXXXXEGTYKILTIYSTVASSLXXXXXXXXXXXXXXXXXXXXXXXXX

SEQ ID NO: 419561 - protein, 562 aa, Influenza virus
  MOD_RES (1)..(26): Any amino acid
  MOD_RES (37)..(77): Any amino acid
  MOD_RES (89)..(246): Any amino acid
  MOD_RES (267)..(323): Any amino acid
  MOD_RES (334)..(339): Any amino acid
  MOD_RES (372)..(425): Any amino acid
  MOD_RES (452)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXXHQSTNSTETVXXXXXXXXXXXXXXXXXXXXXXXXXXXXXXXXXXXXXXXXXEGLVYGNPSCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRVRSNGNLIAPWFXXXXXXXXXXXXXXXXXXXXXXXXXXXXXXXXXXXXXXXXXXXXXXXXXXXXXXXXXSLKLAIGLRNXXXXXXRGIFGAIAGFIEGGWPGLVAGWYGFQHTNDQGXXXXXXXXXXXXXXXXXXXXXXXXXXXXXXXXXXXXXXXXXXXXXXXXXXXXXXDQIQDVWAYNAELLVLIENQKTLDEHXXXXXXXXXXXXXXXXXXXXEDGNGCFELYHKCNXXCMATIRNGTYXXXXXXXXXXXXXXXXXXXXXXXEGIYKILTIYSTAASSLXXXXXXXXXXXXXXXXXXXXXXXXX

SEQ ID NO: 419562 - protein, 562 aa, Influenza virus
  MOD_RES (1)..(26): Any amino acid
  MOD_RES (37)..(77): Any amino acid
  MOD_RES (89)..(246): Any amino acid
  MOD_RES (267)..(323): Any amino acid
  MOD_RES (334)..(348): Any amino acid
  MOD_RES (372)..(425): Any amino acid
  MOD_RES (452)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXXYQSTNSTEAVXXXXXXXXXXXXXXXXXXXXXXXXXXXXXXXXXXXXXXXXXEGLVYGNPACDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRVKSNGNLIAPLYXXXXXXXXXXXXXXXXXXXXXXXXXXXXXXXXXXXXXXXXXXXXXXXXXXXXXXXXXSLKLAVGMRNXXXXXXXXXXXXXXXFIEGGWSGLIAGWYGFQHSNAQGXXXXXXXXXXXXXXXXXXXXXXXXXXXXXXXXXXXXXXXXXXXXXXXXXXXXXXDQIQNIWAYNAELLVLLGNQKTLDEHXXXXXXXXXXXXXXXXXXXXEDGKGCFDLYHKCDXXCMGTIRNGTYXXXXXXXXXXXXXXXXXXXXXXXEETYKILTIYSTVASSIXXXXXXXXXXXXXXXXXXXXXXXXX

SEQ ID NO: 419563 - protein, 562 aa, Influenza virus
  MOD_RES (1)..(26): Any amino acid
  MOD_RES (37)..(78): Any amino acid
  MOD_RES (89)..(246): Any amino acid
  MOD_RES (267)..(323): Any amino acid
  MOD_RES (334)..(349): Any amino acid
  MOD_RES (372)..(425): Any amino acid
  MOD_RES (451)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXXYLSTNSTETVXXXXXXXXXXXXXXXXXXXXXXXXXXXXXXXXXXXXXXXXXXGLIYGNPSCNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRPGQTLRVRSDGNLIAPWYXXXXXXXXXXXXXXXXXXXXXXXXXXXXXXXXXXXXXXXXXXXXXXXXXXXXXXXXXSLKLAVGLKNXXXXXXXXXXXXXXXXIEGGWSGLVDGWYGFQHSNEQGXXXXXXXXXXXXXXXXXXXXXXXXXXXXXXXXXXXXXXXXXXXXXXXXXXXXXXDQIQDLWAYNAELLVLLENQKILDEXXXXXXXXXXXXXXXXXXXXXENGNGCFELYHRCDXXCMEAIRNGTYXXXXXXXXXXXXXXXXXXXXXXXEGAYKILTIYSTVASSFXXXXXXXXXXXXXXXXXXXXXXXXX

SEQ ID NO: 419564 - protein, 562 aa, Influenza virus
  MOD_RES (1)..(26): Any amino acid
  MOD_RES (37)..(78): Any amino acid
  MOD_RES (89)..(246): Any amino acid
  MOD_RES (262)..(323): Any amino acid
  MOD_RES (334)..(425): Any amino acid
  MOD_RES (437)..(437): Any amino acid
  MOD_RES (452)..(471): Any amino acid
  MOD_RES (482)..(487): Any amino acid
  MOD_RES (498)..(520): Any amino acid
  MOD_RES (538)..(562): Any amino acid
XXXXXXXXXXXXXXXXXXXXXXXXXXYQSTNSTEIVXXXXXXXXXXXXXXXXXXXXXXXXXXXXXXXXXXXXXXXXXXGLIYGNPFCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRIISNGNLXXXXXXXXXXXXXXXXXXXXXXXXXXXXXXXXXXXXXXXXXXXXXXXXXXXXXXXXXXXXXXSLKLAVGPRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRIQDIWAYNAXLLVLLENQKPLDEHXXXXXXXXXXXXXXXXXXXXEDGKGCSELYXXXXXXCMETTRNGTYXXXXXXXXXXXXXXXXXXXXXXXDGTYKILTIYSTVASPLXXXXXXXXXXXXXXXXXXXXXXXXX

SEQ ID NO: 419565 - protein, 562 aa, Influenza virus
  MOD_RES (1)..(248): Any amino acid
  MOD_RES (267)..(440): Any amino acid
  MOD_RES (451)..(472): Any amino acid
  MOD_RES (483)..(522): Any amino acid
  MOD_RES (537)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPSQTLRVRSNENLIAPWYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLENQKTLDDXXXXXXXXXXXXXXXXXXXXXXDGKGCFELHHXXXXXXXXXXXXXXXXXXXXXXXXXXXXXXXXXXXXXXXXIYKILSIYSTVASSXXXXXXXXXXXXXXXXXXXXXXXXXX

SEQ ID NO: 419566 - protein, 562 aa, Influenza virus
  MOD_RES (1)..(473): Any amino acid
  MOD_RES (485)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKGCFELYHRCXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419567 - protein, 562 aa, Influenza virus
  MOD_RES (1)..(473): Any amino acid
  MOD_RES (486)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKGCFELYHECDXXXXXXXXXXXXXXXXXXXXXXXXXXXXXXXXXXXXXXXXXXXXXXXXXXXXXXXXXXXXXXXXXXXXXXXXXXXXX

SEQ ID NO: 419568 - protein, 562 aa, Influenza virus
  MOD_RES (12)..(26): Any amino acid
  MOD_RES (37)..(77): Any amino acid
  MOD_RES (89)..(246): Any amino acid
  MOD_RES (267)..(323): Any amino acid
  MOD_RES (334)..(339): Any amino acid
  MOD_RES (372)..(424): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid
RWKHVTNTILLXXXXXXXXXXXXXXXYQSTNSTETVXXXXXXXXXXXXXXXXXXXXXXXXXXXXXXXXXXXXXXXXXEGLIYGNPSCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRIRSNGNLIAPWYXXXXXXXXXXXXXXXXXXXXXXXXXXXXXXXXXXXXXXXXXXXXXXXXXXXXXXXXXSLKLAVGLRNXXXXXXRGLFGAIAGFIEGGWSGLVAGWYGFQHSNDQGXXXXXXXXXXXXXXXXXXXXXXXXXXXXXXXXXXXXXXXXXXXXXXXXXXXXXDDQIQDIWAYNAELLVLLENQKTLDEHDXXXXXXXXXXXXXXXXXXXEDGKGCFELYHKCDXXCMETIRNGTYXXXXXXXXXXXXXXXXXXXXXXXEGTYKILTIYSTVASSLXXXXXXXXXXXXXXXXXXXXXXXXX

SEQ ID NO: 419569 - protein, 562 aa, Influenza virus
  MOD_RES (1)..(26): Any amino acid
  MOD_RES (37)..(77): Any amino acid
  MOD_RES (89)..(246): Any amino acid
  MOD_RES (267)..(323): Any amino acid
  MOD_RES (334)..(345): Any amino acid
  MOD_RES (372)..(424): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXXHQSTNSTETVXXXXXXXXXXXXXXXXXXXXXXXXXXXXXXXXXXXXXXXXXEGLVYGNPSCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRVRSNGNLIAPWFXXXXXXXXXXXXXXXXXXXXXXXXXXXXXXXXXXXXXXXXXXXXXXXXXXXXXXXXXSLKLAIGLRNXXXXXXXXXXXXIAGFIEGGWPGLVAGWYGFQHTNDQGXXXXXXXXXXXXXXXXXXXXXXXXXXXXXXXXXXXXXXXXXXXXXXXXXXXXXDDQIQDVWAYNAELLVLIENQKTLDEHEXXXXXXXXXXXXXXXXXXXEDGNGCFELYHKCNXXCMATIRNGTYXXXXXXXXXXXXXXXXXXXXXXXEGIYKILTIYSTAASSLXXXXXXXXXXXXXXXXXXXXXXXXX

SEQ ID NO: 419570 - protein, 562 aa, Influenza virus
  MOD_RES (1)..(26): Any amino acid
  MOD_RES (37)..(77): Any amino acid
  MOD_RES (89)..(246): Any amino acid
  MOD_RES (267)..(323): Any amino acid
  MOD_RES (334)..(348): Any amino acid
  MOD_RES (372)..(424): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXXYQSTNSTEAVXXXXXXXXXXXXXXXXXXXXXXXXXXXXXXXXXXXXXXXXXEGLVYGNPACDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRVKSNGNLIAPLYXXXXXXXXXXXXXXXXXXXXXXXXXXXXXXXXXXXXXXXXXXXXXXXXXXXXXXXXXSLKLAVGMRNXXXXXXXXXXXXXXXFIEGGWSGLIAGWYGFQHSNAQGXXXXXXXXXXXXXXXXXXXXXXXXXXXXXXXXXXXXXXXXXXXXXXXXXXXXXDDQIQNIWAYNAELLVLLGNQKTLDEHDXXXXXXXXXXXXXXXXXXXEDGKGCFDLYHKCDXXCMGTIRNGTYXXXXXXXXXXXXXXXXXXXXXXXEETYKILTIYSTVASSIXXXXXXXXXXXXXXXXXXXXXXXXX

SEQ ID NO: 419571 - protein, 562 aa, Influenza virus
  MOD_RES (1)..(26): Any amino acid
  MOD_RES (37)..(78): Any amino acid
  MOD_RES (89)..(246): Any amino acid
  MOD_RES (262)..(323): Any amino acid
  MOD_RES (334)..(359): Any amino acid
  MOD_RES (372)..(424): Any amino acid
  MOD_RES (453)..(471): Any amino acid
  MOD_RES (486)..(487): Any amino acid
  MOD_RES (498)..(520): Any amino acid
  MOD_RES (538)..(562): Any amino acid
XXXXXXXXXXXXXXXXXXXXXXXXXXYLSTNSTETVXXXXXXXXXXXXXXXXXXXXXXXXXXXXXXXXXXXXXXXXXXGLIYGNPSCNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGQTLRIISNGNLXXXXXXXXXXXXXXXXXXXXXXXXXXXXXXXXXXXXXXXXXXXXXXXXXXXXXXXXXXXXXXSLKLAVGLKNXXXXXXXXXXXXXXXXXXXXXXXXXXGWYGFQHSNEQGXXXXXXXXXXXXXXXXXXXXXXXXXXXXXXXXXXXXXXXXXXXXXXXXXXXXXDDQIQDLWAYNAELLVLLENQKPLDEHDXXXXXXXXXXXXXXXXXXXENGNGCFELYHRCDXXCMEAIRNGTYXXXXXXXXXXXXXXXXXXXXXXXEGAYKILTIYSTVASSFXXXXXXXXXXXXXXXXXXXXXXXXX

SEQ ID NO: 419572 - protein, 562 aa, Influenza virus
  MOD_RES (1)..(26): Any amino acid
  MOD_RES (37)..(78): Any amino acid
  MOD_RES (89)..(246): Any amino acid
  MOD_RES (267)..(323): Any amino acid
  MOD_RES (334)..(424): Any amino acid
  MOD_RES (436)..(440): Any amino acid
  MOD_RES (451)..(471): Any amino acid
  MOD_RES (482)..(487): Any amino acid
  MOD_RES (498)..(520): Any amino acid
  MOD_RES (538)..(562): Any amino acid
XXXXXXXXXXXXXXXXXXXXXXXXXXYQSTNSTEIVXXXXXXXXXXXXXXXXXXXXXXXXXXXXXXXXXXXXXXXXXXGLIYGNPFCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRPGQTLRVRSDGNLIAPWYXXXXXXXXXXXXXXXXXXXXXXXXXXXXXXXXXXXXXXXXXXXXXXXXXXXXXXXXXSLKLAVGPRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDDRIQDIWAYNXXXXXLLENQKTLDDXXXXXXXXXXXXXXXXXXXXXEDGKGCSELYXXXXXXCMETTRNGTYXXXXXXXXXXXXXXXXXXXXXXXDGTYKILTIYSTVASPLXXXXXXXXXXXXXXXXXXXXXXXXX

SEQ ID NO: 419573 - protein, 562 aa, Influenza virus
  MOD_RES (1)..(248): Any amino acid
  MOD_RES (267)..(442): Any amino acid
  MOD_RES (453)..(472): Any amino acid
  MOD_RES (483)..(522): Any amino acid
  MOD_RES (537)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPSQTLRVRSNENLIAPWYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXENQKTLDEHVXXXXXXXXXXXXXXXXXXXXDGKGCFELHHXXXXXXXXXXXXXXXXXXXXXXXXXXXXXXXXXXXXXXXXIYKILSIYSTVASSXXXXXXXXXXXXXXXXXXXXXXXXXX

SEQ ID NO: 419574 - protein, 562 aa, Influenza virus; identical to SEQ ID NO: 419566
  MOD_RES (1)..(473): Any amino acid
  MOD_RES (485)..(562): Any amino acid

SEQ ID NO: 419575 - protein, 562 aa, Influenza virus; identical to SEQ ID NO: 419567
  MOD_RES (1)..(473): Any amino acid
  MOD_RES (486)..(562): Any amino acid

SEQ ID NO: 419576 - protein, 473 aa, Influenza virus
  MOD_RES (1)..(8): Any amino acid
  MOD_RES (19)..(51): Any amino acid
  MOD_RES (64)..(90): Any amino acid
  MOD_RES (103)..(132): Any amino acid
  MOD_RES (145)..(157): Any amino acid
  MOD_RES (173)..(174): Any amino acid
  MOD_RES (196)..(224): Any amino acid
  MOD_RES (237)..(273): Any amino acid
  MOD_RES (288)..(293): Any amino acid
  MOD_RES (307)..(319): Any amino acid
  MOD_RES (333)..(420): Any amino acid
  MOD_RES (436)..(457): Any amino acid
  MOD_RES (468)..(473): Any amino acid
XXXXXXXXIAIGSVSRTIXXXXXXXXXXXXXXXXXXXXXXXXXXXXXXXXXVPLVPCEPIIIEXXXXXXXXXXXXXXXXXXXXXXXXXXXWSKPQCQITGFAXXXXXXXXXXXXXXXXXXXXXXXXXXXXXXCYQFALGQGTTLXXXXXXXXXXXXXPHRTLLMNELGVPFHXXTKQVCIAWSSSSCHDGKAWLHXXXXXXXXXXXXXXXXXXXXXXXXXXXXXNILRTQESECVCXXXXXXXXXXXXXXXXXXXXXXXXXXXXXXXXXXXXXGSAQHVEECSCYPRXXXXXXVCRDNWKGSNRPVXXXXXXXXXXXXXYVCSGLVGDTPRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXCINRCFYVELIRGRPXXXXXXXXXXXXXXXXXXXXXXGTGSWPDGANXXXXXX

SEQ ID NO: 419577 - protein, 473 aa, Influenza virus
  MOD_RES (1)..(90): Any amino acid
  MOD_RES (103)..(132): Any amino acid
  MOD_RES (145)..(157): Any amino acid
  MOD_RES (173)..(174): Any amino acid
  MOD_RES (196)..(224): Any amino acid
  MOD_RES (237)..(273): Any amino acid
  MOD_RES (288)..(293): Any amino acid
  MOD_RES (307)..(319): Any amino acid
  MOD_RES (333)..(420): Any amino acid
  MOD_RES (436)..(457): Any amino acid
  MOD_RES (468)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWLKPQCQITGFVXXXXXXXXXXXXXXXXXXXXXXXXXXXXXXCYQFALGHGTTLXXXXXXXXXXXXXPYRTLLMSELGVPFHXXTKQVCMAWSSSSCHDGRAWLHXXXXXXXXXXXXXXXXXXXXXXXXXXXXXSILRTQESECICXXXXXXXXXXXXXXXXXXXXXXXXXXXXXXXXXXXXXGSAQHIEECSCYPRXXXXXXVCRDNWRGSNRPVXXXXXXXXXXXXXYLCSGLVGDTPRSXXXXXXXXXXXXXXXXXXXXXXXXXXXXXXXXXXXXXXXXXXXXXXXXXXXXXXXXXXXXXXXXXXXXXXXXXXXXXXXXXXXXXXXXCVNRCFYVELIRGKPXXXXXXXXXXXXXXXXXXXXXXGTGSWPDGADXXXXXX

SEQ ID NO: 419578 - protein, 473 aa, Influenza virus
  MOD_RES (1)..(90): Any amino acid
  MOD_RES (103)..(132): Any amino acid
  MOD_RES (145)..(157): Any amino acid
  MOD_RES (173)..(174): Any amino acid
  MOD_RES (195)..(224): Any amino acid
  MOD_RES (235)..(273): Any amino acid
  MOD_RES (288)..(293): Any amino acid
  MOD_RES (307)..(319): Any amino acid
  MOD_RES (330)..(421): Any amino acid
  MOD_RES (436)..(457): Any amino acid
  MOD_RES (468)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSKPQCQIAGFAXXXXXXXXXXXXXXXXXXXXXXXXXXXXXXCYQFALGQGATLXXXXXXXXXXXXXPHRTLLMSELGVPFYXXTRQVCIAWSSASCHDGRAWLXXXXXXXXXXXXXXXXXXXXXXXXXXXXXXTILRTQESECXXXXXXXXXXXXXXXXXXXXXXXXXXXXXXXXXXXXXXXGGAQHVEECSCYPQXXXXXXVYRDNWKGSNRPIXXXXXXXXXXXXXYFLDVFAGDTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINRCFYVELVRGRPXXXXXXXXXXXXXXXXXXXXXXGAGSWPDGANXXXXXX

SEQ ID NO: 419579 - protein, 473 aa, Influenza virus
  MOD_RES (1)..(90): Any amino acid
  MOD_RES (103)..(132): Any amino acid
  MOD_RES (144)..(157): Any amino acid
  MOD_RES (173)..(174): Any amino acid
  MOD_RES (196)..(224): Any amino acid
  MOD_RES (237)..(273): Any amino acid
  MOD_RES (288)..(293): Any amino acid
  MOD_RES (304)..(322): Any amino acid
  MOD_RES (333)..(424): Any amino acid
  MOD_RES (435)..(457): Any amino acid
  MOD_RES (468)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSKPQCLITGFAXXXXXXXXXXXXXXXXXXXXXXXXXXXXXXCNQFALGQGTTXXXXXXXXXXXXXXSYRTLLMSELGVPFNXXTQQVCIAWSSSSCYDGKAWLHXXXXXXXXXXXXXXXXXXXXXXXXXXXXXNILITQESECVCXXXXXXXXXXXXXXXXXXXXXXXXXXXXXXXXXXXXXGNAQHVEECSCYPSXXXXXXVHISPLSGSAXXXXXXXXXXXXXXXXXXXSGLVGDTPRDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCFYVELTRGRXXXXXXXXXXXXXXXXXXXXXXXGTGSWADGANXXXXXX

SEQ ID NO: 419580 - protein, 473 aa, Influenza virus
  MOD_RES (1)..(90): Any amino acid
  MOD_RES (101)..(157): Any amino acid
  MOD_RES (173)..(174): Any amino acid
  MOD_RES (196)..(224): Any amino acid
  MOD_RES (235)..(273): Any amino acid
  MOD_RES (286)..(293): Any amino acid
  MOD_RES (307)..(322): Any amino acid
  MOD_RES (333)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSKPQCHITGXXXXXXXXXXXXXXXXXXXXXXXXXXXXXXXXXXXXXXXXXXXXXXXXXXXXXXXXXSHRTLLMNELGVPLHXXTKQMCIAWSSSSCHDGKEWLHXXXXXXXXXXXXXXXXXXXXXXXXXXXXXNILRSQESECXXXXXXXXXXXXXXXXXXXXXXXXXXXXXXXXXXXXXXXGSAKHVEECSCYXXXXXXXXVCRDNWKGCNRPVXXXXXXXXXXXXXXXXSGLVGDTPRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419581 - protein, 473 aa, Influenza virus
  MOD_RES (1)..(91): Any amino acid
  MOD_RES (103)..(226): Any amino acid
  MOD_RES (237)..(277): Any amino acid
  MOD_RES (288)..(296): Any amino acid
  MOD_RES (307)..(322): Any amino acid
  MOD_RES (333)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKPQCQITGSAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRTQESDCVCXXXXXXXXXXXXXXXXXXXXXXXXXXXXXXXXXXXXXXXXXHIEECSCYPQXXXXXXXXXDNWKGSNRPDXXXXXXXXXXXXXXXXSGLVGDTPRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419582 - protein, 473 aa, Influenza virus
  MOD_RES (1)..(226): Any amino acid
  MOD_RES (237)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKTQEYECVCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419583 - protein, 275 aa, Influenza virus
  MOD_RES (143)..(145): Any amino acid
  MOD_RES (169)..(169): Any amino acid
  MOD_RES (210)..(214): Any amino acid
  MOD_RES (225)..(234): Any amino acid
MLKMSLLTEVETYVLSIVPSGPLKAEIAQRLEDVFAGKNTDLEALMEWLKTRPILSPLTKGILGFVFTLTVPSERGLQRRRFVQNALNGNGDPNNMDRAVKLYRKLKREITFHGAKEVALSYSTGALASCMGLIYNRMGTVTXXXAFGLVCATCEQIADSQHRSHRQMXTTTNPLIRHENRMVLASTTAKAMEQMAGSSEQAAEAMEVAXXXXXMVQAMRTIGTXXXXXXXXXXDLLENLQAYQKRMGVQMQRFKRPDSSWLFGGWNLALDIVDS

SEQ ID NO: 419584 - protein, 275 aa, Influenza virus
  MOD_RES (1)..(5): Any amino acid
  MOD_RES (50)..(52): Any amino acid
  MOD_RES (72)..(73): Any amino acid
  MOD_RES (143)..(145): Any amino acid
  MOD_RES (169)..(169): Any amino acid
  MOD_RES (210)..(214): Any amino acid
  MOD_RES (225)..(234): Any amino acid
  MOD_RES (256)..(256): Any amino acid
  MOD_RES (275)..(275): Any amino acid
XXXXXQLTEVETYVLSVIPSGPLKAEIAQKLEDVFAGKNADLEALMEWLXXXPILSPLTKGMLGFVFTLTVXXERGLQRRRFIQNALNGNGDPSNMDRAVKLYKKLKREITFHGAKEIALSYSAGALASCMGLIYNRMGAVTXXXAFGLICATCEQIADAQHRSHRQMXATTNPLIKHENRMVLASTTAKAMEQVAGSSEQAAEAIEVAXXXXXMVHAMRTIGTXXXXXXXXXXDLLENLQTYQKRMGVQMHRFKXSSRHCSKYHWNLALDIVDX

SEQ ID NO: 419585 - protein, 275 aa, Influenza virus
  MOD_RES (1)..(8): Any amino acid
  MOD_RES (50)..(56): Any amino acid
  MOD_RES (69)..(78): Any amino acid
  MOD_RES (129)..(131): Any amino acid
  MOD_RES (143)..(145): Any amino acid
  MOD_RES (169)..(169): Any amino acid
  MOD_RES (210)..(214): Any amino acid
  MOD_RES (225)..(234): Any amino acid
  MOD_RES (256)..(275): Any amino acid
XXXXXXXXEVETYVLSIIPSGPLKAEIAQRLESVFAGKNSDLEALMEWLXXXXXXXSLTKGVLGFVFTXXXXXXXXXXRRRFVQNALSGNGDPNNMDKAVKLYRKLKREMTFHGAKEVSLSYSTGALAXXXGLIYNRMGTITXXXALGLVCATCEQIADSHHRSHRQMXTITNPLIRHENRMVIASTTAKAMEQIAGSSEQAAEAMDIAXXXXXMVQAMRAIGTXXXXXXXXXXNLLENLQAYQNRMGVQLQRFKXXXXXXXXXXXXXXXXXXXX

SEQ ID NO: 419586 - protein, 275 aa, Influenza virus
  MOD_RES (1)..(23): Any amino acid
  MOD_RES (50)..(91): Any amino acid
  MOD_RES (131)..(132): Any amino acid
  MOD_RES (143)..(153): Any amino acid
  MOD_RES (169)..(169): Any amino acid
  MOD_RES (180)..(195): Any amino acid
  MOD_RES (209)..(214): Any amino acid
  MOD_RES (225)..(234): Any amino acid
  MOD_RES (256)..(275): Any amino acid
XXXXXXXXXXXXXXXXXXXXXXXKAEIAQRLEGVFAGKNTDLEVLMEWLXXXXXXXXXXXXXXXXXXXXXXXXXXXXXXXXXXXXXXXXXXDPNNMARAVKLYKKLKREMTFHGAKEVALGYSTGALASCXXLIYNRMGTVAXXXXXXXXXXXCEQIADSQHKSHRQMXATTNPLIRHEXXXXXXXXXXXXXXXXAGSNEQAAEAMEVXXXXXXMVQAMRTVGTXXXXXXXXXXDLIENLQAYQKRMGLQMQRFKXXXXXXXXXXXXXXXXXXXX

SEQ ID NO: 419587 - protein, 275 aa, Influenza virus
  MOD_RES (1)..(23): Any amino acid
  MOD_RES (39)..(39): Any amino acid
  MOD_RES (59)..(92): Any amino acid
  MOD_RES (104)..(106): Any amino acid
  MOD_RES (129)..(198): Any amino acid
  MOD_RES (210)..(214): Any amino acid
  MOD_RES (225)..(234): Any amino acid
  MOD_RES (265)..(275): Any amino acid
XXXXXXXXXXXXXXXXXXXXXXXKAEIAQRLENVFAGKXTDLEALMEWIKTRPILSPLXXXXXXXXXXXXXXXXXXXXXXXXXXXXXXXXXXPNNIDRAVKLYXXXKREITFYGAKEISLSYSAGALAXXXXXXXXXXXXXXXXXXXXXXXXXXXXXXXXXXXXXXXXXXXXXXXXXXXXXXXXXXXXXXXXXXXXXXSEQAAEAMEIAXXXXXMVQAMRAVGTXXXXXXXXXXDLLDNLQAYQKRMGVQLQRFRRPDSSWLFGXXXXXXXXXXX

SEQ ID NO: 419588 - protein, 275 aa, Influenza virus
  MOD_RES (1)..(33): Any amino acid
  MOD_RES (46)..(94): Any amino acid
  MOD_RES (108)..(108): Any amino acid
  MOD_RES (128)..(241): Any amino acid
  MOD_RES (256)..(275): Any amino acid
XXXXXXXXXXXXXXXXXXXXXXXXXXXXXXXXXVFSGKNTDLEALXXXXXXXXXXXXXXXXXXXXXXXXXXXXXXXXXXXXXXXXXXXXXXXXXNMDKAVKLYKKLKXEITFHRAKEVALSYSAGALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYQKRMGVQIQRFKXXXXXXXXXXXXXXXXXXXX

SEQ ID NO: 419589 - protein, 275 aa, Influenza virus
  MOD_RES (1)..(108): Any amino acid
  MOD_RES (119)..(246): Any amino acid
  MOD_RES (261)..(275): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEITFHGSKEVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMGVQMQRFRRPDSSXXXXXXXXXXXXXXX

SEQ ID NO: 419590 - protein, 99 aa, Influenza virus
  MOD_RES (11)..(67): Any amino acid
  MOD_RES (78)..(89): Any amino acid
MSLLTEVETPXXXXXXXXXXXXXXXXXXXXXXXXXXXXXXXXXXXXXXXXXXXXXXXXXXXXXXXXXGVPESMREEYXXXXXXXXXXXXDHFVSIELEG

SEQ ID NO: 419591 - protein, 99 aa, Influenza virus
  MOD_RES (11)..(67): Any amino acid
  MOD_RES (78)..(89): Any amino acid
MSLLTEVETLXXXXXXXXXXXXXXXXXXXXXXXXXXXXXXXXXXXXXXXXXXXXXXXXXXXXXXXXXGVPKSMREEYXXXXXXXXXXXXGHFVNIELED

SEQ ID NO: 419592 - protein, 99 aa, Influenza virus
  MOD_RES (11)..(67): Any amino acid
  MOD_RES (78)..(99): Any amino acid
MSLLTEVETHXXXXXXXXXXXXXXXXXXXXXXXXXXXXXXXXXXXXXXXXXXXXXXXXXXXXXXXXXGIPESMREEYXXXXXXXXXXXXXXXXXXXXXX

SEQ ID NO: 419593 - protein, 99 aa, Influenza virus
  MOD_RES (11)..(67): Any amino acid
  MOD_RES (78)..(99): Any amino acid
MSQLTEVETPXXXXXXXXXXXXXXXXXXXXXXXXXXXXXXXXXXXXXXXXXXXXXXXXXXXXXXXXXGMPESMREEYXXXXXXXXXXXXXXXXXXXXXX

SEQ ID NO: 419594 - protein, 99 aa, Influenza virus
  MOD_RES (1)..(9): Any amino acid
  MOD_RES (20)..(99): Any amino acid
XXXXXXXXXRPTRNGWGCKXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419595 - protein, 527 aa, Influenza virus
  MOD_RES (35)..(38): Any amino acid
  MOD_RES (68)..(68): Any amino acid
  MOD_RES (116)..(130): Any amino acid
  MOD_RES (146)..(146): Any amino acid
  MOD_RES (304)..(306): Any amino acid
  MOD_RES (328)..(338): Any amino acid
  MOD_RES (367)..(379): Any amino acid
  MOD_RES (393)..(399): Any amino acid
  MOD_RES (421)..(422): Any amino acid
  MOD_RES (445)..(455): Any amino acid
  MOD_RES (479)..(480): Any amino acid
  MOD_RES (496)..(497): Any amino acid
SKSRVDNHSMSDIEAMASQGTKRSYEQMETGGERXXXXTEIRASVGRMVGGIGRFYIQMCTELKLSDXEGRLIQNSITIERMVLSAFDERRNKYLEEHPSAGKDPKKTGGPIYRRXXXXXXXXXXXXXXXEIRRIWRQANNGEDAXAGLTHIMIWHSNLNDATYQRTRALVRTGMDPRMCSLMQGSTLPRRSGAAGAAVKGVGTMVMELIRMIKRGINDRNFWRGENGRRTRIAYERMCNILKGKFQTAAQQRAMMDQVRESRNPGNAEIEDLIFLARSALILRGSVSVAHKSCLPACVYGLAXXXGYDFEREGYSLVGIDPFKLLQXXXXXXXXXXXRPNENPAHKSQLVWMACHSAAFEDLRVSXXXXXXXXXXXXXLSTRGVQIASNENXXXXXXXTLELRSRYWAIRTRSGGNTNQXXASAGQISVQPTFSVQRNLPFERXXXXXXXXXXXEGRTSDMRTEIIEIIIRMMENARXXDVSFQGRGVFELSDEXXATNPIVPSFDMSNEGSYFFGDNAEEYRRLR

SEQ ID NO: 419596 - protein, 527 aa, Influenza virus
  MOD_RES (1)..(9): Any amino acid
  MOD_RES (35)..(38): Any amino acid
  MOD_RES (68)..(68): Any amino acid
  MOD_RES (116)..(130): Any amino acid
  MOD_RES (146)..(146): Any amino acid
  MOD_RES (183)..(189): Any amino acid
  MOD_RES (304)..(306): Any amino acid
  MOD_RES (328)..(338): Any amino acid
  MOD_RES (367)..(379): Any amino acid
  MOD_RES (393)..(399): Any amino acid
  MOD_RES (421)..(422): Any amino acid
  MOD_RES (445)..(455): Any amino acid
  MOD_RES (468)..(480): Any amino acid
  MOD_RES (496)..(497): Any amino acid
  MOD_RES (524)..(527): Any amino acid
XXXXXXXXXMSDINIMASQGTKRSHEQMETGGERXXXXTEIRASVGKMIDGIGRFYIQMCTELQLSDXEGRLIQNSLTIEKMVLSAFDERRNRYLEEHPSAGRDPKKTGGPIYKRXXXXXXXXXXXXXXXEIRRVWRQANNGEDSXAGLTHLMIWHSNLNDTTYQRTRALVRSGMDPRMCSLXXXXXXXRRSGAAGAAIKGVGTMAMELIRMIKRGVNDRNFWRGENGRKTRVAYERMCNILSKGSSKQQHKRAMVDQVRESRNPGNAEIEDLTFLARSALILRGAVSIAHKSCLPACAYGPAXXXGHDFEREGYSLVGVDPFKLLQXXXXXXXXXXXRSNENPAHKSQLIWMACHSAAFEDLRLLXXXXXXXXXXXXXLSTRGVQVASNENXXXXXXXTLELRSGYWAIRTRSGGNTSQXXASAGQTSVQPAFSVQRNLPFDKXXXXXXXXXXXEGRTSDMRAEIIXXXXXXXXXXXXXDLSFQGRGVFEFSDEXXATNPIVPSFEMSNEGSYFFGDSAEEYXXXX

SEQ ID NO: 419597 - protein, 527 aa, Influenza virus
  MOD_RES (1)..(9): Any amino acid
  MOD_RES (35)..(38): Any amino acid
  MOD_RES (68)..(68): Any amino acid
  MOD_RES (89)..(90): Any amino acid
  MOD_RES (116)..(130): Any amino acid
  MOD_RES (146)..(146): Any amino acid
  MOD_RES (162)..(192): Any amino acid
  MOD_RES (243)..(243): Any amino acid
  MOD_RES (288)..(289): Any amino acid
  MOD_RES (304)..(306): Any amino acid
  MOD_RES (328)..(338): Any amino acid
  MOD_RES (367)..(379): Any amino acid
  MOD_RES (393)..(399): Any amino acid
  MOD_RES (421)..(422): Any amino acid
  MOD_RES (445)..(456): Any amino acid
  MOD_RES (468)..(480): Any amino acid
  MOD_RES (495)..(497): Any amino acid
  MOD_RES (524)..(527): Any amino acid
XXXXXXXXXMSDIEIMASQGTKRPYEQMETDGDRXXXXTEIRSSVGKMISGIGRFYIQMCTELKLNDXDGRLIQNSITVERMVLSAFDXXRNKYLEEHPNAGKDPKKTGGPIYKKXXXXXXXXXXXXXXXEIMRIWRQANNGDDAXAGLTHMMIWHSNLNDXXXXXXXXXXXXXXXXXXXXXXXXXXXXXXXGAAGAAVKGIGTMVMELIRMVKRGINDRNFWRGDNGRRTRSAYERMCNILXKGKFQTAAQRAMMDQVREGRNPGNAEIEDLIFSARSALILRGSIXXAHKSCLPACIYGLVXXXGYDFEKEGYSLVGIDPFRLLQXXXXXXXXXXXRPKENPAHKSQLVWMACNSAAFEDLRVLXXXXXXXXXXXXXLSTRGIQIASNENXXXXXXXTLELRSKYWAIRTRSGGNNNQXXASAGQISTQPTFSVQRNLPFEKXXXXXXXXXXXXGRTSDMRTEVIXXXXXXXXXXXXXEVSFRGRGVFELSDXXXAANPIVPSFDMNNEGSYFFGDNAKEYXXXX

SEQ ID NO: 419598 - protein, 527 aa, Influenza virus
  MOD_RES (1)..(9): Any amino acid
  MOD_RES (35)..(38): Any amino acid
  MOD_RES (67)..(68): Any amino acid
  MOD_RES (81)..(90): Any amino acid
  MOD_RES (108)..(130): Any amino acid
  MOD_RES (146)..(146): Any amino acid
  MOD_RES (157)..(195): Any amino acid
  MOD_RES (217)..(230): Any amino acid
  MOD_RES (243)..(243): Any amino acid
  MOD_RES (304)..(306): Any amino acid
  MOD_RES (328)..(338): Any amino acid
  MOD_RES (355)..(355): Any amino acid
  MOD_RES (367)..(379): Any amino acid
  MOD_RES (391)..(408): Any amino acid
  MOD_RES (421)..(422): Any amino acid
  MOD_RES (440)..(462): Any amino acid
  MOD_RES (473)..(480): Any amino acid
  MOD_RES (491)..(497): Any amino acid
  MOD_RES (523)..(527): Any amino acid
XXXXXXXXXMSDIEAMATQGTKRSYEQMETDGERXXXXTEIRTSVGRMVGGIGRFYVQMCTELKLNXXEGRLIQNSMTIEXXXXXXXXXXRNRYLEENPSAGKDPKKXXXXXXXXXXXXXXXXXXXXXXXEVRRIWRQANSGEDAXSGLTHIMIWHXXXXXXXXXXXXXXXXXXXXXXXXXXXXXXXXXXXXXXXGAAVKGVGTIVLELIRMIKRGXXXXXXXXXXXXXXTRTAYERMCNILXKGKFQTAAQKAMMDQVRESRSPGNAEIEDLIFMARSALILRGRGSVAHKSCLPACVYGPAXXXGYNFEKEGYSLVGVDPFRLLQXXXXXXXXXXXRPNENPVHKSQLIWMAXHSAAFEDLRISXXXXXXXXXXXXXLATRGVQIASNXXXXXXXXXXXXXXXXXXAIRTKSGGNTNQXXASAGQISIQPTFSVQRNXXXXXXXXXXXXXXXXXXXXXXXRRAEIIKMESXXXXXXXXEVSFQGRGVFXXXXXXXATSPIVPSFDMSKEGSYFFGDNAEDXXXXX

SEQ ID NO: 419599 - protein, 527 aa, Influenza virus
  MOD_RES (1)..(11): Any amino acid
  MOD_RES (35)..(38): Any amino acid
  MOD_RES (68)..(69): Any amino acid
  MOD_RES (81)..(91): Any amino acid
  MOD_RES (111)..(130): Any amino acid
  MOD_RES (146)..(195): Any amino acid
  MOD_RES (220)..(230): Any amino acid
  MOD_RES (243)..(246): Any amino acid
  MOD_RES (262)..(267): Any amino acid
  MOD_RES (304)..(320): Any amino acid
  MOD_RES (334)..(343): Any amino acid
  MOD_RES (355)..(379): Any amino acid
  MOD_RES (391)..(410): Any amino acid
  MOD_RES (421)..(422): Any amino acid
  MOD_RES (445)..(466): Any amino acid
  MOD_RES (477)..(480): Any amino acid
  MOD_RES (492)..(497): Any amino acid
  MOD_RES (511)..(513): Any amino acid
  MOD_RES (524)..(527): Any amino acid
XXXXXXXXXXXDIGAMASQGTKRSYEQMETSGERXXXXNEIRASVGRMIGGIGKFYIQMCTELKLSEXXGRLVQNSITIEXXXXXXXXXXXNKYLEEHPSTGKDPKKTGGXXXXXXXXXXXXXXXXXXXXELRRIWRQANNGEEAXXXXXXXXXXXXXXXXXXXXXXXXXXXXXXXXXXXXXXXXXXXXXXXXXXGAAIKGIGTMVMELVRMIKRGINDXXXXXXXXXXXTRGAYERMCNILXXXXFQTAAQRAMVDQVREXXXXXXAEIEDLIFLTRSASALILRGSVAHKSCLPACVYGLVXXXXXXXXXXXXXXXXXDPDPFRLLQNSQVXXXXXXXXXXPVHKSQLVWMAXXXXXXXXXXXXXXXXXXXXXXXXXLTTRGVQIASNXXXXXXXXXXXXXXXXXXXXRTRSGGNTNHXXASAGQVSVQPTFSVQRSLPFERXXXXXXXXXXXXXXXXXXXXXXTEIIIRMMENXXXXEMSFQGRGVFEXXXXXXATNPVVPSFDMSNXXXYFFGDNAEEFXXXX

SEQ ID NO: 419600 - protein, 527 aa, Influenza virus
  MOD_RES (1)..(15): Any amino acid
  MOD_RES (33)..(56): Any amino acid
  MOD_RES (67)..(132): Any amino acid
  MOD_RES (144)..(280): Any amino acid
  MOD_RES (297)..(322): Any amino acid
  MOD_RES (334)..(486): Any amino acid
  MOD_RES (497)..(507): Any amino acid
  MOD_RES (518)..(527): Any amino acid
XXXXXXXXXXXXXXXMALQGTKRSYEQMETGEXXXXXXXXXXXXXXXXXXXXXXXXVQMCTELKLSXXXXXXXXXXXXXXXXXXXXXXXXXXXXXXXXXXXXXXXXXXXXXXXXXXXXXXXXXXXXXXXXXXRRNWRQANNGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSALILRGSIAHKSCLPXXXXXXXXXXXXXXXXXXXXXXXXXXDPFKLLQNSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRGQGHLDEKXXXXXXXXXXXISNEGSYFFGXXXXXXXXXX

SEQ ID NO: 419601 - protein, 527 aa, Influenza virus
  MOD_RES (1)..(25): Any amino acid
  MOD_RES (37)..(280): Any amino acid
  MOD_RES (294)..(322): Any amino acid
  MOD_RES (334)..(487): Any amino acid
  MOD_RES (500)..(527): Any amino acid
XXXXXXXXXXXXXXXXXXXXXXXXXSEQMETGGERQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSALILRGAVAHKSXXXXXXXXXXXXXXXXXXXXXXXXXXXXXDPFKLLQTSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGVFELSDEKATXXXXXXXXXXXXXXXXXXXXXXXXXXXX

SEQ ID NO: 419602 - protein, 527 aa, Influenza virus
  MOD_RES (1)..(26): Any amino acid
  MOD_RES (37)..(322): Any amino acid
  MOD_RES (334)..(487): Any amino acid
  MOD_RES (500)..(527): Any amino acid
XXXXXXXXXXXXXXXXXXXXXXXXXXEQMETDGDRQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPFRLLQSSQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGVFELSDERATXXXXXXXXXXXXXXXXXXXXXXXXXXXX

SEQ ID NO: 419603 - protein, 527 aa, Influenza virus
  MOD_RES (1)..(26): Any amino acid
  MOD_RES (37)..(323): Any amino acid
  MOD_RES (334)..(487): Any amino acid
  MOD_RES (500)..(527): Any amino acid
XXXXXXXXXXXXXXXXXXXXXXXXXXEQMETDGERQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFKLLQNSQIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGVFEFSDERAAXXXXXXXXXXXXXXXXXXXXXXXXXXXX

SEQ ID NO: 419604 - protein, 527 aa, Influenza virus
  MOD_RES (1)..(26): Any amino acid
  MOD_RES (37)..(325): Any amino acid
  MOD_RES (336)..(489): Any amino acid
  MOD_RES (500)..(527): Any amino acid
XXXXXXXXXXXXXXXXXXXXXXXXXXEQMETSGERQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRLLQNSQVFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFELSDEKAAXXXXXXXXXXXXXXXXXXXXXXXXXXXX

SEQ ID NO: 419605 - protein, 527 aa, Influenza virus
  MOD_RES (1)..(489): Any amino acid
  MOD_RES (500)..(527): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFELSDERAAXXXXXXXXXXXXXXXXXXXXXXXXXXXX

SEQ ID NO: 419606 - protein, 308 aa, Influenza virus
  MOD_RES (37)..(44): Any amino acid
  MOD_RES (58)..(58): Any amino acid
  MOD_RES (72)..(74): Any amino acid
  MOD_RES (92)..(123): Any amino acid
  MOD_RES (138)..(183): Any amino acid
  MOD_RES (195)..(222): Any amino acid
  MOD_RES (233)..(262): Any amino acid
  MOD_RES (282)..(284): Any amino acid
MLFVQSYFQLFLVCVSLLQSAILSLQQVDCFLWHVRXXXXXXXXGDAPFLDRLRRDQXDRLRRDQKSLRGRXXXPMRTPIAFLTSSIVCPGXXXXXXXXXXXXXXXXXXXXXXXXXXXXXXXXIASVPASRYLIDMTXXXXXXXXXXXXXXXXXXXXXXXXXXXXXXXXXXXXXXXXXXXXXXAGVETMVILSAXXXXXXXXXXXXXXXXXXXXXXXXXXXXNWPSSSGGLEXXXXXXXXXXXXXXXXXXXXXXXXXXXXXXSRNGKWREQLSQKFEEIRWXXXEVRGDQMAHCNSFEQITFMQALQL

SEQ ID NO: 419607 - protein, 308 aa, Influenza virus
  MOD_RES (1)..(23): Any amino acid
  MOD_RES (36)..(44): Any amino acid
  MOD_RES (67)..(124): Any amino acid
  MOD_RES (138)..(284): Any amino acid
  MOD_RES (304)..(308): Any amino acid
XXXXXXXXXXXXXXXXXXXXXXXSSFQVDCFLWHVXXXXXXXXXSDAPFLDRLRQANLCRFLETRTXXXXXXXXXXXXXXXXXXXXXXXXXXXXXXXXXXXXXXXXXXXXXXXXXXXXXXXXXXASVPASRYLTDMTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVRHRLKITENSFEQITFMXXXXX

SEQ ID NO: 419608 - protein, 308 aa, Influenza virus
  MOD_RES (1)..(23): Any amino acid
  MOD_RES (37)..(44): Any amino acid
  MOD_RES (58)..(58): Any amino acid
  MOD_RES (72)..(124): Any amino acid
  MOD_RES (137)..(284): Any amino acid
  MOD_RES (297)..(308): Any amino acid
XXXXXXXXXXXXXXXXXXXXXXXTSFQVDCYLWHIRXXXXXXXXCDAPFDDRLRRDQXDRLRRDQRSLRGRXXXXXXXXXXXXXXXXXXXXXXXXXXXXXXXXXXXXXXXXXXXXXXXXXXXXXLKMPASRYLTDMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVRRDQMAHCRMXXXXXXXXXXXX

SEQ ID NO: 419609 - protein, 308 aa, Influenza virus
  MOD_RES (1)..(23): Any amino acid
  MOD_RES (37)..(44): Any amino acid
  MOD_RES (58)..(58): Any amino acid
  MOD_RES (72)..(125): Any amino acid
  MOD_RES (138)..(308): Any amino acid
XXXXXXXXXXXXXXXXXXXXXXXLSFQVDCFLWHIRXXXXXXXXGDAPFLDRIRRDQXDRLRRDQKALKGRXXXXXXXXXXXXXXXXXXXXXXXXXXXXXXXXXXXXXXXXXXXXXXXXXXXXXXSKITLKFAFNMMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419610 - protein, 308 aa, Influenza virus; identical to SEQ ID NO: 419159
  MOD_RES (1)..(23): Any amino acid
  MOD_RES (37)..(44): Any amino acid
  MOD_RES (58)..(58): Any amino acid
  MOD_RES (72)..(308): Any amino acid

SEQ ID NO: 419611 - protein, 308 aa, Influenza virus
  MOD_RES (1)..(25): Any amino acid
  MOD_RES (37)..(47): Any amino acid
  MOD_RES (58)..(58): Any amino acid
  MOD_RES (72)..(308): Any amino acid
XXXXXXXXXXXXXXXXXXXXXXXXXFQVDCFLWYVRXXXXXXXXXXXPFLDRVRRDQXDRIRRDQKSLKGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419612 - protein, 308 aa, Influenza virus
  MOD_RES (1)..(49): Any amino acid
  MOD_RES (64)..(308): Any amino acid
XXXXXXXXXXXXXXXXXXXXXXXXXXXXXXXXXXXXXXXXXXXXXXXXXSLLLLQANLCRFLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419613 - protein, 308 aa, Influenza virus
  MOD_RES (1)..(49): Any amino acid
  MOD_RES (61)..(308): Any amino acid
XXXXXXXXXXXXXXXXXXXXXXXXXXXXXXXXXXXXXXXXXXXXXXXXXSSLLLQANLCRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419614 - protein, 205 aa, Influenza virus
  MOD_RES (97)..(100): Any amino acid
  MOD_RES (111)..(168): Any amino acid
  MOD_RES (203)..(205): Any amino acid
TAFSGMSANGDILMQYLLFQDILMRMSADQELGDAPFLDRLRRDQKSLRGRGSTLGLDIRTATREGKHIVERILEEESDEALKMTIASDILTRMSKXXXXRPHPEDLNGMXXXXXXXXXXXXXXXXXXXXXXXXXXXXXXXXXXXXXXXXXXXXXXXXXXXXXXXXXXTENSFEQITFMQALQLLLEVEQEIRTFSFQLILIXXX

SEQ ID NO: 419615 - protein, 205 aa, Influenza virus
  MOD_RES (1)..(13): Any amino acid
  MOD_RES (37)..(82): Any amino acid
  MOD_RES (97)..(168): Any amino acid
XXXXXXXXXXXXXFQYLLFQDILRKRFADQELGDAPXXXXXXXXXXXXXXXXXXXXXXXXXXXXXXXXXXXXXXXXXXXXXXKMTIASDILKRMSKXXXXXXXXXXXXXXXXXXXXXXXXXXXXXXXXXXXXXXXXXXXXXXXXXXXXXXXXXXXXXXXXXXXXXXXXTESSFEQITFMQALQLLFEVEQEIRAFSFQLINNKKP

SEQ ID NO: 419616 - protein, 205 aa, Influenza virus
  MOD_RES (1)..(13): Any amino acid
  MOD_RES (33)..(169): Any amino acid
  MOD_RES (201)..(205): Any amino acid
XXXXXXXXXXXXXFQVDCFLWHVRKRFADQELXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXENSFEQITFLQALQLLLEVESEIRTFSFQFIXXXXX

SEQ ID NO: 419617 - protein, 205 aa, Influenza virus
  MOD_RES (1)..(169): Any amino acid
  MOD_RES (204)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXENSFEQITFIQALQLLLEVENEIRTFSFQLINNKXX

SEQ ID NO: 419618 - protein, 205 aa, Influenza virus
  MOD_RES (1)..(186): Any amino acid
  MOD_RES (203)..(205): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVEQEMRTFSFQLILLXXX

SEQ ID NO: 419619 - protein, 734 aa, Influenza virus
  MOD_RES (27)..(30): Any amino acid
  MOD_RES (58)..(66): Any amino acid
  MOD_RES (86)..(101): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (315)..(352): Any amino acid
  MOD_RES (363)..(370): Any amino acid
  MOD_RES (387)..(410): Any amino acid
  MOD_RES (428)..(428): Any amino acid
  MOD_RES (467)..(467): Any amino acid
  MOD_RES (534)..(568): Any amino acid
  MOD_RES (623)..(636): Any amino acid
  MOD_RES (728)..(734): Any amino acid
MEDFVRQCFNPMIVELAEKAMKEYGEXXXXETNKFAAICTHLEVCFMYSDFHFIDERXXXXXXXXXDPNALLKHRFEIIEGRDRTXXXXXXXXXXXXXXXXKPKFLPDLYDYKENRFIEIGVTRREVHIYYLEKANKIKSEKTHIHIFSFTGEEMATKXDYTLDEESRARIKKTRLFTIRQEMASRGLWDSFRQSERGEETIEERFEIXXXXXXXLADQSLPPNFSXXXXFRAYVDGFEPNGCIEGKLSQMSKXXXXXXXXXXXXXXXXXXXXXXXXCSQRSKFLLMDALKLSIEDPSHEGEGEGIPLYDAIKCXXXXXXXXXXXXXXXXXXXXXXXXXXXXXXXXXXXXXXLKDEEKIPKTXXXXXXXXLKWALGENMAPEKVDFXXXXXXXXXXXXXXXXXXXXXXXXWIQSEFNKACELTDSSWXWIELDEIGEDVAPIEHIASMRRNYFTAEVSHCRATEYIXMKGVYINTALLNASCAAMDDFQLIPMISKCRTKEGRRKTNLYGFIIKGRSHLRNDTDVVNFVSMEFXXXXXXXXXXXXXXXXXXXXXXXXXXXXXXXXXXXPMFLYVRTNGTSKIKMKWGMEMRRCLLQSLQQIESMIEAESSVKEKDMTKEFFEXXXXXXXXXXXXXXVEEGSIGKVCRTLLAKSVFNSLYASPQLEGFSAESRKLLLIVQALRDNLEPGTFDLGGLYEAIEECLINDPWVLLNASWFNSFLTHALRFLXXXXXXX

SEQ ID NO: 419620 - protein, 734 aa, Influenza virus
  MOD_RES (27)..(30): Any amino acid
  MOD_RES (58)..(66): Any amino acid
  MOD_RES (86)..(101): Any amino acid
  MOD_RES (159)..(159): Any amino acid
  MOD_RES (173)..(173): Any amino acid
  MOD_RES (209)..(215): Any amino acid
  MOD_RES (227)..(230): Any amino acid
  MOD_RES (253)..(277): Any amino acid
  MOD_RES (315)..(370): Any amino acid
  MOD_RES (387)..(410): Any amino acid
  MOD_RES (428)..(428): Any amino acid
  MOD_RES (467)..(467): Any amino acid
  MOD_RES (515)..(518): Any amino acid
  MOD_RES (534)..(568): Any amino acid
  MOD_RES (623)..(636): Any amino acid
  MOD_RES (708)..(711): Any amino acid
  MOD_RES (732)..(734): Any amino acid
MENFVRQCFNPMVVELAEKTMKEYGEXXXXETNKLAAICTHLEICFMYSDFHFINEQXXXXXXXXXDSNALLKHRFEIIEGRDRIXXXXXXXXXXXXXXXXKPRFLPDLYDYKEDRFVEIGVTRREIHIYYLEKASKIKSENTHIHIFSFNGEEMATKXDYTIDEESRARIKXTRLFTIRQELASRSLWDSFRQSERGEDTIEERFEIXXXXXXXLANQSLPPNFSXXXXFRAYVDGFKPNGCIEGKLSQMPXXXXXXXXXXXXXXXXXXXXXXXXXCHQRSKFLLMDSLKLSIEDPNHEGEGEGIPLHDAIKCXXXXXXXXXXXXXXXXXXXXXXXXXXXXXXXXXXXXXXXXXXXXXXXXXXXXXXXXLRWALGENMAPEKMDFXXXXXXXXXXXXXXXXXXXXXXXXWIQNEFNKACELTDSIWXWLELDEIGEDIAPIEHVASMRRNYFTAEISHCRATEYIXMKGVYVNTALLNASCAAMEDFQLIPMISKSRTKEGRRRTNLYGFIIKXXXXLRNDTDVVNYVSMEFXXXXXXXXXXXXXXXXXXXXXXXXXXXXXXXXXXXPMFLYIRTNGTSKIKMKWGMELRRCLLQSLQQIESIIEAESSVKEKDLTKEFFEXXXXXXXXXXXXXXVEESSIGKVCRTLLAKSVFNCLYASPQLEGFSAESRKMLLIVQALRDSLEPGTFDLEGLYESIEECLINDPXXXXNASWFNSFLAHALKLVVAMLXXX

SEQ ID NO: 419621 - protein, 734 aa, Influenza virus
  MOD_RES (27)..(30): Any amino acid
  MOD_RES (47)..(47): Any amino acid
  MOD_RES (58)..(66): Any amino acid
  MOD_RES (86)..(101): Any amino acid
  MOD_RES (159)..(159): Any amino acid
  MOD_RES (209)..(215): Any amino acid
  MOD_RES (227)..(230): Any amino acid
  MOD_RES (254)..(277): Any amino acid
  MOD_RES (289)..(289): Any amino acid
  MOD_RES (302)..(302): Any amino acid
  MOD_RES (315)..(370): Any amino acid
  MOD_RES (387)..(410): Any amino acid
  MOD_RES (428)..(428): Any amino acid
  MOD_RES (467)..(467): Any amino acid
  MOD_RES (534)..(568): Any amino acid
  MOD_RES (592)..(595): Any amino acid
  MOD_RES (623)..(636): Any amino acid
  MOD_RES (707)..(711): Any amino acid
  MOD_RES (727)..(734): Any amino acid
MEGFVRQCFNPMTVELAERAMKEYGEXXXXETNKFASICTHLEVCFXYSDFHFINERXXXXXXXXXDPNVLLKHRFEIIEGRDRNXXXXXXXXXXXXXXXXKPRYLPDLYDYKESRFLEIGVTRREVHTYYLEKANKIKTEETHIHIFSFTGEEMASKXEYTLDEESRAARIKTRLFTIRQEMANKGLWDSFRQSERGEETVEERFEIXXXXXXXLANYSLPPNFSXXXXFRVYVDGFEPNGYIEGKLSQMSRXXXXXXXXXXXXXXXXXXXXXXXXCYQRSKFLLMDXLKLSIEDPDHEGXGEGIPLYDAVRCXXXXXXXXXXXXXXXXXXXXXXXXXXXXXXXXXXXXXXXXXXXXXXXXXXXXXXXXLKWVLGENMAPEKIDFXXXXXXXXXXXXXXXXXXXXXXXXWVQNEFNKACELTDSVWXWMELDEIGEDLAPIEYIASMRRDYFTAEVSYCRATEYIXMKGVYMNTALLNASCAAMDEFQLIPMISKCKTKEGRRKTNLYGFIVKGRSHLRNDTDVVNFLSMEFXXXXXXXXXXXXXXXXXXXXXXXXXXXXXXXXXXXPIFLYVRTNGTSKVKMKWGMEMRXXXXQSLQQIESMVEAESSVKEKDMTREFFEXXXXXXXXXXXXXXVEDGSIGKVCRTLLAKSVFNNLYASSQLEGFSAESRKLLLVVQAFRDNLEPGTFDIGGLYDAIEECLINDXXXXXNASWFNSFLVHALKSXXXXXXXX

SEQ ID NO: 419622 - protein, 734 aa, Influenza virus
  MOD_RES (27)..(30): Any amino acid
  MOD_RES (58)..(66): Any amino acid
  MOD_RES (86)..(101): Any amino acid
  MOD_RES (135)..(140): Any amino acid
  MOD_RES (159)..(159): Any amino acid
  MOD_RES (170)..(175): Any amino acid
  MOD_RES (209)..(216): Any amino acid
  MOD_RES (227)..(230): Any amino acid
  MOD_RES (249)..(277): Any amino acid
  MOD_RES (289)..(289): Any amino acid
  MOD_RES (302)..(303): Any amino acid
  MOD_RES (315)..(370): Any amino acid
  MOD_RES (384)..(410): Any amino acid
  MOD_RES (428)..(428): Any amino acid
  MOD_RES (467)..(467): Any amino acid
  MOD_RES (510)..(524): Any amino acid
  MOD_RES (543)..(568): Any amino acid
  MOD_RES (580)..(597): Any amino acid
  MOD_RES (623)..(636): Any amino acid
  MOD_RES (667)..(668): Any amino acid
  MOD_RES (707)..(711): Any amino acid
MEEFVRQCFNPMIIELAEKAMKEHGEXXXXETNKFAAVCTHMEVCFMYSDFHFIDEQXXXXXXXXXDPNTLLKHRFEIIEGRDRAXXXXXXXXXXXXXXXXKPKYLPDLYDYKKNRFTEIGVTRREVHVYYLEKXXXXXXERTHIHIFSFIGEEMATKXDYILDEESRAXXXXXXLFTIRQEMAIRGLWDPFRQSERGEETIEEKFEIXXXXXXXXADQSLPPNFPXXXXFRTYVDGFEPNGSIEGKLXXXXXXXXXXXXXXXXXXXXXXXXXXXXXCFQRSKFLLMDXLKLSIENPSHEGXXEGIPLYDAVKCXXXXXXXXXXXXXXXXXXXXXXXXXXXXXXXXXXXXXXXXXXXXXXXXXXXXXXXXLKWTLGENMAPEKXXXXXXXXXXXXXXXXXXXXXXXXXXXWVQSEFNKACELTDSTWXWVELDEIGEDVAPIEYVASMRRSYFTAEVSHCRATEYMXMKGVYINTAMLNASCAAMDDYQLIPMISKCRTREGRRKTNLYXXXXXXXXXXXXXXXGSLNFVSMEFSLTDPRLEXXXXXXXXXXXXXXXXXXXXXXXXXXPLFLYVRTNGTXXXXXXXXXXXXXXXXXXLQQVESMIEAESSIKEKDMTKDFFEXXXXXXXXXXXXXXMEEGSIGKVCRALLAKSVFNSIYASPQLEGXXAESRKLLLIAQALKDNLEPGTFDIEGLYGAIEECLINDXXXXXNASWFNSFLIHALRELWQCYYLL

SEQ ID NO: 419623 - protein, 734 aa, Influenza virus
  MOD_RES (24)..(32): Any amino acid
  MOD_RES (58)..(101): Any amino acid
  MOD_RES (115)..(119): Any amino acid
  MOD_RES (135)..(140): Any amino acid
  MOD_RES (159)..(163): Any amino acid
  MOD_RES (186)..(200): Any amino acid
  MOD_RES (211)..(230): Any amino acid
  MOD_RES (254)..(289): Any amino acid
  MOD_RES (302)..(370): Any amino acid
  MOD_RES (382)..(416): Any amino acid
  MOD_RES (428)..(428): Any amino acid
  MOD_RES (465)..(467): Any amino acid
  MOD_RES (490)..(490): Any amino acid
  MOD_RES (507)..(525): Any amino acid
  MOD_RES (543)..(568): Any amino acid
  MOD_RES (579)..(602): Any amino acid
  MOD_RES (623)..(636): Any amino acid
  MOD_RES (647)..(650): Any amino acid
  MOD_RES (681)..(681): Any amino acid
  MOD_RES (692)..(695): Any amino acid
  MOD_RES (709)..(711): Any amino acid
  MOD_RES (723)..(734): Any amino acid
MGDFVRQCFNPMIAELAEKAMKEXXXXXXXXXNKFAAICTHMEVCFMYSDFHFINELXXXXXXXXXXXXXXXXXXXXXXXXXXXXXXXXXXXXXXXXXXXXKPKSLPDLYDYKEXXXXXIGVTRREVHMYYLEKXXXXXXEDTHIHIFSFTGEEMATRXXXXXASSKSRARIKTRLFTIRQEMAGXXXXXXXXXXXXXXXRSIEEKFEITXXXXXXXXXXXXXXXXXXXXFRTYVDGFKPNGCIESKLSQMSKXXXXXXXXXXXXXXXXXXXXXXXXXXXXXXXXXXXXLKLSIEEPSHEGXXXXXXXXXXXXXXXXXXXXXXXXXXXXXXXXXXXXXXXXXXXXXXXXXXXXXXXXXXXXXXXXXXXXXLMWALGENMAPXXXXXXXXXXXXXXXXXXXXXXXXXXXXXXXXXXXNKACELTGSSWXWIEFDEIGEDVAPIEHIASIRRNYFTTEVSHCRATEXXXIKGVYINTALLNSSCAAMDDFQXIPMISNCRTKEGRRRTXXXXXXXXXXXXXXXXXXXVVNFVSMEFSLTDPKLEXXXXXXXXXXXXXXXXXXXXXXXXXXSMFLYVRTNGXXXXXXXXXXXXXXXXXXXXXXXXSMIEAESSVREKDMTKEFFVXXXXXXXXXXXXXXIEEGSIGKVCXXXXAKSVFNSLYSSPQLEGFSAESRKLLLITQAXRDDLEPGTFDXXXXYEAVEECLINDPWXXXNASWFNSFLKHXXXXXXXXXXXX

SEQ ID NO: 419624 - protein, 734 aa, Influenza virus
  MOD_RES (1)..(2): Any amino acid
  MOD_RES (14)..(104): Any amino acid
  MOD_RES (115)..(130): Any amino acid
  MOD_RES (141)..(164): Any amino acid
  MOD_RES (177)..(236): Any amino acid
  MOD_RES (249)..(292): Any amino acid
  MOD_RES (311)..(374): Any amino acid
  MOD_RES (387)..(418): Any amino acid
  MOD_RES (430)..(434): Any amino acid
  MOD_RES (464)..(481): Any amino acid
  MOD_RES (493)..(495): Any amino acid
  MOD_RES (506)..(525): Any amino acid
  MOD_RES (543)..(652): Any amino acid
  MOD_RES (667)..(716): Any amino acid
  MOD_RES (731)..(734): Any amino acid
XXDFVRQCFSPMIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLPDLYDYKEXXXXXXXXXXXXXXXXYMEKANKIKSXXXXXXXXXXXXXXXXXXXXXXXXDEESRARIKTRLXXXXXXXXXXXXXXXXXXXXXXXXXXXXXXXXXXXXXXXXXXXXXXXXXXXXXXXXXXXXGFEPNGCIESKLXXXXXXXXXXXXXXXXXXXXXXXXXXXXXXXXXXXXXXXXXXXXKASKEPEVHEGEGIPLYDXXXXXXXXXXXXXXXXXXXXXXXXXXXXXXXXXXXXXXXXXXXXXXXXXXXXXXXXXXXXXXXXLGENIAPEKVDFXXXXXXXXXXXXXXXXXXXXXXXXXXXXXXXXKTAYELTDSSWXXXXXIGEDIAPIEYIASMRRSYFTEEVSHCRATXXXXXXXXXXXXXXXXXXCTAMDDFQLIPXXXKCRTKEGRRRXXXXXXXXXXXXXXXXXXXXVVNYVSMEFSLTDPRFEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSVFNSLYASSQLEGXXXXXXXXXXXXXXXXXXXXXXXXXXXXXXXXXXXXXXXXXXXXXXXXXXNSSLTHALRELWQCXXXX

SEQ ID NO: 419625 - protein, 734 aa, Influenza virus
  MOD_RES (1)..(294): Any amino acid
  MOD_RES (310)..(457): Any amino acid
  MOD_RES (473)..(525): Any amino acid
  MOD_RES (540)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPSHEGEGIPLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISKSRATEYIMKGVYXXXXXXXXXXXXXXXXXXXXXXXXXXXXXXXXXXXXXXXXXXXXXXXXXXXXXVVNFLSMEFSLTDPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419626 - protein, 734 aa, Influenza virus
  MOD_RES (1)..(294): Any amino acid
  MOD_RES (310)..(458): Any amino acid
  MOD_RES (471)..(532): Any amino acid
  MOD_RES (543)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPNHEGEGIPLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHCRATEYIMKGXXXXXXXXXXXXXXXXXXXXXXXXXXXXXXXXXXXXXXXXXXXXXXXXXXXXXXXXXXXXXXEFSLVDPRLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419627 - protein, 734 aa, Influenza virus
  MOD_RES (1)..(294): Any amino acid
  MOD_RES (310)..(458): Any amino acid
  MOD_RES (470)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEDPDHEGEGIPLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSYCRATEYIMKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419628 - protein, 734 aa, Influenza virus
  MOD_RES (1)..(294): Any amino acid
  MOD_RES (311)..(458): Any amino acid
  MOD_RES (473)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIENPSHEGEGIPLHDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHCRATEYMMKGVYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419629 - protein, 734 aa, Influenza virus
  MOD_RES (1)..(294): Any amino acid
  MOD_RES (310)..(462): Any amino acid
  MOD_RES (473)..(734): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIEEPSHEGEGIPLCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXATEYIIKGVYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419630 - protein, 829 aa, Influenza virus
  MOD_RES (13)..(14): Any amino acid
  MOD_RES (58)..(60): Any amino acid
  MOD_RES (112)..(115): Any amino acid
  MOD_RES (156)..(159): Any amino acid
  MOD_RES (174)..(182): Any amino acid
  MOD_RES (197)..(200): Any amino acid
  MOD_RES (213)..(217): Any amino acid
  MOD_RES (323)..(332): Any amino acid
  MOD_RES (365)..(391): Any amino acid
  MOD_RES (404)..(405): Any amino acid
  MOD_RES (437)..(440): Any amino acid
  MOD_RES (462)..(464): Any amino acid
  MOD_RES (576)..(594): Any amino acid
  MOD_RES (625)..(626): Any amino acid
  MOD_RES (667)..(684): Any amino acid
  MOD_RES (803)..(807): Any amino acid
MDVNPTLLFLKVXXPAQNAISTTFPYTGDPPYSHGTGTGYTMDTVNRTHQYSEKGKWXXXTETGAPQLNPIDGPLPEDNEPSGYAQTDCVLEAMAFLEESHPGIFENSCLEXXXXVQQTRVDKLTQGRQTYDWTLNRNQPAATALANTIEVFRSNXXXXNESGRLIDFLKDVMXXXXXXXXXITTHFQRKRRVRDNXXXXMVTQRTIGKKKQXXXXXSYLIRALTLNTMTKDAERGKLKRRAIATPGMQIRGFVYFVETLARSICEKLEQSGLPVGGNEKKAKLANVVRKMMTNSQDTELSFTITGDNTKWNENQNPRMFLAXXXXXXXXXXQPEWFRNILSMAPIMFSNKMARLGKGYMFESKXXXXXXXXXXXXXXXXXXXXXXXXXXXKIEKIEKIRPLLXXGTASLSPGMMMGMFNMLSTVLGVSILNLGQKXXXXTTYWWDGLQSSDDFALIVNAPXXXGIQAGVDRFYRTCKLVGINMSKKKSYINRTGTFEFTSFFYRYGFVANFSMELPSFGVSGINESADMSIGVTVIKNNMINNDLGPATAQMALQLFIKDYRYTYRCHRGDTQIXXXXXXXXXXXXXXXXXXXGLLVSDGGPNLYNIRNLHIPEVCLKWELMDXXYQGRLCNPLNPFVSHVGTRWMKIIRVGCVILLNPFVSHKEXXXXXXXXXXXXXXXXXXMEYDAVATTHSWIPKRNRSILNTSQRGISGQNHGICAVATTHSWVPILNTSQRGILEDEQMYQKCCNLFEKFFPSSSYRRPVGISSMVEAMVSRARIDARIDFESGRIGKKEEFSEIMXXXXXIEELRRQKSLIWLWLVLREKMP

SEQ ID NO: 419631 - protein, 829 aa, Influenza virus
  MOD_RES (1)..(1): Any amino acid
  MOD_RES (13)..(14): Any amino acid
  MOD_RES (26)..(36): Any amino acid
  MOD_RES (58)..(60): Any amino acid
  MOD_RES (74)..(77): Any amino acid
  MOD_RES (112)..(115): Any amino acid
  MOD_RES (141)..(141): Any amino acid
  MOD_RES (156)..(159): Any amino acid
  MOD_RES (174)..(182): Any amino acid
  MOD_RES (197)..(200): Any amino acid
  MOD_RES (213)..(217): Any amino acid
  MOD_RES (228)..(245): Any amino acid
  MOD_RES (273)..(284): Any amino acid
  MOD_RES (323)..(332): Any amino acid
  MOD_RES (365)..(405): Any amino acid
  MOD_RES (417)..(422): Any amino acid
  MOD_RES (437)..(440): Any amino acid
  MOD_RES (462)..(464): Any amino acid
  MOD_RES (503)..(514): Any amino acid
  MOD_RES (544)..(560): Any amino acid
  MOD_RES (576)..(594): Any amino acid
  MOD_RES (625)..(626): Any amino acid
  MOD_RES (642)..(684): Any amino acid
  MOD_RES (713)..(730): Any amino acid
  MOD_RES (803)..(807): Any amino acid
  MOD_RES (828)..(829): Any amino acid
XDVNPTLLFLEVXXPVQNAISTTFPXXXXXXXXXXXGTGYTMDTVSRTHQYSEKGRWXXXSETGAPQLNPVDGXXXXDNEPTGYAQTDCVLEAMALLEESHPGLFENSCLEXXXXIQQTRVDKLTQGRQTFDWTLNRNQPXATALANTIEIFRSNXXXXSESGRLIDFLKDVIXXXXXXXXXVTTHFQRKRRIRDNXXXXMITQRTIGKKKHXXXXXGYLIRALTLNXXXXXXXXXXXXXXXXXXPGMQIRGFVHFVEALARRICEKLEQSGXXXXXXXXXXXXANVVRKMMTSSQDTELSFTVTGDNTKWNENQNPRVFLAXXXXXXXXXXQPEWFRNVLSIAPIMFSNKMAKLGRGYMFESKXXXXXXXXXXXXXXXXXXXXXXXXXXXXXXXXXXXXXXXXXGAASLSPGMMMXXXXXXSTVLGVSVLNLGQKXXXXTIYWWDGLQSSDDFALILNAPXXXGIQAGVNRFYRTCKLVGINMSKRKSYINKTGTFEFTSFXXXXXXXXXXXXELPSFGVSGVNESADMSIGITVIKNNMINXXXXXXXXXXXXXXXXXDYRYTYRCHKGDTQIXXXXXXXXXXXXXXXXXXXGLLISDGGPNLYNIRNLHIPEAGLKWELMDXXYRGRLCNPLNPFVNHXXXXXXXXXXXXXXXXXXXXXXXXXXXXXXXXXXXXXXXXXXXIEYDAVATTHSWVPKRNRSILNTSQRGVXXXXXXXXXXXXXXXXXXILNTSQRGVLEDEQMYQKCCSLFEKFFPSSSYRRPIGISSMVEAMISRARIDARIDFESGRMGKKEFSEIMKXXXXXIEELRRQKWWVWLWLVLREKXX

SEQ ID NO: 419632 - protein, 829 aa, Influenza virus
  MOD_RES (1)..(1): Any amino acid
  MOD_RES (13)..(14): Any amino acid
  MOD_RES (26)..(44): Any amino acid
  MOD_RES (58)..(60): Any amino acid
  MOD_RES (88)..(89): Any amino acid
  MOD_RES (112)..(115): Any amino acid
  MOD_RES (133)..(144): Any amino acid
  MOD_RES (156)..(159): Any amino acid
  MOD_RES (174)..(182): Any amino acid
  MOD_RES (194)..(200): Any amino acid
  MOD_RES (213)..(217): Any amino acid
  MOD_RES (228)..(249): Any amino acid
  MOD_RES (273)..(286): Any amino acid
  MOD_RES (323)..(332): Any amino acid
  MOD_RES (364)..(405): Any amino acid
  MOD_RES (418)..(426): Any amino acid
  MOD_RES (437)..(440): Any amino acid
  MOD_RES (462)..(464): Any amino acid
  MOD_RES (497)..(526): Any amino acid
  MOD_RES (547)..(563): Any amino acid
  MOD_RES (576)..(594): Any amino acid
  MOD_RES (609)..(611): Any amino acid
  MOD_RES (625)..(626): Any amino acid
  MOD_RES (642)..(684): Any amino acid
  MOD_RES (722)..(734): Any amino acid
  MOD_RES (758)..(762): Any amino acid
  MOD_RES (793)..(829): Any amino acid
XDVNPTLLFLRVXXPAQNAISITFPXXXXXXXXXXXXXXXXXXXVNRTHQYSERGRWXXXTEIGAPQLNPIDGPLPKNNEPSGYAQTXXVLEAMAFLEKSHPGIFESSCLEXXXXVQQTRVDRLTQGRQTYDXXXXXXXXXXXXLANTIEVFRLNXXXXNESGRLMDFLKDVMXXXXXXXXXIVTHFQRKRRVXXXXXXXMVTQRTVGKKKQXXXXXNYLIRALTLNXXXXXXXXXXXXXXXXXXXXXXIRGFVYFVEALARCICEKLEQSGXXXXXXXXXXXXXXVVRKMMTNSRDTEISFTITGDNTKWNENQNPRIFLAXXXXXXXXXXQPGWFRNVLSVAPIMFSNKMARLGRGYMFESXXXXXXXXXXXXXXXXXXXXXXXXXXXXXXXXXXXXXXXXXXGTVSLSPGMMMGXXXXXXXXXGVSILNLGQRXXXXTSYWWDGLQSSDDFALIVNASXXXGVQAGVDRFYRICKLVGINMSKKKSYINKTGTXXXXXXXXXXXXXXXXXXXXXXXXXXXXXXSADMSIGVAVIKNNMVNNDLXXXXXXXXXXXXXXXXXYTYRCHRGDMQIXXXXXXXXXXXXXXXXXXXGLLVADGGPNLYNIXXXHIPEVCLKWDLMDXXYKGRLCNPLNPFVTHXXXXXXXXXXXXXXXXXXXXXXXXXXXXXXXXXXXXXXXXXXXVEYDAVATTHSWTPKRNRSILNSNAITRSGQNHGICAXXXXXXXXXXXXXNQRGILEDEQMYQRCCNLFEKFFXXXXXRRPVGISSMGEAMVSRARIDARVDFESGRIXXXXXXXXXXXXXXXXXXXXXXXXXXXXXXXXXXXXX

SEQ ID NO: 419633 - protein, 829 aa, Influenza virus
  MOD_RES (1)..(2): Any amino acid
  MOD_RES (13)..(46): Any amino acid
  MOD_RES (58)..(60): Any amino acid
  MOD_RES (112)..(115): Any amino acid
  MOD_RES (126)..(144): Any amino acid
  MOD_RES (156)..(163): Any amino acid
  MOD_RES (174)..(182): Any amino acid
  MOD_RES (194)..(200): Any amino acid
  MOD_RES (213)..(217): Any amino acid
  MOD_RES (233)..(249): Any amino acid
  MOD_RES (273)..(293): Any amino acid
  MOD_RES (306)..(312): Any amino acid
  MOD_RES (323)..(332): Any amino acid
  MOD_RES (343)..(344): Any amino acid
  MOD_RES (362)..(405): Any amino acid
  MOD_RES (416)..(440): Any amino acid
  MOD_RES (462)..(470): Any amino acid
  MOD_RES (490)..(528): Any amino acid
  MOD_RES (548)..(564): Any amino acid
  MOD_RES (576)..(611): Any amino acid
  MOD_RES (623)..(626): Any amino acid
  MOD_RES (642)..(703): Any amino acid
  MOD_RES (715)..(734): Any amino acid
  MOD_RES (761)..(762): Any amino acid
  MOD_RES (793)..(829): Any amino acid
XXVNPTLLFLKIXXXXXXXXXXXXXXXXXXXXXXXXXXXXXXXXXXRTHQYSERGKWXXXTETKAPQLNPIDGPLPDDNDPSGYAQTDCVLEAMAFLENSHPGIFENSCIEXXXXVQQTRMDKLTXXXXXXXXXXXXXXXXXXXLANTIEVFKSNXXXXXXXXRLIDFLKDVVXXXXXXXXXIITHFQRKRRVXXXXXXXMVTQRTIGKRKQXXXXXSYLIRTLTLNTMTKDXXXXXXXXXXXXXXXXXIRGFVYFVEILARNICEKLEQSGXXXXXXXXXXXXXXXXXXXXXNSQDTEISFTITXXXXXXXENQNPRVFLTXXXXXXXXXXQPKWFRNVLSXXPIMFSNKVARLGKGYMFXXXXXXXXXXXXXXXXXXXXXXXXXXXXXXXXXXXXXXXXXXXXGTAALSPGMMXXXXXXXXXXXXXXXXXXXXXXXXXTVYWWDGLQSSDDFALIVNALXXXXXXXXXDRFYRTCKLLGINMSKKKSXXXXXXXXXXXXXXXXXXXXXXXXXXXXXXXXXXXXXXXDMSIGVTVIRNNMINNDLGXXXXXXXXXXXXXXXXXTYRCHRGDTHIXXXXXXXXXXXXXXXXXXXXXXXXXXXXXXXXXXXXHIPEVCLKWGLXXXXYQGRLCNPMNPFVSHXXXXXXXXXXXXXXXXXXXXXXXXXXXXXXXXXXXXXXXXXXXXXXXXXXXXXXXXXXXXXXICNSNAITRSGXXXXXXXXXXXXXXXXXXXXSQKGILEDEQMYQKCCTLFEKFFPSSXXRRPVGISSMMEAMVSRARIDARVDSESGRIXXXXXXXXXXXXXXXXXXXXXXXXXXXXXXXXXXXXX

SEQ ID NO: 419634 - protein, 829 aa, Influenza virus
  MOD_RES (1)..(2): Any amino acid
  MOD_RES (13)..(60): Any amino acid
  MOD_RES (89)..(89): Any amino acid
  MOD_RES (112)..(163): Any amino acid
  MOD_RES (174)..(182): Any amino acid
  MOD_RES (197)..(200): Any amino acid
  MOD_RES (213)..(217): Any amino acid
  MOD_RES (230)..(249): Any amino acid
  MOD_RES (260)..(293): Any amino acid
  MOD_RES (306)..(312): Any amino acid
  MOD_RES (323)..(332): Any amino acid
  MOD_RES (343)..(440): Any amino acid
  MOD_RES (452)..(470): Any amino acid
  MOD_RES (481)..(532): Any amino acid
  MOD_RES (545)..(564): Any amino acid
  MOD_RES (576)..(631): Any amino acid
  MOD_RES (642)..(738): Any amino acid
  MOD_RES (754)..(766): Any amino acid
  MOD_RES (793)..(829): Any amino acid
XXVNPTLLFLKMXXXXXXXXXXXXXXXXXXXXXXXXXXXXXXXXXXXXXXXXXXXXXXXXTETGALQLNPIDGPLPVDNEPNGYAQTDXVLEAMAFLEDSHPGIFGNSCLEXXXXXXXXXXXXXXXXXXXXXXXXXXXXXXXXXXXXXXXXXXXXXXXXXXXXRLIDFLKDVTXXXXXXXXXVTTHFHRKRRVRDNXXXXMVTQRTMGKKKQXXXXXSYIIRALTLNTMXXXXXXXXXXXXXXXXXXXXIRGVVYFVETXXXXXXXXXXXXXXXXXXXXXXXXXXXXXXXXXXNSQDTEVSFTITXXXXXXXENQSPRMFLAXXXXXXXXXXQPDWFRNVLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTAYWWDGLQSSXXXXXXXXXXXXXXXXXXXNRFYRTCKLLXXXXXXXXXXXXXXXXXXXXXXXXXXXXXXXXXXXXXXXXXXXXXXXXXXXXGVTVIKNNMVNNXXXXXXXXXXXXXXXXXXXXTYRCHRGDAQIXXXXXXXXXXXXXXXXXXXXXXXXXXXXXXXXXXXXXXXXXXXXXXXXXXXXXXXXCNPLNPFVGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILEDERMYQKCCNLFXXXXXXXXXXXXXGISSMVEAMMSRARIDARIDFESGRVXXXXXXXXXXXXXXXXXXXXXXXXXXXXXXXXXXXXX

SEQ ID NO: 419635 - protein, 829 aa, Influenza virus
  MOD_RES (1)..(3): Any amino acid
  MOD_RES (15)..(96): Any amino acid
  MOD_RES (107)..(313): Any amino acid
  MOD_RES (332)..(335): Any amino acid
  MOD_RES (350)..(634): Any amino acid
  MOD_RES (651)..(829): Any amino acid
XXXINPTLLFLKVPXXXXXXXXXXXXXXXXXXXXXXXXXXXXXXXXXXXXXXXXXXXXXXXXXXXXXXXXXXXXXXXXXXXXXXXXXXXXXXXXXXLEESHPGIFGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQNQNPRMFLAMITYITRXXXXWFRNILSIAPIMFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHPRGLLEVGTRWMKIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419636 - protein, 829 aa, Influenza virus
  MOD_RES (1)..(4): Any amino acid
  MOD_RES (15)..(315): Any amino acid
  MOD_RES (332)..(336): Any amino acid
  MOD_RES (350)..(829): Any amino acid
XXXXNPTLLFLKIPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQNPRIFLAMITYITKXXXXXFRNALSIAPIMFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419637 - protein, 829 aa, Influenza virus
  MOD_RES (1)..(4): Any amino acid
  MOD_RES (15)..(315): Any amino acid
  MOD_RES (331)..(829): Any amino acid
XXXXHPTLLFLKVPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQNPRVFLAMITYITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419638 - protein, 829 aa, Influenza virus
  MOD_RES (1)..(4): Any amino acid
  MOD_RES (15)..(315): Any amino acid
  MOD_RES (332)..(829): Any amino acid
XXXXNPTLLFLEVPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQNPRVFLTMITYITRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419639 - protein, 829 aa, Influenza virus
  MOD_RES (1)..(4): Any amino acid
  MOD_RES (15)..(315): Any amino acid
  MOD_RES (328)..(829): Any amino acid
XXXXNPTLLFLKMPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNQSPRMFLAMITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419640 - protein, 829 aa, Influenza virus
  MOD_RES (1)..(8): Any amino acid
  MOD_RES (19)..(319): Any amino acid
  MOD_RES (331)..(829): Any amino acid
XXXXXXXXYFFLKVPVQNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTFLAMITYITXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419641 - protein, 780 aa, Influenza virus
  MOD_RES (73)..(101): Any amino acid
  MOD_RES (117)..(121): Any amino acid
  MOD_RES (132)..(139): Any amino acid
  MOD_RES (166)..(168): Any amino acid
  MOD_RES (197)..(210): Any amino acid
  MOD_RES (305)..(308): Any amino acid
  MOD_RES (351)..(353): Any amino acid
  MOD_RES (368)..(370): Any amino acid
  MOD_RES (381)..(382): Any amino acid
  MOD_RES (393)..(411): Any amino acid
  MOD_RES (459)..(491): Any amino acid
  MOD_RES (507)..(507): Any amino acid
  MOD_RES (572)..(583): Any amino acid
  MOD_RES (601)..(603): Any amino acid
  MOD_RES (674)..(675): Any amino acid
  MOD_RES (696)..(698): Any amino acid
  MOD_RES (723)..(731): Any amino acid
  MOD_RES (778)..(780): Any amino acid
SKSRSNIFNMERIKELRDLMSQSRTREILTKTTVDHMAIIKKYTSGRQERQEKNPALRMKWMMAMKYPITADXXXXXXXXXXXXXXXXXXXXXXXXXXXXXMVSPLAVTWWNRNGPXXXXXHYPKVYKTYFXXXXXXXXGTFGPVHFRNQVKIRRRVDINPGHADXXXAKEAQDVIMEVVFPNEVGARILTSESQLXXXXXXXXXXXXXXIAPLMVAYMLERELVRKTRFLPVAGGTSSVYIEVLHLTQGTCWEQMYTPGGEVRNDDVDQSLIIAARNIVRRAAVSADPLASLLEMCHSTQIGGXXXXDILRQNPTEEQAVDICKAAMGLRISSSFSFGGFTFKRTSGSSXXXEEEVLTGNLQTLKIXXXEGYEEFTMVGXXATAILRKATRXXXXXXXXXXXXXXXXXXXIVAMVFSQEDCMIKAVRGDLNFVNRANQRLNPMHQLLRHFQKDAKVLXXXXXXXXXXXXXXXXXXXXXXXXXXXXXXXXXRVSKMGVDEYSSTERXVVSIDRFLRVRDQRGNVLLSPEEVSETQGTEKLTITYSSSMMWEINGPESVLVNTYQWIIRNWEXXXXXXXXXXXXLYNKMEFEPFQSLVPKAXXXQYSGFVRTLFQQMRDVLGTFDTVQIIKLLPFAAAPPEQSRMQFSSLTVNVRGSGMRILVRGNSPVFNYNKXXKRLTVLGKDAGAGALAEDPDXXXAGVESAVLRGFLILGKEDKRYGPAXXXXXXXXXLAKGEKANVLIGQGDVVLVMKRKRDSSILTDSQTATKRIRMAINQCXXX

SEQ ID NO: 419642 - protein, 780 aa, Influenza virus
  MOD_RES (73)..(101): Any amino acid
  MOD_RES (117)..(121): Any amino acid
  MOD_RES (132)..(139): Any amino acid
  MOD_RES (166)..(168): Any amino acid
  MOD_RES (197)..(210): Any amino acid
  MOD_RES (222)..(224): Any amino acid
  MOD_RES (305)..(308): Any amino acid
  MOD_RES (351)..(353): Any amino acid
  MOD_RES (368)..(370): Any amino acid
  MOD_RES (381)..(382): Any amino acid
  MOD_RES (393)..(411): Any amino acid
  MOD_RES (432)..(433): Any amino acid
  MOD_RES (459)..(491): Any amino acid
  MOD_RES (507)..(507): Any amino acid
  MOD_RES (572)..(583): Any amino acid
  MOD_RES (601)..(603): Any amino acid
  MOD_RES (674)..(675): Any amino acid
  MOD_RES (687)..(698): Any amino acid
  MOD_RES (723)..(731): Any amino acid
  MOD_RES (757)..(760): Any amino acid
SESRSNIFNMERIKELRYLMLQSRTREILTRTTVDHMAIIKRYTSGTSGRQEKNPALRMKWMMAMRYPITADXXXXXXXXXXXXXXXXXXXXXXXXXXXXXMISPLAVTWWNRKGPXXXXXHYPKIYKTYFXXXXXXXXGTFGPVHFQNQVKIRRRVDTNPGHADXXXSKEAQDVIMEVVFPNEVGAKILTSESQLXXXXXXXXXXXXXXISPLMVAYMLEXXXVRKTRFLPVSGGTSSIYIEVLHLTQGACWEQLYTPGGEVKNDDVDQSLVIAARNIVRRATVSADPLASLLEMCHGTQIGGXXXXDILKQNPTEEQAVGICKAAMGLKISSSFSFGGFTFKRTKGSSXXXEEEMLTGNLQTLKLXXXEGYEEFTLVGXXATAILKKATRXXXXXXXXXXXXXXXXXXXVVAMVFSQEDRMIKAVRGDLXXVNRANQRLNTMHQLLRHFQKNAKVLXXXXXXXXXXXXXXXXXXXXXXXXXXXXXXXXXRISKMGVDEYSNAERXIVSIDRFLRVKDQQGNVLLSPEEVSEAQGTERLTITYSSSMMWEVNGPESVLVNTYQWVIRNWEXXXXXXXXXXXXLYNKIEFEPFQSLVPRAXXXRYSGFVRTLFQQMRDILGTFDTTQIIKLLPFASAPPEQSKMQFSSLTVNVRGTGMRILVRGNSPAFNYNKXXKRLTILGKDAGXXXXXXXXXXXXSGVESAVLRGFLIIGKEDRRYGPAXXXXXXXXXLTKGEKANVLIGQGDIVLVMKRKRDXXXXTDSQTATKRLRMAINWGRIV

SEQ ID NO: 419643 - protein, 780 aa, Influenza virus
  MOD_RES (16)..(18): Any amino acid
  MOD_RES (35)..(36): Any amino acid
  MOD_RES (73)..(101): Any amino acid
  MOD_RES (117)..(121): Any amino acid
  MOD_RES (132)..(139): Any amino acid
  MOD_RES (166)..(168): Any amino acid
  MOD_RES (179)..(180): Any amino acid
  MOD_RES (197)..(210): Any amino acid
  MOD_RES (305)..(308): Any amino acid
  MOD_RES (337)..(337): Any amino acid
  MOD_RES (351)..(353): Any amino acid
  MOD_RES (368)..(370): Any amino acid
  MOD_RES (381)..(382): Any amino acid
  MOD_RES (393)..(411): Any amino acid
  MOD_RES (431)..(446): Any amino acid
  MOD_RES (459)..(491): Any amino acid
  MOD_RES (507)..(507): Any amino acid
  MOD_RES (572)..(583): Any amino acid
  MOD_RES (598)..(603): Any amino acid
  MOD_RES (674)..(675): Any amino acid
  MOD_RES (687)..(698): Any amino acid
  MOD_RES (723)..(731): Any amino acid
  MOD_RES (744)..(746): Any amino acid
SKSRSIIFNMERIKEXXXLMSQSRTRGILTKTTVXXMAIIKKYTSARQERQEKNPSLRMKWMMAMKYPITAEXXXXXXXXXXXXXXXXXXXXXXXXXXXXXIVSPLAVTWWNRSGPXXXXXHYPKVYRTYFXXXXXXXXGIFGPVHFRNQIKIRRRVDINPGHSDXXXTKEAQDVIMEXXFPNEVGARIITSESQLXXXXXXXXXXXXXXIAPLMMAYMLERELVRKTRFLPVTGGTSSVYVEVLHLTQGTCWEQLYTPGGGVRNDDIDQSLIIAARSIVRRATVSADPLLSLLEMCHSTRIGGXXXXDILKHNPTEEQAVNICKAAMGMRISSSFXFGGFTFKRTNGSSXXXEEELLTGNLQTLRIXXXEGYEEFTIVGXXATAILRKATKXXXXXXXXXXXXXXXXXXXIVAMVFSQEECMIKAVRGDXXXXXXXXXXXXXXXXLLRHFQKDARVLXXXXXXXXXXXXXXXXXXXXXXXXXXXXXXXXXRVSKVGVDEYSSTEKXVVNIDRFLRVRDQQGNILLSPEEVSETQGIEKLTIIYSSSMMWEINGPDSVLVNTYQWIIKNWEXXXXXXXXXXXXLYNKVEFEPFQSLVXXXXXXLYSGFVRTLFQQMRDVIGTFDTAQIIKLLPFAAAPPKQSRMQFSSLAVNVRGSGMRVLIRGNSPVFNYNRXXKRLTIIGKDAGXXXXXXXXXXXXTGVESAVLRGFLILGREDKRYGPAXXXXXXXXXLARGEKANVLIGXXXVVLVMKRKRNSSILTDSQTATKRIRMATNECRII

SEQ ID NO: 419644 - protein, 780 aa, Influenza virus
  MOD_RES (1)..(20): Any amino acid
  MOD_RES (59)..(62): Any amino acid
  MOD_RES (73)..(101): Any amino acid
  MOD_RES (115)..(121): Any amino acid
  MOD_RES (132)..(139): Any amino acid
  MOD_RES (166)..(168): Any amino acid
  MOD_RES (179)..(183): Any amino acid
  MOD_RES (197)..(224): Any amino acid
  MOD_RES (248)..(252): Any amino acid
  MOD_RES (273)..(274): Any amino acid
  MOD_RES (304)..(308): Any amino acid
  MOD_RES (338)..(340): Any amino acid
  MOD_RES (351)..(354): Any amino acid
  MOD_RES (368)..(370): Any amino acid
  MOD_RES (381)..(382): Any amino acid
  MOD_RES (393)..(411): Any amino acid
  MOD_RES (425)..(447): Any amino acid
  MOD_RES (459)..(491): Any amino acid
  MOD_RES (506)..(507): Any amino acid
  MOD_RES (570)..(583): Any amino acid
  MOD_RES (598)..(620): Any amino acid
  MOD_RES (674)..(675): Any amino acid
  MOD_RES (686)..(698): Any amino acid
  MOD_RES (723)..(731): Any amino acid
  MOD_RES (742)..(764): Any amino acid
  MOD_RES (775)..(780): Any amino acid
XXXXXXXXXXXXXXXXXXXXSLSRTREILTKITVDHMAIIKHNQEYTSGRQEKNPSLRXXXXMAMKYPITANXXXXXXXXXXXXXXXXXXXXXXXXXXXXXMVSPLAITWWNRNXXXXXXXHYSKVYKTYFXXXXXXXXGTFGPVHFRSQVKIRRRVDVNPGHADXXXVKEAQDVIMEXXXXXEVGARILASESQLXXXXXXXXXXXXXXXXXXXXXXXXXXXXVRKTRFLPVVGGTGSVYIEVLHLXXXXXWEQMYTPGGGVKNDDIDQSLXXAARNIVRRAIVSADPLASLLEMCHSTQVGXXXXXDILRQNPSEEQAVDICKAAIGLRISSSFSXXXFTFKRTKGFSXXXXEEVLTGNLQALKIXXXEGFEEFTMVGXXATAIIRKATRXXXXXXXXXXXXXXXXXXXIVAIVFSQEDCMIXXXXXXXXXXXXXXXXXXXXXXXLRHFQKDAKILXXXXXXXXXXXXXXXXXXXXXXXXXXXXXXXXXRVSKTGVDEYSSTEXXAVSIDRFLRVRDQLGNILLSPEEVSETQGMEKLTITYSSPMMWEINGPESVLINTYQWIIRNXXXXXXXXXXXXXXLYNKLEFEPFQSLVXXXXXXXXXXXXXXXXXXXXXXXGTFDTIQIIKLLPFAAAPPVQSKMQFSSLTVSVRGSGMRILIRGNSPIFNYNKXXRRLTVLGKDAXXXXXXXXXXXXXGGVESAVLRGFLILGKENKRYGPAXXXXXXXXXIAKGEKANVLXXXXXXXXXXXXXXXXXXXXXXXTATKRIRLAIXXXXXX

SEQ ID NO: 419645 - protein, 780 aa, Influenza virus
  MOD_RES (1)..(21): Any amino acid
  MOD_RES (32)..(40): Any amino acid
  MOD_RES (51)..(121): Any amino acid
  MOD_RES (132)..(139): Any amino acid
  MOD_RES (166)..(186): Any amino acid
  MOD_RES (197)..(228): Any amino acid
  MOD_RES (248)..(252): Any amino acid
  MOD_RES (277)..(281): Any amino acid
  MOD_RES (297)..(312): Any amino acid
  MOD_RES (338)..(340): Any amino acid
  MOD_RES (351)..(356): Any amino acid
  MOD_RES (367)..(370): Any amino acid
  MOD_RES (381)..(382): Any amino acid
  MOD_RES (393)..(413): Any amino acid
  MOD_RES (434)..(447): Any amino acid
  MOD_RES (459)..(491): Any amino acid
  MOD_RES (507)..(507): Any amino acid
  MOD_RES (524)..(527): Any amino acid
  MOD_RES (558)..(587): Any amino acid
  MOD_RES (601)..(620): Any amino acid
  MOD_RES (653)..(653): Any amino acid
  MOD_RES (674)..(675): Any amino acid
  MOD_RES (686)..(707): Any amino acid
  MOD_RES (731)..(767): Any amino acid
  MOD_RES (778)..(780): Any amino acid
XXXXXXXXXXXXXXXXXXXXXQPRTREILTKXXXXXXXXXGHNQEYTSGRXXXXXXXXXXXXXXXXXXXXXXXXXXXXXXXXXXXXXXXXXXXXXXXXXXXXXXXXXXXXXXXXXXXXXXXHYPKVYKPYFXXXXXXXXGAFGPVHFRNQVKIRRRVDMNPGHADXXXXXXXXXXXXXXXXXXXXXARILTSESQMXXXXXXXXXXXXXXXXXXXXXXXXXXXXXXXXRFLPVAGGTGSIYIEVLHLXXXXXWEQMYTPGGKVRNDEVDQSLIIAAXXXXXRATVSADPLVSLLEMXXXXXXXXXXXXXXXXQNPTEEQAVNICKAALGLRISSSFSXXXFTFKRTSGTSXXXXXXVLTGNLQTLRXXXXEGYEEFTMIGXXATAIFRKATRXXXXXXXXXXXXXXXXXXXXXAMVFSQEDCVVKAVRGDLNFXXXXXXXXXXXXXXLRHFQKDAKMLXXXXXXXXXXXXXXXXXXXXXXXXXXXXXXXXXRVSRMGVDEYSSAERXTVSIDRFLRVRDQMGNXXXXPEEISETQGTEKLTITYSSSLMWEINGPESXXXXXXXXXXXXXXXXXXXXXXXXXXXXXXMEFEPFQSLIPKAXXXXXXXXXXXXXXXXXXXXGTFDTVQVIKLLPFAAAPPVQSRMQFSSLTVSXRGSGLRILVRGNSPVFNYSKXXKRLAVLGKDAXXXXXXXXXXXXXXXXXXXXXXGFLILGKEDRKRYGPALSINELSXXXXXXXXXXXXXXXXXXXXXXXXXXXXXXXXXXXXXKRIRMAINLVXXX

SEQ ID NO: 419646 - protein, 780 aa, Influenza virus
  MOD_RES (1)..(43): Any amino acid
  MOD_RES (55)..(234): Any amino acid
  MOD_RES (245)..(256): Any amino acid
  MOD_RES (267)..(312): Any amino acid
  MOD_RES (324)..(357): Any amino acid
  MOD_RES (368)..(414): Any amino acid
  MOD_RES (433)..(496): Any amino acid
  MOD_RES (507)..(520): Any amino acid
  MOD_RES (531)..(627): Any amino acid
  MOD_RES (638)..(640): Any amino acid
  MOD_RES (668)..(712): Any amino acid
  MOD_RES (723)..(767): Any amino acid
  MOD_RES (780)..(780): Any amino acid
XXXXXXXXXXXXXXXXXXXXXXXXXXXXXXXXXXXXXXXXXXXKKYTSGRQEKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGTSSMYIEVXXXXXXXXXXXXYTPGGEVINDXXXXXXXXXXXXXXXXXXXXXXXXXXXXXXXXXXXXXXXXXXXXXXQNPTEEQAVEIXXXXXXXXXXXXXXXXXXXXXXXXXXXXXXXXXXLTGNLQTLKVXXXXXXXXXXXXXXXXXXXXXXXXXXXXXXXXXXXXXXXXXXXXXXXMVFSQEDCMVKAVRGDLNXXXXXXXXXXXXXXXXXXXXXXXXXXXXXXXXXXXXXXXXXXXXXXXXXXXXXXXXXXXXXXXXGVDEYSNAEKXXXXXXXXXXXXXXRGNILLSPEEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIIKMLPFAAAXXXQNRMQFSSLTVNVRGSGLRILIRGNSPXXXXXXXXXXXXXXXXXXXXXXXXXXXXXXXXXXXXXXXXXXXXXGKENKKYGPAXXXXXXXXXXXXXXXXXXXXXXXXXXXXXXXXXXXXXXXXXXXXXKRIRMAINWGRIX

SEQ ID NO: 419647 - protein, 780 aa, Influenza virus
  MOD_RES (1)..(43): Any amino acid
  MOD_RES (59)..(262): Any amino acid
  MOD_RES (273)..(318): Any amino acid
  MOD_RES (330)..(414): Any amino acid
  MOD_RES (433)..(643): Any amino acid
  MOD_RES (654)..(713): Any amino acid
  MOD_RES (731)..(767): Any amino acid
  MOD_RES (778)..(780): Any amino acid
XXXXXXXXXXXXXXXXXXXXXXXXXXXXXXXXXXXXXXXXXXXKKYTSARQEKNPALRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKNDEVDQSLXXXXXXXXXXXXXXXXXXXXXXXXXXXXXXXXXXXXXXXXXXXXXXQAVDICKAALGXXXXXXXXXXXXXXXXXXXXXXXXXXXXXXXXXXXXXXXXXXXXXXXXXXXXXXXXXXXXXXXXXXXXXXXXXXXXXXXXXXXXXMVFSQEDCMMKAVRGDLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMQFSSFTVNVXXXXXXXXXXXXXXXXXXXXXXXXXXXXXXXXXXXXXXXXXXXXXXXXXXXXXXXXXXXXQKKDKRYGPALSISELSXXXXXXXXXXXXXXXXXXXXXXXXXXXXXXXXXXXXXKRIRMAINYSXXX

SEQ ID NO: 419648 - protein, 780 aa, Influenza virus
  MOD_RES (1)..(714): Any amino acid
  MOD_RES (731)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEDKRYGPALSINELGXXXXXXXXXXXXXXXXXXXXXXXXXXXXXXXXXXXXXXXXXXXXXXXXXX

SEQ ID NO: 419649 - protein, 780 aa, Influenza virus
  MOD_RES (1)..(714): Any amino acid
  MOD_RES (728)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEDRRYGPALSINXXXXXXXXXXXXXXXXXXXXXXXXXXXXXXXXXXXXXXXXXXXXXXXXXXXXX

SEQ ID NO: 419650 - protein, 780 aa, Influenza virus
  MOD_RES (1)..(714): Any amino acid
  MOD_RES (725)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXREDKRYGPALXXXXXXXXXXXXXXXXXXXXXXXXXXXXXXXXXXXXXXXXXXXXXXXXXXXXXXXX

SEQ ID NO: 419651 - protein, 780 aa, Influenza virus
  MOD_RES (1)..(714): Any amino acid
  MOD_RES (727)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKENKRYGPALSIXXXXXXXXXXXXXXXXXXXXXXXXXXXXXXXXXXXXXXXXXXXXXXXXXXXXXX

SEQ ID NO: 419652 - protein, 780 aa, Influenza virus
  MOD_RES (1)..(714): Any amino acid
  MOD_RES (729)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKENKKYGPALSINEXXXXXXXXXXXXXXXXXXXXXXXXXXXXXXXXXXXXXXXXXXXXXXXXXXXX

SEQ ID NO: 419653 - protein, 780 aa, Influenza virus
  MOD_RES (1)..(717): Any amino acid
  MOD_RES (728)..(780): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRYGPALSISXXXXXXXXXXXXXXXXXXXXXXXXXXXXXXXXXXXXXXXXXXXXXXXXXXXXX

SEQ ID NO: 419654 - protein, 742 aa, Influenza virus
  MOD_RES (13)..(14): Any amino acid
  MOD_RES (27)..(31): Any amino acid
  MOD_RES (49)..(74): Any amino acid
  MOD_RES (97)..(154): Any amino acid
  MOD_RES (167)..(223): Any amino acid
  MOD_RES (235)..(280): Any amino acid
  MOD_RES (292)..(298): Any amino acid
  MOD_RES (314)..(341): Any amino acid
  MOD_RES (360)..(369): Any amino acid
  MOD_RES (381)..(383): Any amino acid
  MOD_RES (397)..(422): Any amino acid
  MOD_RES (473)..(477): Any amino acid
  MOD_RES (491)..(496): Any amino acid
  MOD_RES (509)..(641): Any amino acid
  MOD_RES (661)..(681): Any amino acid
  MOD_RES (698)..(718): Any amino acid
  MOD_RES (734)..(742): Any amino acid
KQGKTKATKMKAXXIFIFILLTHWAYXXXXXSQITNGTTGNPIICLGHXXXXXXXXXXXXXXXXXXXXXXXXXXGVIPLTTTPTKSYFANLKGTRTXXXXXXXXXXXXXXXXXXXXXXXXXXXXXXXXXXXXXXXXXXXXXXXXXXXXXXXXXXIMHDRTKIRQLPXXXXXXXXXXXXXXXXXXXXXXXXXXXXXXXXXXXXXXXXXXXXXXXXXXXXXXXXXEKENSYPMINKXXXXXXXXXXXXXXXXXXXXXXXXXXXXXXXXXXXXXXXXXXXXXXGVTTHYVSQIGXXXXXXXDEGLPQSGRIVVDYMXXXXXXXXXXXXXXXXXXXXXXXXXXXXAPSGIEYNGKSLGIQSDAXXXXXXXXXXPSVKLPMGAINXXXTSLTSLPFQNIHPXXXXXXXXXXXXXXXXXXXXXXXXXXPAKLLKERGFFGAIRQKRGLFGAIAGMRKKRGLFGAIAMTRGLFGAIAGFXXXXXLFGAIAGFIEGGWXXXXXXGRLVRFRHQNSEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPTFDSLNITAASLNDDGLXXXXXXXXXXXXXXXXXXXXXVTTRQASPSCLVVRKSXXXXXXXXXXXXXXXXXXXXXLCSVEYASKTRISEIXXXXXXXXX

SEQ ID NO: 419655 - protein, 742 aa, Influenza virus
  MOD_RES (13)..(14): Any amino acid
  MOD_RES (27)..(40): Any amino acid
  MOD_RES (52)..(223): Any amino acid
  MOD_RES (235)..(341): Any amino acid
  MOD_RES (357)..(376): Any amino acid
  MOD_RES (390)..(393): Any amino acid
  MOD_RES (405)..(422): Any amino acid
  MOD_RES (434)..(434): Any amino acid
  MOD_RES (472)..(477): Any amino acid
  MOD_RES (491)..(688): Any amino acid
  MOD_RES (706)..(730): Any amino acid
KQGKTKATKMEAXXIFIFLLLTHWAYXXXXXXXXXXXXXXNNNNNTATLCLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKENSYPKINKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAPSGVEYNGKSLGIQXXXXXXXXXXXXXXXXXXXXGAIGAIDSSMPFHXXXXGEHAKAIGNCPXXXXXXXXXXXXXXXXXXIPIGERGLFGAXTRRQKRGLFGAIHHMRKKRGLFGAKAETRGLFGAIAGXXXXXXIFGAIAGFIENGWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPSTGNHGSLVLSLWMXXXXXXXXXXXXXXXXXXXXXXXXXCIDFRDMRKNTL

SEQ ID NO: 419656 - protein, 742 aa, Influenza virus
  MOD_RES (1)..(14): Any amino acid
  MOD_RES (27)..(43): Any amino acid
  MOD_RES (55)..(223): Any amino acid
  MOD_RES (235)..(341): Any amino acid
  MOD_RES (353)..(378): Any amino acid
  MOD_RES (390)..(424): Any amino acid
  MOD_RES (449)..(459): Any amino acid
  MOD_RES (471)..(477): Any amino acid
  MOD_RES (489)..(730): Any amino acid
  MOD_RES (742)..(742): Any amino acid
XXXXXXXXXXXXXXIFNFILLTHWAYXXXXXXXXXXXXXXXXXNNSTATLCLGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNNKNATNPLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNNNKGAVFKSNXXXXXXXXXXXXXXXXXXXXXXXXXXYGGLNKSKPYYXXXXXXXXXXXXXXXXXXXXXXXXXXXXXXXXXXXREREGGRRRKRGRKKRGLFGAIAGXXXXXXXXXXXRMTRGLFGAIAXXXXXXXLFGAIAGFIENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCIRFVNSDCSKX

SEQ ID NO: 419657 - protein, 742 aa, Influenza virus
  MOD_RES (1)..(17): Any amino acid
  MOD_RES (29)..(43): Any amino acid
  MOD_RES (55)..(233): Any amino acid
  MOD_RES (245)..(432): Any amino acid
  MOD_RES (457)..(459): Any amino acid
  MOD_RES (471)..(730): Any amino acid
XXXXXXXXXXXXXXXXXVLSCIFCLAFGXXXXXXXXXXXXXXXSDNADKICLGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTVEVPYVCTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKKRGLFGAIAQLTHHMRKKRGLFXXXRETRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCILDQNFRNIRK

SEQ ID NO: 419658 - protein, 742 aa, Influenza virus
  MOD_RES (1)..(17): Any amino acid
  MOD_RES (29)..(434): Any amino acid
  MOD_RES (447)..(459): Any amino acid
  MOD_RES (472)..(742): Any amino acid
XXXXXXXXXXXXXXXXXRFSYVFCLALGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRRKKRGLFGAIXXXXXXXXXXXXXRKTRGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419659 - protein, 742 aa, Influenza virus
  MOD_RES (1)..(440): Any amino acid
  MOD_RES (454)..(459): Any amino acid
  MOD_RES (471)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTHKQLTHHMRKKRXXXXXXQMTRGLFGAIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419660 - protein, 742 aa, Influenza virus
  MOD_RES (1)..(440): Any amino acid
  MOD_RES (452)..(461): Any amino acid
  MOD_RES (473)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAHKQLTHHMRKXXXXXXXXXXPRGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419661 - protein, 742 aa, Influenza virus
  MOD_RES (1)..(440): Any amino acid
  MOD_RES (452)..(461): Any amino acid
  MOD_RES (473)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIHKQLTHHMRKXXXXXXXXXXKRGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419662 - protein, 742 aa, Influenza virus
  MOD_RES (1)..(461): Any amino acid
  MOD_RES (473)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419663 - protein, 742 aa, Influenza virus
  MOD_RES (1)..(462): Any amino acid
  MOD_RES (481)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKPRPRRGLFGAIAGFIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419664 - protein, 742 aa, Influenza virus
  MOD_RES (1)..(468): Any amino acid
  MOD_RES (481)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGIFGAIAGFIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419665 - protein, 742 aa, Influenza virus
  MOD_RES (1)..(468): Any amino acid
  MOD_RES (480)..(742): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGLFGAIAGFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419666 - protein, 694 aa, Influenza virus
  MOD_RES (33)..(76): Any amino acid
  MOD_RES (90)..(410): Any amino acid
  MOD_RES (423)..(425): Any amino acid
  MOD_RES (437)..(441): Any amino acid
  MOD_RES (453)..(453): Any amino acid
  MOD_RES (465)..(473): Any amino acid
  MOD_RES (485)..(546): Any amino acid
  MOD_RES (559)..(659): Any amino acid
  MOD_RES (679)..(683): Any amino acid
IGLREQKQEFKMNPNKKIITIDITIGSICMVTXXXXXXXXXXXXXXXXXXXXXXXXXXXXXXXXXXXXXXXXXXXXVPLVPCEPIIIERXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRKGLILEYYSLXXXGKKGKWLNQSKXXXXXIQHLEECSCYVXSYLNVRCVCRDXXXXXXXXXKLDINMADYSIXXXXXXXXXXXXXXXXXXXXXXXXXXXXXXXXXXXXXXXXXXXXXXXXXXXXXXXXXXXXXXNNYGVKGFGFRQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFLWCKIVTTVGWSWPDGAXXXXXNLHAYISFRNL

SEQ ID NO: 419667 - protein, 694 aa, Influenza virus
  MOD_RES (22)..(410): Any amino acid
  MOD_RES (423)..(425): Any amino acid
  MOD_RES (437)..(441): Any amino acid
  MOD_RES (453)..(453): Any amino acid
  MOD_RES (465)..(546): Any amino acid
  MOD_RES (558)..(677): Any amino acid
  MOD_RES (689)..(694): Any amino acid
LVFREQKQEFKMNPNQKIITIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIREGLILEYYFVXXXEKGKVVKSVELXXXXXIKHLEECSCYVXSYPNVRCVCRDXXXXXXXXXXXXXXXXXXXXXXXXXXXXXXXXXXXXXXXXXXXXXXXXXXXXXXXXXXXXXXXXXXXXXXXXXXXXXXXXXXDNYGVKGFGFRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTSISCLYKLSXXXXXX

SEQ ID NO: 419668 - protein, 694 aa, Influenza virus
  MOD_RES (1)..(1): Any amino acid
  MOD_RES (22)..(411): Any amino acid
  MOD_RES (423)..(425): Any amino acid
  MOD_RES (437)..(441): Any amino acid
  MOD_RES (453)..(694): Any amino acid
XFSGSQKQEFKMNPNQKIIIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMGQASYKIFKXXXGKRGKWVKSVQXXXXXIQHLEECSCYTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419669 - protein, 694 aa, Influenza virus
  MOD_RES (1)..(5): Any amino acid
  MOD_RES (29)..(417): Any amino acid
  MOD_RES (430)..(441): Any amino acid
  MOD_RES (453)..(694): Any amino acid
XXXXXQKQEIKMNPNQKIIIAIGSVSRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYKYKIFKNGKKGXXXXXXXXXXXXVQHLEECSCYVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419670 - protein, 694 aa, Influenza virus
  MOD_RES (1)..(5): Any amino acid
  MOD_RES (32)..(441): Any amino acid
  MOD_RES (453)..(694): Any amino acid
XXXXXAKAGVKMNPNQKIINRDITIGSICMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRHLEECSCYVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419671 - protein, 694 aa, Influenza virus
  MOD_RES (1)..(8): Any amino acid
  MOD_RES (22)..(694): Any amino acid
XXXXXXXXEIKMNPNQKIMTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419672 - protein, 502 aa, Influenza virus
  MOD_RES (22)..(43): Any amino acid
  MOD_RES (55)..(120): Any amino acid
  MOD_RES (141)..(141): Any amino acid
  MOD_RES (165)..(166): Any amino acid
  MOD_RES (178)..(178): Any amino acid
  MOD_RES (224)..(237): Any amino acid
  MOD_RES (249)..(249): Any amino acid
  MOD_RES (262)..(262): Any amino acid
  MOD_RES (274)..(276): Any amino acid
  MOD_RES (288)..(289): Any amino acid
  MOD_RES (303)..(308): Any amino acid
  MOD_RES (326)..(333): Any amino acid
  MOD_RES (347)..(372): Any amino acid
  MOD_RES (384)..(389): Any amino acid
  MOD_RES (401)..(416): Any amino acid
  MOD_RES (452)..(454): Any amino acid
  MOD_RES (471)..(472): Any amino acid
  MOD_RES (496)..(502): Any amino acid
IGLREQKQEFKMNPNKKIITIXXXXXXXXXXXXXXXXXXXXXXDLNMGQPFYSHXXXXXXXXXXXXXXXXXXXXXXXXXXXXXXXXXXXXXXXXXXXXXXXXXXXXXXXXXXXXXXXXXXIRIGSKGDVFVIREPFISCSXLECRTFFLTQGALLNDKHSNGTIXXRSPYRTLMSCPXGEVPSPYNSRFESVAWSASACHDGINWLTIGISGPDNGAVAVLKYXXXXXXXXXXXXXXILRTQESECACXNGSCFTVMTDGPXVMGQASYKIFKXXXGKKGKWLNQSKXXAPNYHYEECSCYPXXXXXXCVCRDNWHGSNRPWVSFXXXXXXXXGYICSGVFGDNPRXXXXXXXXXXXXXXXXXXXXXXXXXXYGNGVWIGRTKXXXXXXGFEMIWDPNGWXXXXXXXXXXXXXXXXTDWSGYSGSFVQHPELTGLDCIRPCFWVELIRGRPXXXTTIWTSGSSISFCGVNXXIFLWCKIVTTVGWSWPDGAELPFXXXXXXX

SEQ ID NO: 419673 - protein, 502 aa, Influenza virus
  MOD_RES (22)..(43): Any amino acid
  MOD_RES (55)..(120): Any amino acid
  MOD_RES (141)..(141): Any amino acid
  MOD_RES (165)..(166): Any amino acid
  MOD_RES (178)..(178): Any amino acid
  MOD_RES (192)..(192): Any amino acid
  MOD_RES (224)..(237): Any amino acid
  MOD_RES (249)..(249): Any amino acid
  MOD_RES (262)..(268): Any amino acid
  MOD_RES (281)..(289): Any amino acid
  MOD_RES (303)..(308): Any amino acid
  MOD_RES (326)..(333): Any amino acid
  MOD_RES (347)..(372): Any amino acid
  MOD_RES (384)..(389): Any amino acid
  MOD_RES (401)..(416): Any amino acid
  MOD_RES (452)..(454): Any amino acid
  MOD_RES (471)..(484): Any amino acid
  MOD_RES (496)..(502): Any amino acid
LVFREQKQEFKMNPNQKIIIIXXXXXXXXXXXXXXXXXXXXXXASQYGPSHSIHXXXXXXXXXXXXXXXXXXXXXXXXXXXXXXXXXXXXXXXXXXXXXXXXXXXXXXXXXXXXXXXXXXVRIGSKGDVFVMREPFISCSXLECKTFFLTQGALLNDRHSNGTVXXRSPYRALMSCPXGEAPSPYNSRFESXAWSASACHDGMSWLTIGISGPDDGAVAVLKYXXXXXXXXXXXXXXILRTQESECVCXNGSCFTIMTDGPXXXXXXXYKYKIFKNGKKGXXXXXXXXXAPNFHYEECSCYPXXXXXXCVCRDNWHASNRPWVSFXXXXXXXXGYICSGIFGDNPRXXXXXXXXXXXXXXXXXXXXXXXXXXYDNGVWIGRTKXXXXXXGFEMIWDPDGWXXXXXXXXXXXXXXXXNEWSGYSGSFVQHPELTGMDCMRPCFWVELIRGQPXXXATIWTSGSSISFCGVDXXXXXXXXXXXXXXWSWPDGADLPFXXXXXXX

SEQ ID NO: 419674 - protein, 502 aa, Influenza virus
  MOD_RES (1)..(1): Any amino acid
  MOD_RES (22)..(120): Any amino acid
  MOD_RES (141)..(141): Any amino acid
  MOD_RES (165)..(166): Any amino acid
  MOD_RES (178)..(178): Any amino acid
  MOD_RES (224)..(237): Any amino acid
  MOD_RES (249)..(249): Any amino acid
  MOD_RES (262)..(276): Any amino acid
  MOD_RES (288)..(289): Any amino acid
  MOD_RES (303)..(312): Any amino acid
  MOD_RES (326)..(333): Any amino acid
  MOD_RES (347)..(372): Any amino acid
  MOD_RES (384)..(389): Any amino acid
  MOD_RES (401)..(416): Any amino acid
  MOD_RES (452)..(455): Any amino acid
  MOD_RES (471)..(484): Any amino acid
  MOD_RES (496)..(502): Any amino acid
XFSGSQKQEFKMNPNQKIITIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRIGSKGDIFVVREPFISCSXMECRTFFLTQGSLLNDKHSNGTVXXRSPHRTLMSCPXGEAPSPYNSKFESVAWSASACHDGTGWLTIGISGPDNEAVAVLKYXXXXXXXXXXXXXXIMRTQESECACXNGSCFTVLTDGPXXXXXXXXXXXXXXXEKGKVVKSVELXXAPNFYYEECSCYPXXXXXXXXXXDNWHASNRPWISFXXXXXXXXGYICSGVFGDSPRXXXXXXXXXXXXXXXXXXXXXXXXXXYGDGVWIGRTKXXXXXXGFEMVWDPNGWXXXXXXXXXXXXXXXXTDWSGYSGSFIQHPELTGLNCIRPCFWVELVRGLPXXXXTIWASGSSISFCGVSXXXXXXXXXXXXXXWSWPDGAEVPFXXXXXXX

SEQ ID NO: 419675 - protein, 502 aa, Influenza virus
  MOD_RES (1)..(5): Any amino acid
  MOD_RES (32)..(120): Any amino acid
  MOD_RES (132)..(141): Any amino acid
  MOD_RES (153)..(153): Any amino acid
  MOD_RES (165)..(166): Any amino acid
  MOD_RES (178)..(192): Any amino acid
  MOD_RES (224)..(249): Any amino acid
  MOD_RES (262)..(276): Any amino acid
  MOD_RES (288)..(289): Any amino acid
  MOD_RES (303)..(312): Any amino acid
  MOD_RES (326)..(333): Any amino acid
  MOD_RES (347)..(372): Any amino acid
  MOD_RES (384)..(416): Any amino acid
  MOD_RES (428)..(435): Any amino acid
  MOD_RES (452)..(455): Any amino acid
  MOD_RES (468)..(484): Any amino acid
  MOD_RES (496)..(502): Any amino acid
XXXXXQKQEIKMNPNQKIITDITIGSICMVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRIGSRGDVFVXXXXXXXXXXSECRTFFLTQGXLLNDKHSNGTAXXRSPHRALMSCPXXXXXXXXXXXXXXXAWSASACHDGLGWITIGISGPDSGAVAVLKYXXXXXXXXXXXXXXXXXXXXXXXXXXNGFCFTVMTDGPXXXXXXXXXXXXXXXGKRGKWVKSVQXXAPNSHYEECSCYPXXXXXXXXXXDNWHGANRPWVSFXXXXXXXXGYICSGVLGDNPRXXXXXXXXXXXXXXXXXXXXXXXXXXYGNGVWMGRTKXXXXXXXXXXXXXXXXXXXXXXXXXXXXXXXXXNDWSGYSGSFVXXXXXXXXNCMRPCFWVELVRGRPXXXXTVWTSGSSISFCXXXXXXXXXXXXXXXXXWSWPDGAKLPFXXXXXXX

SEQ ID NO: 419676 - protein, 502 aa, Influenza virus
  MOD_RES (1)..(8): Any amino acid
  MOD_RES (22)..(129): Any amino acid
  MOD_RES (141)..(141): Any amino acid
  MOD_RES (153)..(153): Any amino acid
  MOD_RES (165)..(192): Any amino acid
  MOD_RES (224)..(249): Any amino acid
  MOD_RES (262)..(289): Any amino acid
  MOD_RES (303)..(335): Any amino acid
  MOD_RES (347)..(416): Any amino acid
  MOD_RES (428)..(435): Any amino acid
  MOD_RES (450)..(455): Any amino acid
  MOD_RES (471)..(484): Any amino acid
  MOD_RES (496)..(502): Any amino acid
XXXXXXXXEIKMNPNQKIMTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFIIREPFISCSXFECRTFFLTQGXLLNDRHSNGTIXXXXXXXXXXXXXXXXXXXXXXXXXXXXAWSASACHDGVSWLTIGVSGPDNGAVAVVKYXXXXXXXXXXXXXXXXXXXXXXXXXXNGSCFTLMTDGPXXXXXXXXXXXXXXXXXXXXXXXXXXXXAPNYYYEECSCYPXXXXXXXXXXXXXXXXXXXXXXXXXXXXXXXXXICSGVFGDTPRXXXXXXXXXXXXXXXXXXXXXXXXXXXXXXXXXXXXXXXXXXXXXXXXXXXXXXXXXXXXXXXXXXXXXXTNWSGYSGSFVXXXXXXXXNCIKPCFWVELIRGXXXXXXTIWTSGSIISFCGVNXXXXXXXXXXXXXXWSWPDDAELPFXXXXXXX

SEQ ID NO: 419677 - protein, 502 aa, Influenza virus
  MOD_RES (1)..(18): Any amino acid
  MOD_RES (31)..(455): Any amino acid
  MOD_RES (471)..(502): Any amino acid
XXXXXXXXXXXXXXXXXXNRDITIGSICMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTIWTSASSISFCGVNXXXXXXXXXXXXXXXXXXXXXXXXXXXXXXXX

SEQ ID NO: 419678 - protein, 494 aa, Influenza virus
  MOD_RES (17)..(53): Any amino acid
  MOD_RES (65)..(71): Any amino acid
  MOD_RES (83)..(85): Any amino acid
  MOD_RES (98)..(115): Any amino acid
  MOD_RES (127)..(127): Any amino acid
  MOD_RES (139)..(141): Any amino acid
  MOD_RES (155)..(167): Any amino acid
  MOD_RES (206)..(235): Any amino acid
  MOD_RES (249)..(250): Any amino acid
  MOD_RES (273)..(285): Any amino acid
  MOD_RES (331)..(333): Any amino acid
  MOD_RES (347)..(434): Any amino acid
  MOD_RES (449)..(456): Any amino acid
  MOD_RES (490)..(494): Any amino acid
AKAGVKMNPNQKIITIXXXXXXXXXXXXXXXXXXXXXXXXXXXXXXXXXXXXXKNNQVILCEPTXXXXXXXKTVVHLNSTTIXXXEKEKEICSVVLEXXXXXXXXXXXXXXXXXXKDNSIRLSAGGXIWVTREPYVSCXXXKCYQFALGQGTTLXXXXXXXXXXXXXPYRTLLMNELGVPFHLGTKQVCIAWSSSSCHDGKAWLHXXXXXXXXXXXXXXXXXXXXXXXXXXXXXXILRTQESECVCINXXCTVVMTDGSASREGLILEYYFVXXXXXXXXXXXXXGSAQHVEECSCYPRSYLNVRCVCRDNWKGSNRPIKLDINMADYSIXXXYVCSGLVGDTPRKXXXXXXXXXXXXXXXXXXXXXXXXXXXXXXXXXXXXXXXXXXXXXXXXXXXXXXXXXXXXXXXXXXXXXXXXXXXXXXXXXXXXXXXXCINRCFYVELIRGRXXXXXXXXTSNSIVVFCGTSGTYGTGSWPDGADINLHAYISXXXXX

SEQ ID NO: 419679 - protein, 494 aa, Influenza virus
  MOD_RES (1)..(12): Any amino acid
  MOD_RES (24)..(53): Any amino acid
  MOD_RES (65)..(115): Any amino acid
  MOD_RES (127)..(127): Any amino acid
  MOD_RES (139)..(141): Any amino acid
  MOD_RES (153)..(167): Any amino acid
  MOD_RES (206)..(235): Any amino acid
  MOD_RES (249)..(250): Any amino acid
  MOD_RES (273)..(285): Any amino acid
  MOD_RES (320)..(333): Any amino acid
  MOD_RES (347)..(434): Any amino acid
  MOD_RES (449)..(456): Any amino acid
  MOD_RES (490)..(494): Any amino acid
XXXXXXXXXXXXIIIAIGSVSRTXXXXXXXXXXXXXXXXXXXXXXXXXXXXXXKNNQVILCEQTXXXXXXXXXXXXXXXXXXXXXXXXXXXXXXXXXXXXXXXXXXXXXXXXXXXKDNSIRLSASGXIWITREPYVSCXXXRCYQFALGQGTXXXXXXXXXXXXXXXPHRTLLMNELGVPFHLATKQVCMAWSSSSCHDGRAWLHXXXXXXXXXXXXXXXXXXXXXXXXXXXXXXILRTQESECICINXXCAVVMTDGSASRKGLILEYYSLXXXXXXXXXXXXXGSAQHIEECSCYPRSYPNVRCVCRDNWRGSNRPVXXXXXXXXXXXXXXYLCSGLVGDTPRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXCVNRCFYVELIRGSXXXXXXXXTSNSIIVFCGTSGTYGSGSWPDGANINFMPYISXXXXX

SEQ ID NO: 419680 - protein, 494 aa, Influenza virus
  MOD_RES (1)..(53): Any amino acid
  MOD_RES (65)..(115): Any amino acid
  MOD_RES (127)..(127): Any amino acid
  MOD_RES (139)..(141): Any amino acid
  MOD_RES (153)..(167): Any amino acid
  MOD_RES (206)..(237): Any amino acid
  MOD_RES (249)..(250): Any amino acid
  MOD_RES (262)..(285): Any amino acid
  MOD_RES (300)..(303): Any amino acid
  MOD_RES (320)..(333): Any amino acid
  MOD_RES (347)..(437): Any amino acid
  MOD_RES (449)..(456): Any amino acid
  MOD_RES (490)..(494): Any amino acid
XXXXXXXXXXXXXXXXXXXXXXXXXXXXXXXXXXXXXXXXXXXXXXXXXXXXXKNNQVILCGPTXXXXXXXXXXXXXXXXXXXXXXXXXXXXXXXXXXXXXXXXXXXXXXXXXXXKDNSVRLSAGGXIWVTRELYVSCXXXNCYQFALGQGTXXXXXXXXXXXXXXXPHRTLLMSELGVPFHLGTRQVCIAWSSSSCYDGKAWLHXXXXXXXXXXXXXXXXXXXXXXXXXXXXXXXXRTQESECVCISXXCTVVMTDGNASXXXXXXXXXXXXXXXXXXXXXXXXGNAQHVEECSCYPQXXXXVRCICRDNWKGSNRPVXXXXXXXXXXXXXXYMCSGLVGDTPRSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRCFYVELVRGRXXXXXXXXTSNSIVAFCGTSGTYGTGTWPDGADINLMPIYSXXXXX

SEQ ID NO: 419681 - protein, 494 aa, Influenza virus
  MOD_RES (1)..(58): Any amino acid
  MOD_RES (72)..(115): Any amino acid
  MOD_RES (127)..(127): Any amino acid
  MOD_RES (139)..(167): Any amino acid
  MOD_RES (206)..(237): Any amino acid
  MOD_RES (249)..(250): Any amino acid
  MOD_RES (262)..(288): Any amino acid
  MOD_RES (300)..(303): Any amino acid
  MOD_RES (315)..(335): Any amino acid
  MOD_RES (347)..(456): Any amino acid
  MOD_RES (490)..(494): Any amino acid
XXXXXXXXXXXXXXXXXXXXXXXXXXXXXXXXXXXXXXXXXXXXXXXXXXXXXXXXXXVPLVPCEPIIIERXXXXXXXXXXXXXXXXXXXXXXXXXXXXXXXXXXXXXXXXXXXXKDNSIRLAAGGXVWVTREPYVSCXXXXXXXXXXXXXXXXXXXXXXXXXXXXXPYRTLLMSELGVPFYLGTKQVCVAWSSSSCHDGNAWLHXXXXXXXXXXXXXXXXXXXXXXXXXXXXXXXXRTQESECVCIDXXCTVIMTDGSASXXXXXXXXXXXXXXXXXXXXXXXXXXXQHIEECSCYPQXXXXIRCVCRDNWKGXXXXXXXXXXXXXXXXXXXXXCSGLVGDTPRDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSNSIIAFCGTSGTYGAGSWPDGADIKSHAYISXXXXX

SEQ ID NO: 419682 - protein, 494 aa, Influenza virus
  MOD_RES (1)..(115): Any amino acid
  MOD_RES (127)..(167): Any amino acid
  MOD_RES (190)..(260): Any amino acid
  MOD_RES (272)..(288): Any amino acid
  MOD_RES (300)..(303): Any amino acid
  MOD_RES (316)..(335): Any amino acid
  MOD_RES (347)..(456): Any amino acid
  MOD_RES (474)..(478): Any amino acid
  MOD_RES (493)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKDNSIQLSAGGXXXXXXXXXXXXXXXXXXXXXXXXXXXXXXXXXXXXXXXXXSHRTLLMNELGIPFHLGTKQVCXXXXXXXXXXXXXXXXXXXXXXXXXXXXXXXXXXXXXXXXXXXXXXXXXXXXXXXXXXXXXXXXXXXXXXXIREGLILEYYFXXXXXXXXXXXXXXXXXQHVEECSCYPSXXXXVKCVCRDNWKGSXXXXXXXXXXXXXXXXXXXXCSGLVGDTPREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTANSIIVFCGTSGTYGAXXXXXGRTSISCLYKLSQFXX

SEQ ID NO: 419683 - protein, 494 aa, Influenza virus
  MOD_RES (1)..(168): Any amino acid
  MOD_RES (180)..(185): Any amino acid
  MOD_RES (197)..(260): Any amino acid
  MOD_RES (272)..(308): Any amino acid
  MOD_RES (320)..(462): Any amino acid
  MOD_RES (478)..(480): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYRTLLMNELGIXXXXXXRQVCMAWSSSSXXXXXXXXXXXXXXXXXXXXXXXXXXXXXXXXXXXXXXXXXXXXXXXXXXXXXXXXXXXXXXXXIRKGLILEYYSXXXXXXXXXXXXXXXXXXXXXXXXXXXXXXXXXXXXXRDNWRGSNRPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFCGTSGTYGKGSWPXXXADINLHAYISFRNL

SEQ ID NO: 419684 - protein, 494 aa, Influenza virus
  MOD_RES (1)..(469): Any amino acid
  MOD_RES (492)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYGTGSWPDGGADIKSHAYISFXXX

SEQ ID NO: 419685 - protein, 494 aa, Influenza virus
  MOD_RES (1)..(480): Any amino acid
  MOD_RES (493)..(494): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXANINFMPYISFAXX

SEQ ID NO: 419686 - protein, 515 aa, Influenza virus
  MOD_RES (1)..(88): Any amino acid
  MOD_RES (112)..(114): Any amino acid
  MOD_RES (127)..(128): Any amino acid
  MOD_RES (143)..(150): Any amino acid
  MOD_RES (163)..(175): Any amino acid
  MOD_RES (195)..(266): Any amino acid
  MOD_RES (281)..(318): Any amino acid
  MOD_RES (332)..(332): Any amino acid
  MOD_RES (379)..(438): Any amino acid
  MOD_RES (458)..(460): Any amino acid
  MOD_RES (476)..(481): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXLPLCPFRGFFPFHKDNAIRLGENXXXIVTREPYVSCDNXXCWSFALAQGALLGTXXXXXXXXDRTPYRSLIRFPXXXXXXXXXXXXXCIAWSSSSCFDGKEWMHVCXXXXXXXXXXXXXXXXXXXXXXXXXXXXXXXXXXXXXXXXXXXXXXXXXXXXXXXXXXXXXXXXXXXXXXXXKDILRTQESECQCIXXXXXXXXXXXXXXXXXXXXXXXXXXXXXXXXXXXXXXKIQHLEECSCYVDXDVYCICRDNWKGSNRPWMRINNETILETGYVCSKFHSDTPRPADPSXXXXXXXXXXXXXXXXXXXXXXXXXXXXXXXXXXXXXXXXXXXXXXXXXXXXXXXXXXXXTQTLVSNNDWSGYSGSFIVXXXDCFQPCFYVELIRGRXXXXXXVSWTSNSIVTFCGLDNEPGSGNWPDGSNIGFMPK

SEQ ID NO: 419687 - protein, 515 aa, Influenza virus
  MOD_RES (1)..(88): Any amino acid
  MOD_RES (112)..(114): Any amino acid
  MOD_RES (127)..(128): Any amino acid
  MOD_RES (143)..(150): Any amino acid
  MOD_RES (163)..(175): Any amino acid
  MOD_RES (195)..(266): Any amino acid
  MOD_RES (281)..(318): Any amino acid
  MOD_RES (332)..(332): Any amino acid
  MOD_RES (379)..(438): Any amino acid
  MOD_RES (458)..(460): Any amino acid
  MOD_RES (476)..(481): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXLPLCPFKGFFPFHKDNALRLAENXXXIVTREPYISCDNXXCWSFALAQGTLLGTXXXXXXXXDRTPYRSLIQFPXXXXXXXXXXXXXCVAWSSSSCFDGREWMHVCXXXXXXXXXXXXXXXXXXXXXXXXXXXXXXXXXXXXXXXXXXXXXXXXXXXXXXXXXXXXXXXXXXXXXXXXRDILRTQESECQCLXXXXXXXXXXXXXXXXXXXXXXXXXXXXXXXXXXXXXXKIKHLEECSCYVDXDVYCVCRDNWKGSNRPWVRMNNETILETGYICSKFHSDTPRPDDPSXXXXXXXXXXXXXXXXXXXXXXXXXXXXXXXXXXXXXXXXXXXXXXXXXXXXXXXXXXXXTQTLVSNSDWSGYSGSFIIXXXGCFQPCFYIELIRGRXXXXXXVSWASNSIVTFCGLNNEPGSGNWPDGANIGFMPK

SEQ ID NO: 419688 - protein, 515 aa, Influenza virus
  MOD_RES (1)..(88): Any amino acid
  MOD_RES (112)..(114): Any amino acid
  MOD_RES (126)..(128): Any amino acid
  MOD_RES (141)..(150): Any amino acid
  MOD_RES (163)..(175): Any amino acid
  MOD_RES (195)..(266): Any amino acid
  MOD_RES (279)..(318): Any amino acid
  MOD_RES (332)..(332): Any amino acid
  MOD_RES (379)..(438): Any amino acid
  MOD_RES (458)..(460): Any amino acid
  MOD_RES (476)..(481): Any amino acid
  MOD_RES (501)..(503): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXLPLCPFQGFFPFHKDNAVRLGENXXXLVTREPYISCDXXXCWSFALAQGVLLXXXXXXXXXXDRTSYRSLIRFPXXXXXXXXXXXXXCAAWSSSSCFDGKEWLHVCXXXXXXXXXXXXXXXXXXXXXXXXXXXXXXXXXXXXXXXXXXXXXXXXXXXXXXXXXXXXXXXXXXXXXXXXNNILRTQESECQXXXXXXXXXXXXXXXXXXXXXXXXXXXXXXXXXXXXXXXXRIQHLEECSCYTDXDIYCICRDNWKGSNRPWIRINNETIIETGYVCSKFHSDTPRPVDPSXXXXXXXXXXXXXXXXXXXXXXXXXXXXXXXXXXXXXXXXXXXXXXXXXXXXXXXXXXXXIQTLVSNNDWSGYSGSFVIXXXGCFQPCFYVELTRGVXXXXXXVSWTSNSMVTFCGLDNEPDXXXWPDGSDIGFMPK

SEQ ID NO: 419689 - protein, 515 aa, Influenza virus
  MOD_RES (1)..(100): Any amino acid
  MOD_RES (112)..(114): Any amino acid
  MOD_RES (127)..(129): Any amino acid
  MOD_RES (143)..(150): Any amino acid
  MOD_RES (163)..(178): Any amino acid
  MOD_RES (195)..(266): Any amino acid
  MOD_RES (278)..(318): Any amino acid
  MOD_RES (331)..(332): Any amino acid
  MOD_RES (379)..(438): Any amino acid
  MOD_RES (458)..(460): Any amino acid
  MOD_RES (472)..(481): Any amino acid
  MOD_RES (503)..(503): Any amino acid
  MOD_RES (515)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHKDNAIRLGETXXXIITREPYVSCDNXXXWSFALAQGALVGTXXXXXXXXDRAPYRSLIRFPXXXXXXXXXXXXXXXXWSSTSCFDGKEWMHICXXXXXXXXXXXXXXXXXXXXXXXXXXXXXXXXXXXXXXXXXXXXXXXXXXXXXXXXXXXXXXXXXXXXXXXXKNILRTQESECXXXXXXXXXXXXXXXXXXXXXXXXXXXXXXXXXXXXXXXXXKVQHLEECSCYVXXDIYCVCRDNWKGSNRPWVRINNETIVETGYVCSKFHSDTPRPSDPSXXXXXXXXXXXXXXXXXXXXXXXXXXXXXXXXXXXXXXXXXXXXXXXXXXXXXXXXXXXXTQTLVANNDWSGYSGSFSVXXXACFQPCFYVELXXXXXXXXXXVSWTSNSIITFCGLDNEPGSEXWPDGSNIGLCPX

SEQ ID NO: 419690 - protein, 515 aa, Influenza virus
  MOD_RES (1)..(114): Any amino acid
  MOD_RES (126)..(130): Any amino acid
  MOD_RES (143)..(150): Any amino acid
  MOD_RES (163)..(266): Any amino acid
  MOD_RES (278)..(318): Any amino acid
  MOD_RES (332)..(341): Any amino acid
  MOD_RES (379)..(438): Any amino acid
  MOD_RES (458)..(464): Any amino acid
  MOD_RES (476)..(485): Any amino acid
  MOD_RES (509)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVTREPCVSCDXXXXXSFALSQGALLGTXXXXXXXXDRTPYRSLIKFPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNILRTQESECXXXXXXXXXXXXXXXXXXXXXXXXXXXXXXXXXXXXXXXXXKIRHLEECSCYVDXXXXXXXXXXWKGSNRPWMKISNETILETGYVCGKFHSDTPRPTDPSXXXXXXXXXXXXXXXXXXXXXXXXXXXXXXXXXXXXXXXXXXXXXXXXXXXXXXXXXXXXNQTLVSNNDWSGYSGSFVVXXXXXXXPCFYIELIRGKXXXXXXXXXXSNSLVTFCGLDNEPGSGDWPDGSXXXXXXX

SEQ ID NO: 419691 - protein, 515 aa, Influenza virus
  MOD_RES (1)..(115): Any amino acid
  MOD_RES (127)..(320): Any amino acid
  MOD_RES (332)..(343): Any amino acid
  MOD_RES (358)..(486): Any amino acid
  MOD_RES (509)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTREPYVSCDYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQHLEECSCYMDXXXXXXXXXXXXGSNRPWMRISNETIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSIVTFCGLBNEPGSGNWPDGPXXXXXXX

SEQ ID NO: 419692 - protein, 515 aa, Influenza virus
  MOD_RES (1)..(115): Any amino acid
  MOD_RES (127)..(495): Any amino acid
  MOD_RES (507)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTREPYVSCDSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNEPGSGNGLMXXXXXXXXX

SEQ ID NO: 419693 - protein, 515 aa, Influenza virus
  MOD_RES (1)..(503): Any amino acid
  MOD_RES (515)..(515): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWPDGANIGLCPX

SEQ ID NO: 419694 - protein, 470 aa, Influenza virus
  MOD_RES (14)..(16): Any amino acid
  MOD_RES (44)..(47): Any amino acid
  MOD_RES (73)..(89): Any amino acid
  MOD_RES (264)..(269): Any amino acid
  MOD_RES (328)..(335): Any amino acid
MNPNQKIITIGSIXXXLTTVGLLLQITSLCSIWFSHYNQVTQTXXXXCSNNTTNYYNETFVNVTNVQNNYTTXXXXXXXXXXXXXXXXXLCPIRGWAPLSKDNGIRIGSRGEVFVIREPFISCSISECRTFFLTQGALLNDKHSNGTVKDRSPFRTLMSCPIGVAPSPSNSRFESVAWSATACSDGPGWLTLGITGPDATAVAVLKYNGIITDTLKSWKGNIMRTQESECVCQDEFCYTLITDGPSDAQAFYKILKIRKGKIVXXXXXXATGFHFEECSCYPSGTDIECVCRDNWRGSNRPWIRFNSDLDYQIGYVCSGIFGDNPRPXXXXXXXXSPVNNGKGRYGVKGFSFRYGDGVWIGRTKSLESRSGFEMVWDANGWVSTDKDSNGVQDIIDNDNWSGYSGSFSIRGETTGRNCTVPCFWVEMIRGQPKEKTIWTSGSSIAFCGVNSDTTGWSWPDGALLPFDIDK

SEQ ID NO: 419695 - protein, 470 aa, Influenza virus
  MOD_RES (14)..(16): Any amino acid
  MOD_RES (44)..(47): Any amino acid
  MOD_RES (73)..(89): Any amino acid
  MOD_RES (105)..(109): Any amino acid
  MOD_RES (136)..(151): Any amino acid
  MOD_RES (173)..(176): Any amino acid
  MOD_RES (216)..(230): Any amino acid
  MOD_RES (264)..(269): Any amino acid
  MOD_RES (328)..(335): Any amino acid
  MOD_RES (349)..(354): Any amino acid
  MOD_RES (422)..(422): Any amino acid
MNPNQSIITIGSAXXXLTTIGLLLQITSLCSIWFSHYNQMTQAXXXXCSNDTINYYNETFVNVTHVQNNYTTXXXXXXXXXXXXXXXXXLCPVKGWAPLSKDNGXXXXXRGEVSVIREPFISCSVSECRTFFLTQXXXXXXXXXXXXXXXXSPFRTLMSCPMGVAPSPSNSRXXXXAWSATACSDGSGWLTLGITGPDSTAVAVIKYNGIITDTLXXXXXXXXXXXXXXXVCQDEFCYTLMTDGPSDAQAFYKLLKIRKGKIVXXXXXXATGYHFEECSCYPSGENVECVCRDNWRGSNRPWVRFNSDLDYQIGYICSGVFGDNPRPXXXXXXXXGPINNGKGRYGVKXXXXXXGDGVWIGRTKNLESRSGFEMVWDDNGWVSTDKDSNGVQDIIDNNNWSGYSGSFSIRWETTGRNCTVPXLWVEMIRGQPKEKAIWTSGSSIAFCGVDSDTTGWPWPDGALLPFDIDR

SEQ ID NO: 419696 - protein, 470 aa, Influenza virus
  MOD_RES (14)..(16): Any amino acid
  MOD_RES (44)..(52): Any amino acid
  MOD_RES (73)..(89): Any amino acid
  MOD_RES (104)..(110): Any amino acid
  MOD_RES (137)..(151): Any amino acid
  MOD_RES (173)..(181): Any amino acid
  MOD_RES (226)..(230): Any amino acid
  MOD_RES (264)..(269): Any amino acid
  MOD_RES (287)..(293): Any amino acid
  MOD_RES (327)..(335): Any amino acid
  MOD_RES (347)..(355): Any amino acid
  MOD_RES (398)..(409): Any amino acid
  MOD_RES (468)..(470): Any amino acid
MNPNQMIITIGSAXXXLTTVGLLLQIISLCSIWFSHYNQMKQAXXXXXXXXXTNYYNETFVNMTNVQNNYTTXXXXXXXXXXXXXXXXXLCPIKGWAPLSKDNXXXXXXXGEVFVIREPFVSCSIHECRTFFLTQGXXXXXXXXXXXXXXXSPFRTLMSCPVGVAPSPSNSRXXXXXXXXXACSDGPGWLTIGITGPDATAVAVIKYNGIITDTFKSWKGNIMRTXXXXXVCQDEFCYTLVTDGPSDAQAFYKILKIKKGKIVXXXXXXAPGFHFEECSCYPSRENXXXXXXXNWQGSNRPWIRFNSNLDYQIGYVCSGVFGDNPRXXXXXXXXXSPINNGKGRYGXXXXXXXXXEEVWIGRTKSLESRRGFEMIWDANGWVSTDKNSNGVQDIIDNXXXXXXXXXXXXRGETTGRNCTIPCFWVEMIRGQPNERTIWTSGSSIAFCGVNSNTTGWSWPDGALFPLTXXX

SEQ ID NO: 419697 - protein, 470 aa, Influenza virus
  MOD_RES (1)..(2): Any amino acid
  MOD_RES (14)..(16): Any amino acid
  MOD_RES (42)..(54): Any amino acid
  MOD_RES (72)..(111): Any amino acid
  MOD_RES (137)..(154): Any amino acid
  MOD_RES (172)..(188): Any amino acid
  MOD_RES (221)..(236): Any amino acid
  MOD_RES (263)..(269): Any amino acid
  MOD_RES (287)..(298): Any amino acid
  MOD_RES (328)..(364): Any amino acid
  MOD_RES (395)..(427): Any amino acid
  MOD_RES (468)..(470): Any amino acid
XXPNQKIITIGSVXXXLTTVGLLLQVTSLCSIWFSHYNQITXXXXXXXXXXXXXYYNETFVNITNVQNNYTXXXXXXXXXXXXXXXXXXXXXXXXXXXXXXXXXXXXXXXXEVFVIREPCISCSINECRTFFLTQGXXXXXXXXXXXXXXXXXXRTLMSCHIGVAPSPSNSXXXXXXXXXXXXXXXXXWLTLGITGPDTTAVAVLKYNGVITDTLKSWKGXXXXXXXXXXXXXXXXCYTLITDGPSNAQAFYKILKIKKGKLXXXXXXXAAGFHFEECSCYPSGESXXXXXXXXXXXXNRPWIRFNSDPDYQIGYVCSGIFGDSPRPXXXXXXXXXXXXXXXXXXXXXXXXXXXXXXXXXXXXXSLESRSGFEMIWDANGWVTADKDSNGVQDIXXXXXXXXXXXXXXXXXXXXXXXXXXXXXXXXXIRGQPKERTIWTSGSSIAFCGVNFDLTSWSWPDGALLPLTXXX

SEQ ID NO: 419698 - protein, 470 aa, Influenza virus
  MOD_RES (1)..(2): Any amino acid
  MOD_RES (14)..(16): Any amino acid
  MOD_RES (44)..(58): Any amino acid
  MOD_RES (73)..(120): Any amino acid
  MOD_RES (137)..(159): Any amino acid
  MOD_RES (171)..(196): Any amino acid
  MOD_RES (210)..(243): Any amino acid
  MOD_RES (264)..(269): Any amino acid
  MOD_RES (285)..(302): Any amino acid
  MOD_RES (327)..(373): Any amino acid
  MOD_RES (385)..(444): Any amino acid
  MOD_RES (464)..(470): Any amino acid
XXPNQKIITIGSAXXXLTTIGPLLQITSLCSIWFSHYNQVAQTXXXXXXXXXXXXXXXTFVNVTNVQNDYTTXXXXXXXXXXXXXXXXXXXXXXXXXXXXXXXXXXXXXXXXXXXXXXXXISCSIDECRTFFLTQGXXXXXXXXXXXXXXXXXXXXXXXCPIGVVPSPSNXXXXXXXXXXXXXXXXXXXXXXXXXXPDATAVVVLKYNGXXXXXXXXXXXXXXXXXXXXXXXXXXXXXXXXXXGPSDGQAFYKILKIKKGKIMXXXXXXATGFHLEECSCYPSGXXXXXXXXXXXXXXXXXXIRFNSDLNYQIGYICSGIFGDNPRXXXXXXXXXXXXXXXXXXXXXXXXXXXXXXXXXXXXXXXXXXXXXXXMVWDANGWVTAXXXXXXXXXXXXXXXXXXXXXXXXXXXXXXXXXXXXXXXXXXXXXXXXXXXXXXXXXXXXAFCGVDSDTTSWSWPDGALXXXXXXX

SEQ ID NO: 419699 - protein, 470 aa, Influenza virus
  MOD_RES (1)..(17): Any amino acid
  MOD_RES (29)..(32): Any amino acid
  MOD_RES (44)..(252): Any amino acid
  MOD_RES (264)..(270): Any amino acid
  MOD_RES (282)..(377): Any amino acid
  MOD_RES (389)..(444): Any amino acid
  MOD_RES (457)..(470): Any amino acid
XXXXXXXXXXXXXXXXXTTIGLLLQIISXXXXWFSHYNQVTQPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKILKIRKGKIMXXXXXXXIGFHFEECSCYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXANGWVSTDKSSXXXXXXXXXXXXXXXXXXXXXXXXXXXXXXXXXXXXXXXXXXXXXXXXXXXXXXXXAFCGVNSDTTSWXXXXXXXXXXXXXX

SEQ ID NO: 419700 - protein, 470 aa, Influenza virus
  MOD_RES (1)..(450): Any amino acid
  MOD_RES (466)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDTTCWSWPDGALLPXXXXX

SEQ ID NO: 419701 - protein, 473 aa, Influenza virus
  MOD_RES (18)..(80): Any amino acid
  MOD_RES (189)..(190): Any amino acid
  MOD_RES (234)..(234): Any amino acid
  MOD_RES (256)..(264): Any amino acid
  MOD_RES (302)..(308): Any amino acid
  MOD_RES (329)..(336): Any amino acid
  MOD_RES (366)..(367): Any amino acid
  MOD_RES (383)..(393): Any amino acid
  MOD_RES (413)..(418): Any amino acid
MNPNQKIITIGSVSLALXXXXXXXXXXXXXXXXXXXXXXXXXXXXXXXXXXXXXXXXXXXXXXXXXXXXXXXXXXXXXXXFLNNTEPLCNVSGFAIVSKDNGIRIGSRGHVFVIREPFVACGPTECRTFFLTQGALLNDKHSNNTVKDRSPYRALMSVPLGSSPNAYQAKFESVAWSATACHDGKEWLXXGISGADDDAYAVIHYGGMPTDVVRSWRKQILRTQESSCVCMKGXCYWVMTDGPANNQASYKIFKSXXXXXXXXXEVSFQGGHIEECSCYPNLGKVECVCRDNWNGMNRPILXXXXXXXYEVGYLCAGIPTDTPRVQDSXXXXXXXXAVGGSGTNNYGVKGFGFRQGNSVWAGRTVXXSSRSGFEILLIEDGWXXXXXXXXXXXEVLNNKNWSGYSGAFTIPIXXXXXXCLVPCFWLEMIRGKPEERTSIWTSSSSTVFCGVSSEVPGWSWDDGAILPFDIDKM

SEQ ID NO: 419702 - protein, 473 aa, Influenza virus
  MOD_RES (1)..(2): Any amino acid
  MOD_RES (18)..(80): Any amino acid
  MOD_RES (189)..(190): Any amino acid
  MOD_RES (234)..(234): Any amino acid
  MOD_RES (256)..(264): Any amino acid
  MOD_RES (302)..(308): Any amino acid
  MOD_RES (329)..(336): Any amino acid
  MOD_RES (366)..(367): Any amino acid
  MOD_RES (383)..(393): Any amino acid
  MOD_RES (413)..(418): Any amino acid
  MOD_RES (472)..(473): Any amino acid
XXPNQKIITIGSISLGLXXXXXXXXXXXXXXXXXXXXXXXXXXXXXXXXXXXXXXXXXXXXXXXXXXXXXXXXXXXXXXXFLNNTEPLCEVSGFAIISKDNGIRIGSRGHIFVIREPFVACSPSECRTFFLTQGALLNDRHSNNTVKDRSPYRALMSVPMGSSPNAYQARFESVGWSATACHDGKKWLXXGVSGADDDAYAVIHYGGVPTDVVRSWKKQILRTQESSCVCVKGXCYWVMTDGPASNQASYKIFKSXXXXXXXXXEISFQGGHIEECSCYPNMGKVECVCRDNWNGMNRPVLXXXXXXXYNVGYLCAGIPTDTPRIQDSXXXXXXXXAIGGSGTNNYGVKGFGFRQGTSVWAGRTIXXSSRSGFEVLLIEDGWXXXXXXXXXXXEVLDNKNWSGYSGSFTIPTXXXXXXCIVPCFWLEMIRGRPEERNSIWTSSSSTVFCGVSGEVPGWSWDDGAILPLTSIXX

SEQ ID NO: 419703 - protein, 473 aa, Influenza virus
  MOD_RES (1)..(2): Any amino acid
  MOD_RES (18)..(80): Any amino acid
  MOD_RES (108)..(109): Any amino acid
  MOD_RES (133)..(133): Any amino acid
  MOD_RES (148)..(151): Any amino acid
  MOD_RES (189)..(190): Any amino acid
  MOD_RES (234)..(235): Any amino acid
  MOD_RES (256)..(264): Any amino acid
  MOD_RES (293)..(308): Any amino acid
  MOD_RES (329)..(336): Any amino acid
  MOD_RES (366)..(367): Any amino acid
  MOD_RES (381)..(393): Any amino acid
  MOD_RES (409)..(423): Any amino acid
  MOD_RES (470)..(473): Any amino acid
XXPNQKIITIGSASLGLXXXXXXXXXXXXXXXXXXXXXXXXXXXXXXXXXXXXXXXXXXXXXXXXXXXXXXXXXXXXXXXFLNNTEPLCDVSGFAIFSKDNGIRIGSXXHVFVIREPFVSCGPSECRTFFLTXCVLLNDKHSNNTVRXXXXYRALMSVLLGSSPNAYQARFESVEWSATACHDGKGWLXXGVSGADNDAYAVIHYGGIPTDVVRSWRKKILRTQESSCVCIKGXXYWVMTDGPANSQASYKIFKSXXXXXXXXXEVLFQGGHIEECSCYPNSGKVECVCRDNXXXXXXXXXXXXXXXXYDVGYLCAGIPTDTPRVQDNXXXXXXXXAVGGSGTDNYGVKGFGFRQGNNVWAGRTVXXASRSGFEVLLIENXXXXXXXXXXXXXEVLNNMNWSGYSGSFXXXXXXXXXXXXXXXFWLEMIRGKPKERTSIWTSSSSMVFCGVSGEVPGWSWGDGAILPFDXXXX

SEQ ID NO: 419704 - protein, 473 aa, Influenza virus
  MOD_RES (1)..(2): Any amino acid
  MOD_RES (14)..(80): Any amino acid
  MOD_RES (131)..(153): Any amino acid
  MOD_RES (186)..(190): Any amino acid
  MOD_RES (234)..(235): Any amino acid
  MOD_RES (256)..(264): Any amino acid
  MOD_RES (295)..(308): Any amino acid
  MOD_RES (329)..(336): Any amino acid
  MOD_RES (366)..(367): Any amino acid
  MOD_RES (382)..(393): Any amino acid
  MOD_RES (408)..(425): Any amino acid
  MOD_RES (473)..(473): Any amino acid
XXPNQKIITIGSMXXXXXXXXXXXXXXXXXXXXXXXXXXXXXXXXXXXXXXXXXXXXXXXXXXXXXXXXXXXXXXXXXXXFFNNTEPLCEVSGFVIVSKDNGIRVGSRGHVFVIREPFVACGPSECRTFFXXXXXXXXXXXXXXXXXXXXXXXALMSVPLGSSSNAYQAKFESVAWSATACHDGRXXXXXGVSGTDDDAYAVIHYGGVPTDVIRSWRKQILRTQESSCVCMNGXXYWVMTDGPANKQASYKIFKSXXXXXXXXXEVSFRGGHIEECSCYPNLGQVECVCRDNWNXXXXXXXXXXXXXXYKVGYLCAGIPTDTPRVQDDXXXXXXXXAVGRSGTNNYGVKGFAFKQGNSVWAGRTIXXSSRNGFEILLIEDGXXXXXXXXXXXXEILNNKNWSGYSGSXXXXXXXXXXXXXXXXXXLEMIRGKPEEGTSIWTSSSSTVFCGVSSEAPGWSWDDGAILPFGIDKX

SEQ ID NO: 419705 - protein, 473 aa, Influenza virus
  MOD_RES (1)..(3): Any amino acid
  MOD_RES (18)..(85): Any amino acid
  MOD_RES (105)..(113): Any amino acid
  MOD_RES (135)..(159): Any amino acid
  MOD_RES (175)..(177): Any amino acid
  MOD_RES (189)..(192): Any amino acid
  MOD_RES (229)..(240): Any amino acid
  MOD_RES (256)..(265): Any amino acid
  MOD_RES (294)..(317): Any amino acid
  MOD_RES (329)..(337): Any amino acid
  MOD_RES (349)..(354): Any amino acid
  MOD_RES (366)..(368): Any amino acid
  MOD_RES (383)..(393): Any amino acid
  MOD_RES (410)..(432): Any amino acid
  MOD_RES (446)..(447): Any amino acid
  MOD_RES (459)..(473): Any amino acid
XXXNQKIMTIGSVSLALXXXXXXXXXXXXXXXXXXXXXXXXXXXXXXXXXXXXXXXXXXXXXXXXXXXXXXXXXXXXXXXXXXXXEPLCEVSGFAVVSKDNGIRXXXXXXXXXIREPFVACGPAECRTFFLTQGXXXXXXXXXXXXXXXXXXXXXXXXXLGSSPNAYQAQFESVXXXATACHDGKEWMXXXXSGADDEAYAVIHYGGVPTDVMRSWRRQILRTQESSCXXXXXXXXXXXXDGPANNQASYRIFKSXXXXXXXXXXISFQSGHIEECSCYPNLCQVECVCRDNWXXXXXXXXXXXXXXXXXXXXXXXXIPTDTPRFQDSXXXXXXXXXIGGSGTDNYGVXXXXXXQGNSVWAGRTMXXXSRSGFEVLFIEDGWXXXXXXXXXXXEVLNNKHWSGYSGSFTXXXXXXXXXXXXXXXXXXXXXXXPEEKTSIWTSSSSXXFCGVSSEVPGCXXXXXXXXXXXXXXX

SEQ ID NO: 419706 - protein, 473 aa, Influenza virus
  MOD_RES (1)..(5): Any amino acid
  MOD_RES (18)..(92): Any amino acid
  MOD_RES (107)..(122): Any amino acid
  MOD_RES (134)..(171): Any amino acid
  MOD_RES (189)..(205): Any amino acid
  MOD_RES (217)..(274): Any amino acid
  MOD_RES (291)..(369): Any amino acid
  MOD_RES (383)..(394): Any amino acid
  MOD_RES (410)..(433): Any amino acid
  MOD_RES (468)..(473): Any amino acid
XXXXXKIITIGSVSLTLXXXXXXXXXXXXXXXXXXXXXXXXXXXXXXXXXXXXXXXXXXXXXXXXXXXXXXXXXXXXXXXXXXXXXXXXXXXGFAIASKDNGIRIGXXXXXXXXXXXXXXXXSTECRTFFLTQXXXXXXXXXXXXXXXXXXXXXXXXXXXXXXXXXXXXXXESIAWSATACHDGKKWMXXXXXXXXXXXXXXXXXGGIPTDVIRSWXXXXXXXXXXXXXXXXXXXXXXXXXXXXXXXXXXXXXXXXXXXXXXXXXXXXXXXXXXECSCYPNLGIVECVCRXXXXXXXXXXXXXXXXXXXXXXXXXXXXXXXXXXXXXXXXXXXXXXXXXXXXXXXXXXXXXXXXXXXXXXXXXXXXXXXRSGFEILLIEEGWXXXXXXXXXXXXVLNNRNWSGYSGSFTXXXXXXXXXXXXXXXXXXXXXXXXEERPSIWTSSSSTVFCGVSSEVPEWSWDDGAILPXXXXXX

SEQ ID NO: 419707 - protein, 473 aa, Influenza virus
  MOD_RES (1)..(208): Any amino acid
  MOD_RES (224)..(399): Any amino acid
  MOD_RES (413)..(450): Any amino acid
  MOD_RES (464)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPTDVVRSWRRQILRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNWSGYSGAFTVPIXXXXXXXXXXXXXXXXXXXXXXXXXXXXXXXXXXXXXXVSSEVPGWSWGDGXXXXXXXXXX

SEQ ID NO: 419708 - protein, 473 aa, Influenza virus
  MOD_RES (1)..(401): Any amino acid
  MOD_RES (413)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGYSGAFTIPTXXXXXXXXXXXXXXXXXXXXXXXXXXXXXXXXXXXXXXXXXXXXXXXXXXXXXXXXXXXXX

SEQ ID NO: 419709 - protein, 473 aa, Influenza virus
  MOD_RES (1)..(401): Any amino acid
  MOD_RES (413)..(473): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGYSGAFTIPVXXXXXXXXXXXXXXXXXXXXXXXXXXXXXXXXXXXXXXXXXXXXXXXXXXXXXXXXXXXXX

SEQ ID NO: 419710 - protein, 471 aa, Influenza virus
  MOD_RES (20)..(55): Any amino acid
  MOD_RES (67)..(89): Any amino acid
  MOD_RES (128)..(128): Any amino acid
  MOD_RES (173)..(174): Any amino acid
  MOD_RES (210)..(214): Any amino acid
  MOD_RES (250)..(271): Any amino acid
  MOD_RES (286)..(288): Any amino acid
  MOD_RES (308)..(317): Any amino acid
  MOD_RES (331)..(343): Any amino acid
  MOD_RES (360)..(360): Any amino acid
  MOD_RES (386)..(397): Any amino acid
  MOD_RES (416)..(417): Any amino acid
  MOD_RES (437)..(438): Any amino acid
MNPNQKIICISATGMTLSVXXXXXXXXXXXXXXXXXXXXXXXXXXXXXXXXXXXXTTTTIINNNTQXXXXXXXXXXXXXXXXXXXXXXXKPLCEVNSWHILSKDNAIRIGEDAHILVTREPYLSCGPXECRMFALSQGTTLRGRHANGTIHDRSPFRALISWEMGQAPSPYNXXVECVGWSSTSCHDGISRMSICMSGPNNNASAVVWYXXXXXTEIASWAGNILRTQESECVCHNGICPVVMTDGPANXXXXXXXXXXXXXXXXXXXXXXGSAQHIEECSCYGAXXXIKCICRDNWKGANRPVITIXXXXXXXXXXYLCSKILTDTSRPXXXXXXXXXXXXXGGSPDPGVKGFAFLDGXNSWLGRTISKDSRSGYEMLKVPNAEXXXXXXXXXXXXIVNNQNWSGYSGAFIDYWXXRECFNPCFYVELIRGRPKEXXVLWTSNSIVALCGSKERLGSWSWHDGAEIIYFK

SEQ ID NO: 419711 - protein, 471 aa, Influenza virus
  MOD_RES (20)..(89): Any amino acid
  MOD_RES (128)..(128): Any amino acid
  MOD_RES (173)..(174): Any amino acid
  MOD_RES (210)..(214): Any amino acid
  MOD_RES (250)..(271): Any amino acid
  MOD_RES (286)..(288): Any amino acid
  MOD_RES (308)..(317): Any amino acid
  MOD_RES (331)..(343): Any amino acid
  MOD_RES (360)..(360): Any amino acid
  MOD_RES (386)..(397): Any amino acid
  MOD_RES (416)..(417): Any amino acid
  MOD_RES (437)..(438): Any amino acid
MNPNQKITCISATGVTLSVXXXXXXXXXXXXXXXXXXXXXXXXXXXXXXXXXXXXXXXXXXXXXXXXXXXXXXXXXXXXXXXXXXXXXXKPLCEVSSWHILSKDNAVRIGEDAHVLVTREPYLSCDPXGCRMFALSQGTTLKGRHANGTIHDRSQFRALISWEMGLAPSPYNXXVECIGWSSTSCHDGMSRMSICISGPNNNASAVIWYXXXXXTEIPSWAGNILRTQESECVCHKGICPVVMTDGPASXXXXXXXXXXXXXXXXXXXXXXGNAQHIEECSCYGSXXXVKCICRDNWKGANRPIITIXXXXXXXXXXYLCSKVLTDTSRPXXXXXXXXXXXXXGGGPDPGVKGFAFLNGXNSWLGRTTSKDSRSGYEVLKVPNAEXXXXXXXXXXXXIVNNQDWSGYSGAFMDYWXXKECFNPCFYVELIRGMPKEXXVFWTSNSIVALCGSRERLGSWSWHDGAEITYFK

SEQ ID NO: 419712 - protein, 471 aa, Influenza virus
  MOD_RES (20)..(89): Any amino acid
  MOD_RES (128)..(128): Any amino acid
  MOD_RES (173)..(174): Any amino acid
  MOD_RES (205)..(214): Any amino acid
  MOD_RES (250)..(271): Any amino acid
  MOD_RES (284)..(288): Any amino acid
  MOD_RES (308)..(317): Any amino acid
  MOD_RES (331)..(343): Any amino acid
  MOD_RES (360)..(361): Any amino acid
  MOD_RES (386)..(397): Any amino acid
  MOD_RES (416)..(417): Any amino acid
  MOD_RES (437)..(438): Any amino acid
MNPNQKIMCISATGMALSVXXXXXXXXXXXXXXXXXXXXXXXXXXXXXXXXXXXXXXXXXXXXXXXXXXXXXXXXXXXXXXXXXXXXXXKPLCAVNSWHILSKDNAIRIGENAHILVTREPYLSCEPXECRIFALSQGTTLRGQHANGTIHDRSPYRALISWEMGQAPSPYTXXIECIGWSSTSCHDGVSRMSVCMSGPNNNASXXXXXXXXXXTEIPSWEGNILRTQESECVCHKGVCPVVMTDGPADXXXXXXXXXXXXXXXXXXXXXXGSAEHIEECSCYXXXXXIKCVCRDNWKGANRPVIIIXXXXXXXXXXYLCSRILTDTSRPXXXXXXXXXXXXXGGTPDPGVKGFAFLDEXXSWLGRTISKDLRSGYEMLKVPDAEXXXXXXXXXXXXIINNQNWSGYSGSFIDYWXXKKCFNPCFYVELIRGRPREXXVWWTSNSIVALCGSKKRLGSWSWHDGAEIIYFE

SEQ ID NO: 419713 - protein, 471 aa, Influenza virus
  MOD_RES (1)..(1): Any amino acid
  MOD_RES (20)..(89): Any amino acid
  MOD_RES (123)..(139): Any amino acid
  MOD_RES (173)..(174): Any amino acid
  MOD_RES (207)..(214): Any amino acid
  MOD_RES (243)..(271): Any amino acid
  MOD_RES (284)..(288): Any amino acid
  MOD_RES (308)..(317): Any amino acid
  MOD_RES (331)..(343): Any amino acid
  MOD_RES (360)..(361): Any amino acid
  MOD_RES (383)..(397): Any amino acid
  MOD_RES (416)..(424): Any amino acid
  MOD_RES (436)..(438): Any amino acid
  MOD_RES (466)..(471): Any amino acid
XNPNQKIICISTTGMTLSVXXXXXXXXXXXXXXXXXXXXXXXXXXXXXXXXXXXXXXXXXXXXXXXXXXXXXXXXXXXXXXXXXXXXXXKSLCEVNSWHILSKDNAIRIGEEAHILVTREPYXXXXXXXXXXXXXXXXXTLRGRHANGTMHDRSPFRALVSWEMGQAPSPCNXXIECVGWSSTSCHDGRSRMSICVSGPNNNASAVXXXXXXXXTEIPSWAGNVLRTQESECVCHNGVCPVVXXXXXXXXXXXXXXXXXXXXXXXXXXXXXGKAQHIEECSCYXXXXXIKCICRDNWRGANRPVITIXXXXXXXXXXYLCSRVLTDTSRPXXXXXXXXXXXXXGGNPDPGVKGFAFLDRXXSWLGRTISKDTRSGYEMLKVPXXXXXXXXXXXXXXXIVDNQNWSGYSGAFVDYWXXXXXXXXXFYVELIRGKPKXXXVLWTSNSMVALCGSKEQLGSWSWHDGAXXXXXX

SEQ ID NO: 419714 - protein, 471 aa, Influenza virus
  MOD_RES (1)..(2): Any amino acid
  MOD_RES (14)..(90): Any amino acid
  MOD_RES (123)..(140): Any amino acid
  MOD_RES (173)..(178): Any amino acid
  MOD_RES (210)..(214): Any amino acid
  MOD_RES (226)..(231): Any amino acid
  MOD_RES (243)..(317): Any amino acid
  MOD_RES (331)..(347): Any amino acid
  MOD_RES (360)..(370): Any amino acid
  MOD_RES (386)..(398): Any amino acid
  MOD_RES (415)..(425): Any amino acid
  MOD_RES (437)..(439): Any amino acid
  MOD_RES (451)..(471): Any amino acid
XXPNQKIICISAAXXXXXXXXXXXXXXXXXXXXXXXXXXXXXXXXXXXXXXXXXXXXXXXXXXXXXXXXXXXXXXXXXXXXXXXXXXXXXPLCEVNSWHIFSKDNAIRIGEGAHILVTREPYXXXXXXXXXXXXXXXXXXLRGRHANGTINDRSPFRALVSWGMGQAPSPYNXXXXXXGWSSTSCHDGKSRMSICMSGPNDNASAVVWYXXXXXIEIPSWAGNILXXXXXXCVCHNGTCPVVXXXXXXXXXXXXXXXXXXXXXXXXXXXXXXXXXXXXXXXXXXXXXXXXXXXXXXXXXXXXXXXXXXXXXXXXXXXYLCSKTLTDTSRPXXXXXXXXXXXXXXXXXDPGIKGFAFLDGXXXXXXXXXXXDSRSGYEILKVPNAEXXXXXXXXXXXXXVNNPNWSGYSGAFINYXXXXXXXXXXXYAELIRGRPKEXXXLWTSNSVVALCXXXXXXXXXXXXXXXXXXXXX

SEQ ID NO: 419715 - protein, 471 aa, Influenza virus
  MOD_RES (1)..(8): Any amino acid
  MOD_RES (20)..(152): Any amino acid
  MOD_RES (171)..(217): Any amino acid
  MOD_RES (230)..(237): Any amino acid
  MOD_RES (250)..(372): Any amino acid
  MOD_RES (386)..(399): Any amino acid
  MOD_RES (411)..(444): Any amino acid
  MOD_RES (457)..(471): Any amino acid
XXXXXXXXCISATGMILSVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRSPFRALISWGMGQAPSPXXXXXXXXXXXXXXXXXXXXXXXXXXXXXXXXXXXXXXXXXXXXXXXPTWAGNILRTQEXXXXXXXXVCPVIMTDGPANXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRSGYEVLKVPDAEXXXXXXXXXXXXXXNNQKWSGYSGAXXXXXXXXXXXXXXXXXXXXXXXXXXXXXXXXXXSIVALCGSKEQLXXXXXXXXXXXXXXX

SEQ ID NO: 419716 - protein, 471 aa, Influenza virus
  MOD_RES (1)..(156): Any amino acid
  MOD_RES (169)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTLISWEMGQAPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419717 - protein, 471 aa, Influenza virus
  MOD_RES (16)..(20): Any amino acid
  MOD_RES (38)..(61): Any amino acid
  MOD_RES (73)..(82): Any amino acid
  MOD_RES (94)..(95): Any amino acid
  MOD_RES (164)..(168): Any amino acid
  MOD_RES (194)..(194): Any amino acid
  MOD_RES (239)..(267): Any amino acid
  MOD_RES (285)..(286): Any amino acid
  MOD_RES (308)..(317): Any amino acid
  MOD_RES (331)..(333): Any amino acid
  MOD_RES (357)..(358): Any amino acid
  MOD_RES (384)..(400): Any amino acid
  MOD_RES (416)..(416): Any amino acid
MNPNQKLFALSGVAIXXXXXNLLIGISNVGLNVSLHLXXXXXXXXXXXXXXXXXXXXXXXXENTYVNNTTVIXXXXXXXXXXYLMLNKSLCKVXXWVVVAKDNAIRFGESEQIIVTREPYVSCDPLGCKMYALHQGTTIRNKHSNGTIHDRTAFRGLISTPLGXXXXXSNSDFLCVGWSSTSCHDGIGRMTICXQGNNDNATATVYYDRRLTTTIKTWAGNILRTQESECVCHNGTCVXXXXXXXXXXXXXXXXXXXXXXXXXXXXXLKGSARHIEECSCYGHNXXVTCVCRDNWQGANRPVIEIDMXXXXXXXXXXCTGVLTDTSRPSDXXXGDCNNPITGSPGAPGVKGFGFLDXXNTWLGRTISPRSRSGFEMLKIPNAGXXXXXXXXXXXXXXXXXNWSGYSGSFIDYWDEXSECYNPCFYVELIRGRPEEAKYVWWTSNSLVALCGSPISVGSGSFPDGAQIQYFS

SEQ ID NO: 419718 - protein, 471 aa, Influenza virus
  MOD_RES (16)..(20): Any amino acid
  MOD_RES (38)..(61): Any amino acid
  MOD_RES (73)..(82): Any amino acid
  MOD_RES (94)..(95): Any amino acid
  MOD_RES (161)..(168): Any amino acid
  MOD_RES (194)..(194): Any amino acid
  MOD_RES (239)..(267): Any amino acid
  MOD_RES (285)..(286): Any amino acid
  MOD_RES (308)..(317): Any amino acid
  MOD_RES (331)..(333): Any amino acid
  MOD_RES (357)..(358): Any amino acid
  MOD_RES (384)..(400): Any amino acid
  MOD_RES (416)..(416): Any amino acid
  MOD_RES (471)..(471): Any amino acid
MNPNQKLFASSGIAIXXXXXNLIIGISNVGLNMSLHLXXXXXXXXXXXXXXXXXXXXXXXXENTYVNNTTIIXXXXXXXXXXYLLLNKSLCNVXXWVVIAKDNAVRFGESEQIIVTREPYVSCDPTGCRMYALHQGTTIRNRHSNGTIHDRTTFRGLLSTXXXXXXXXSNSDFMCVGWSSTTCHDGIARMTICXQGNNNNATATVYYDKRLTTTIKTWARNILRTQESECVCHNSTCVXXXXXXXXXXXXXXXXXXXXXXXXXXXXXLKGSAKHIEECSCYGHSXXATCVCRDNWQGANRPIIEIDMXXXXXXXXXXCTGILTDTSRPGDXXXGDCSNPITGSPGVPGVKGFGFLNXXNTWLGRTISPKLRSGFEMLKIPNAEXXXXXXXXXXXXXXXXXNLSGYSGSFIDYWNDXNECYNPCFYVELIRGRPEEVKYVWWTSNSLIALCGSPFPVGSGSFPDGARIQYFX

SEQ ID NO: 419719 - protein, 471 aa, Influenza virus
  MOD_RES (16)..(20): Any amino acid
  MOD_RES (38)..(61): Any amino acid
  MOD_RES (73)..(82): Any amino acid
  MOD_RES (94)..(95): Any amino acid
  MOD_RES (164)..(168): Any amino acid
  MOD_RES (194)..(194): Any amino acid
  MOD_RES (238)..(267): Any amino acid
  MOD_RES (284)..(286): Any amino acid
  MOD_RES (308)..(318): Any amino acid
  MOD_RES (331)..(333): Any amino acid
  MOD_RES (349)..(358): Any amino acid
  MOD_RES (384)..(400): Any amino acid
  MOD_RES (416)..(416): Any amino acid
  MOD_RES (429)..(429): Any amino acid
MNPNQKLFTLSGVAIXXXXXNLLIGISNMSLNISLYSXXXXXXXXXXXXXXXXXXXXXXXXKNTYVNNTTIIXXXXXXXXXXYLVLNKSLCKVXXWVVIAKDNAIRFGEGEQIIVTREPYVSCDPSSCKMYALHQGTTIRNKHSNSTTHDRTAFRGLMSTPLGXXXXXSNSDFICVGWSSTSCHDGVGRMTICXQGDNENATATVYYNRRLTTTIKPWARNILRTQESECVRHNGTCXXXXXXXXXXXXXXXXXXXXXXXXXXXXXXLRGSARHIEECPCYGHXXXITCVCRDNWQGANRPVIKIDMXXXXXXXXXXXTGVLTDTSRPKDXXXGECFNPITGSPGSPGXXXXXXXXXXNTWLGRTISTRSRSGFEMLKVPNAEXXXXXXXXXXXXXXXXXKWSGYSGSFIDYWDDXSVCYNPCFYVELXRGRPEEAKYVEWTSNSLIALCGSPIPVGPGSFPDGAQIKYFS

SEQ ID NO: 419720 - protein, 471 aa, Influenza virus
  MOD_RES (16)..(20): Any amino acid
  MOD_RES (33)..(61): Any amino acid
  MOD_RES (73)..(82): Any amino acid
  MOD_RES (94)..(95): Any amino acid
  MOD_RES (164)..(168): Any amino acid
  MOD_RES (194)..(194): Any amino acid
  MOD_RES (239)..(267): Any amino acid
  MOD_RES (285)..(286): Any amino acid
  MOD_RES (308)..(318): Any amino acid
  MOD_RES (331)..(334): Any amino acid
  MOD_RES (357)..(358): Any amino acid
  MOD_RES (382)..(416): Any amino acid
  MOD_RES (429)..(431): Any amino acid
  MOD_RES (470)..(471): Any amino acid
MNPSQKLFALSGVAVXXXXXNLLIGVSNVGLNXXXXXXXXXXXXXXXXXXXXXXXXXXXXXENKYVNNTTIIXXXXXXXXXXYLLLNKSLCSVXXWVAVAKDNAIRFGESEQVIVTREPYVSCDPIGCKMFALHQGTTIRNKHSNGTTHDRAAFRGLISTHLGXXXXXSNSEFICVGWSSTTCHDGVSRMTICXQGNNENATATVYYNKRLTTTIKTWAKNILRTQESECVCHNGTCAXXXXXXXXXXXXXXXXXXXXXXXXXXXXXLQGSARHIEECSCYGHDXXVSCVCRDNWQGANRPVIEINMXXXXXXXXXXXTGVLTDTSRPGDXXXXDCSNPITGSPSAPGVKGFGFLNXXSTWLGRTISPRLRSGFEMLKIHNXXXXXXXXXXXXXXXXXXXXXXXXXXXXXXXXXXXSKCYNPCFYVELXXXRPEEAKYVWWASNSLIALCGSPVPIGSGFFPDGPQIQYXX

SEQ ID NO: 419721 - protein, 471 aa, Influenza virus
  MOD_RES (12)..(20): Any amino acid
  MOD_RES (38)..(61): Any amino acid
  MOD_RES (73)..(82): Any amino acid
  MOD_RES (94)..(95): Any amino acid
  MOD_RES (110)..(115): Any amino acid
  MOD_RES (127)..(146): Any amino acid
  MOD_RES (164)..(168): Any amino acid
  MOD_RES (182)..(182): Any amino acid
  MOD_RES (194)..(194): Any amino acid
  MOD_RES (239)..(267): Any amino acid
  MOD_RES (279)..(286): Any amino acid
  MOD_RES (307)..(318): Any amino acid
  MOD_RES (331)..(334): Any amino acid
  MOD_RES (357)..(358): Any amino acid
  MOD_RES (383)..(416): Any amino acid
  MOD_RES (428)..(443): Any amino acid
  MOD_RES (455)..(455): Any amino acid
MNPNQNLFTLSXXXXXXXXXNLLIGISNVVLNVSLHLXXXXXXXXXXXXXXXXXXXXXXXXENTYVNKTTVIXXXXXXXXXXYLMLSKSLCKVXXWVVIAQDNAIRFGEXXXXXXTREPYVSCDPKXXXXXXXXXXXXXXXXXXXXTINDRTAFRGLISTQLGXXXXXSNSEFLCVGWSSTXCHDGVNRMTICXQGNNKNATATVYYDGRLTTTIKTWAGKILRTQESECVSHNGTWAXXXXXXXXXXXXXXXXXXXXXXXXXXXXXLKGSAMHIEECXXXXXXXXVTCICRDNWQGANRPAIEIDXXXXXXXXXXXXTGILTDTSRPSDXXXXDCSNPITGSPCAPGIKGFGFLNXXNTWLGGTISPRSRSGFEVLKVPNAXXXXXXXXXXXXXXXXXXXXXXXXXXXXXXXXXXSACYNPCFYVEXXXXXXXXXXXXXXXXNSLVALCGSPVXVGSGSFPNGAQIQYFS

SEQ ID NO: 419722 - protein, 471 aa, Influenza virus
  MOD_RES (1)..(1): Any amino acid
  MOD_RES (16)..(26): Any amino acid
  MOD_RES (38)..(96): Any amino acid
  MOD_RES (109)..(146): Any amino acid
  MOD_RES (158)..(197): Any amino acid
  MOD_RES (216)..(223): Any amino acid
  MOD_RES (236)..(269): Any amino acid
  MOD_RES (283)..(287): Any amino acid
  MOD_RES (301)..(345): Any amino acid
  MOD_RES (357)..(359): Any amino acid
  MOD_RES (381)..(456): Any amino acid
XNPNQKLFALSEVAIXXXXXXXXXXXSNIGLNVSLHLXXXXXXXXXXXXXXXXXXXXXXXXXXXXXXXXXXXXXXXXXXXXXXXXXXXXXXXXXXXVVIEKDNAVRFGXXXXXXXXXXXXXXXXXXXXXXXXXXXXXXXXXXXXXXTIHDRNAFRGLXXXXXXXXXXXXXXXXXXXXXXXXXXXXXXXXXXXXXXXXNDNATATVYYNGRLTTTIXXXXXXXXRTQDSECVSHNGXXXXXXXXXXXXXXXXXXXXXXXXXXXXXXXXXXGSARHVEECSCYGXXXXXTCVCRDNWRGANRXXXXXXXXXXXXXXXXXXXXXXXXXXXXXXXXXXXXXXXXXXXXXAPGTKGFGFLNXXXTWLGRTFSPRSRSGFEMLKIHXXXXXXXXXXXXXXXXXXXXXXXXXXXXXXXXXXXXXXXXXXXXXXXXXXXXXXXXXXXXXXXXXXXXXXXXXXXXGSGSFPDGAKIQYFS

SEQ ID NO: 419723 - protein, 471 aa, Influenza virus
  MOD_RES (1)..(2): Any amino acid
  MOD_RES (15)..(149): Any amino acid
  MOD_RES (161)..(204): Any amino acid
  MOD_RES (221)..(227): Any amino acid
  MOD_RES (239)..(270): Any amino acid
  MOD_RES (285)..(359): Any amino acid
  MOD_RES (384)..(458): Any amino acid
XXPKSKLFTLSGVAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGTAFRGLISTXXXXXXXXXXXXXXXXXXXXXXXXXXXXXXXXXXXXXXXXXXXXVYYNRRPTTTIKTWARXXXXXXXSECVCHNGTCGXXXXXXXXXXXXXXXXXXXXXXXXXXXXXXXXSARHIEEWSCYGHSXXXXXXXXXXXXXXXXXXXXXXXXXXXXXXXXXXXXXXXXXXXXXXXXXXXXXXXXXXXXXXXXXXXXXXXXXXXTWLGRTISPHSRSGFEMLRIPNAGXXXXXXXXXXXXXXXXXXXXXXXXXXXXXXXXXXXXXXXXXXXXXXXXXXXXXXXXXXXXXXXXXXXXXXXXXXXGSLPDGAQIQYFS

SEQ ID NO: 419724 - protein, 471 aa, Influenza virus
  MOD_RES (1)..(152): Any amino acid
  MOD_RES (164)..(208): Any amino acid
  MOD_RES (220)..(372): Any amino acid
  MOD_RES (384)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRGLISTPLGXXXXXXXXXXXXXXXXXXXXXXXXXXXXXXXXXXXXXXXXXXXXXRRLTTTVKTWAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFEMLKVPNAGXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419725 - protein, 548 aa, Influenza virus
  MOD_RES (1)..(168): Any amino acid
  MOD_RES (201)..(201): Any amino acid
  MOD_RES (237)..(237): Any amino acid
  MOD_RES (266)..(294): Any amino acid
  MOD_RES (326)..(344): Any amino acid
  MOD_RES (381)..(383): Any amino acid
  MOD_RES (408)..(417): Any amino acid
  MOD_RES (435)..(470): Any amino acid
  MOD_RES (489)..(492): Any amino acid
  MOD_RES (510)..(510): Any amino acid
  MOD_RES (527)..(529): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGFAPFSKDNGIRIGSRGHVFVIREPFVSCSPXECRTFFLTQGSLLNDKHSNGTVKDRSPYRTLMSVEXGQSPNVYQARFEAVAWSATACHDGKKWMXXXXXXXXXXXXXXXXXXXXXXXXXXXXXGDILRTQESSCTCIQGECYWVMTDGPANRQAXXXXXXXXXXXXXXXXXXXFNGGHIEECSCYPNEGKVECVCRDNWTGTNRPVLVIXXXLSYRVGYLCAGLPSDTPRGEDSQFXXXXXXXXXXQGYGVKGFGFRQGNDVWXXXXXXXXXXXXXXXXXXXXXXXXXXXXXXXXXXXXDNLNWSGYSGSFTLPVELXXXXCLVPCFWVEMIRGKPEEXTIWTSSSSIVMCGVDHXXXDWSWHDGAILPFDFDKISQ

SEQ ID NO: 419726 - protein, 548 aa, Influenza virus
  MOD_RES (1)..(168): Any amino acid
  MOD_RES (199)..(201): Any amino acid
  MOD_RES (237)..(237): Any amino acid
  MOD_RES (266)..(294): Any amino acid
  MOD_RES (326)..(344): Any amino acid
  MOD_RES (381)..(383): Any amino acid
  MOD_RES (408)..(417): Any amino acid
  MOD_RES (435)..(470): Any amino acid
  MOD_RES (489)..(495): Any amino acid
  MOD_RES (510)..(510): Any amino acid
  MOD_RES (527)..(529): Any amino acid
  MOD_RES (542)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQGFAPFSKDNGVRIGSRGHIFVIREPFVSCXXXGCRTFFLTQGSLPNDKHSNGTIKDRSPYRTLMSVKXGQSPNVYQAKFESVAWSATACHDGRKWMXXXXXXXXXXXXXXXXXXXXXXXXXXXXXGNILRTQESSCTCIKGDCYWVMTDGPANKQAXXXXXXXXXXXXXXXXXXXFSGGHIEECSCYPNDGKVECVCRDNWTGTNRPILVIXXXLSYTVGYLCAGIPTDTPRGEDSQFXXXXXXXXXXKGYGVKGFGFRQGTDVWXXXXXXXXXXXXXXXXXXXXXXXXXXXXXXXXXXXXDDPNWSGYSGSFTLPIELXXXXXXXPCFWVEMIRGEPEEXTIWTSSSSVVMCGVDHXXXSWSWHDGAILPLXXXXXXX

SEQ ID NO: 419727 - protein, 548 aa, Influenza virus
  MOD_RES (1)..(168): Any amino acid
  MOD_RES (201)..(201): Any amino acid
  MOD_RES (237)..(237): Any amino acid
  MOD_RES (266)..(294): Any amino acid
  MOD_RES (326)..(344): Any amino acid
  MOD_RES (381)..(383): Any amino acid
  MOD_RES (408)..(417): Any amino acid
  MOD_RES (435)..(470): Any amino acid
  MOD_RES (489)..(495): Any amino acid
  MOD_RES (510)..(510): Any amino acid
  MOD_RES (527)..(529): Any amino acid
  MOD_RES (542)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGFAPFSKDNGIRIGSKGHVFVIREPFISCSPXECRTFFLTHGSLLNDKHSNGTMKDRSPYRTLMSVGXGQSPNVYQSRFEAVAWSATACHDGKKWTXXXXXXXXXXXXXXXXXXXXXXXXXXXXXGDIMRTQESSCTCIRGECFWVMTDGPANSQAXXXXXXXXXXXXXXXXXXXFDGGHIEECSCYPNNGKVECICRDNWTGTNRPVLIIXXXLSYKVGYLCAGIPSDTPRGEDAQFXXXXXXXXXXLGYGVKGFGFRQGDDVWXXXXXXXXXXXXXXXXXXXXXXXXXXXXXXXXXXXXDNSNWSGYSGSFTLPVGLXXXXXXXPCFWVEMIRGRPEEXTVWTSSSSIVMCGVNYXXXDWSWHDGAVLPFXXXXXXX

SEQ ID NO: 419728 - protein, 548 aa, Influenza virus
  MOD_RES (1)..(168): Any amino acid
  MOD_RES (191)..(201): Any amino acid
  MOD_RES (237)..(237): Any amino acid
  MOD_RES (266)..(294): Any amino acid
  MOD_RES (306)..(309): Any amino acid
  MOD_RES (326)..(344): Any amino acid
  MOD_RES (380)..(383): Any amino acid
  MOD_RES (395)..(395): Any amino acid
  MOD_RES (408)..(421): Any amino acid
  MOD_RES (435)..(470): Any amino acid
  MOD_RES (489)..(498): Any amino acid
  MOD_RES (510)..(510): Any amino acid
  MOD_RES (527)..(529): Any amino acid
  MOD_RES (541)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGFAPFSKDNGIRIGSRGHIFVXXXXXXXXXXXDCRTFFLTQGSLVNDRHSNGTVKDRSPFRTLMSVEXGLSPNVYQARFESVAWSATACHDGKKWIXXXXXXXXXXXXXXXXXXXXXXXXXXXXXGDILRTQEFSCXXXXGNCYWVMTDGPANNQAXXXXXXXXXXXXXXXXXXXFNEGHIEECSCYPNEGKVECICRDNWTGTNRPILAXXXXLSYQVGYLCAGXPSDTPRGEDNQFXXXXXXXXXXXXXXVKGFGFRQGSDVWXXXXXXXXXXXXXXXXXXXXXXXXXXXXXXXXXXXXDNPNWSGYSGSFTLPVEMXXXXXXXXXXWVETIRGKPEEXAIWTSSSSIVMCGVDYXXXSWSWHDGAVLPXXXXXXXX

SEQ ID NO: 419729 - protein, 548 aa, Influenza virus
  MOD_RES (1)..(169): Any amino acid
  MOD_RES (201)..(203): Any amino acid
  MOD_RES (222)..(225): Any amino acid
  MOD_RES (237)..(242): Any amino acid
  MOD_RES (258)..(294): Any amino acid
  MOD_RES (308)..(344): Any amino acid
  MOD_RES (357)..(368): Any amino acid
  MOD_RES (380)..(383): Any amino acid
  MOD_RES (395)..(395): Any amino acid
  MOD_RES (408)..(515): Any amino acid
  MOD_RES (527)..(529): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLAPFSKDNGIRIGSRGHVFIIREPFVSCSPXXXRTFFITQGSLLNDKHFNGXXXXRSPFRTLMSVKXXXXXXVYQAKFEAVAWSATAXXXXXXXXXXXXXXXXXXXXXXXXXXXXXXXXXXXXXRDILRTQESSCSCXXXXXXXXXXXXXXXXXXXXXXXXXXXXXXXXXXXXXFTEGHIEECSCYXXXXXXXXXXXXNWIGTNRPVLVXXXXLSYSVGYLCAGXPSDTPRGEDGQFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSSIVMCGVEHXXXNWSWHDGAILPFDIDKIIT

SEQ ID NO: 419730 - protein, 548 aa, Influenza virus
  MOD_RES (1)..(203): Any amino acid
  MOD_RES (223)..(249): Any amino acid
  MOD_RES (262)..(298): Any amino acid
  MOD_RES (311)..(369): Any amino acid
  MOD_RES (381)..(530): Any amino acid
  MOD_RES (542)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTFFLTQGSLLNDRHSNGTXXXXXXXXXXXXXXXXXXXXXXXXXXXAIAWSATACHDGXXXXXXXXXXXXXXXXXXXXXXXXXXXXXXXXXXXXXRTQESSCTCILGXXXXXXXXXXXXXXXXXXXXXXXXXXXXXXXXXXXXXXXXXXXXXXXXXXXXXXXXXXXWTGTNRPVLVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSWQDGAILPFXXXXXXX

SEQ ID NO: 419731 - protein, 548 aa, Influenza virus
  MOD_RES (1)..(211): Any amino acid
  MOD_RES (231)..(369): Any amino acid
  MOD_RES (381)..(548): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLLNDKHSSGTVKDRSPFRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWTGTNRPVLMIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419732 - protein, 470 aa, Influenza virus
  MOD_RES (16)..(26): Any amino acid
  MOD_RES (40)..(84): Any amino acid
  MOD_RES (211)..(211): Any amino acid
  MOD_RES (260)..(269): Any amino acid
  MOD_RES (286)..(288): Any amino acid
  MOD_RES (310)..(310): Any amino acid
  MOD_RES (359)..(359): Any amino acid
  MOD_RES (392)..(392): Any amino acid
MNPNQKILCTSATAIXXXXXXXXXXXANLGLNIGLHLKPXXXXXXXXXXXXXXXXXXXXXXXXXXXXXXXXXXXXXXXXXXXXXFNNLTKGLCTINSWHIYGKDNAVRIGEDSDVLVTREPYVSCDPDECRFYALSQGTTIRGKHSNGTIHDRSQYRALISWPLSSPPTVYNSRVECIGWSSTSCHDGRARMSICISGPNNNASAVIWYNXRPVTEINTWARNILRTQESECVCHNGVCPVVFTDGSATGPAETRVYYFXXXXXXXXXXLTGTAKHIEECSCYGEXXXITCTCRDNWQGSNRPVIQIDPXAMTHTSQYICSPVLTDNPRPNDPAVGKCNDPYPGNNNNGVKGFSYLDGXNTWLGRTISTASRSGYEMLKVPNALTDDRSKPXQGQTIVLNTDWSGYSGSFMDYWAEGECYRACFYVELIRGRPKEDKVWWTSNSIVSMCSSTEFLGQWNWPDGAKIEYFL

SEQ ID NO: 419733 - protein, 470 aa, Influenza virus
  MOD_RES (16)..(26): Any amino acid
  MOD_RES (40)..(84): Any amino acid
  MOD_RES (211)..(211): Any amino acid
  MOD_RES (260)..(269): Any amino acid
  MOD_RES (284)..(288): Any amino acid
  MOD_RES (310)..(310): Any amino acid
  MOD_RES (359)..(359): Any amino acid
  MOD_RES (392)..(392): Any amino acid
  MOD_RES (447)..(448): Any amino acid
  MOD_RES (470)..(470): Any amino acid
MNPNQKILCASATAIXXXXXXXXXXXVNLGLNIGLHLRPXXXXXXXXXXXXXXXXXXXXXXXXXXXXXXXXXXXXXXXXXXXXXFNNLTRELCTINSWHIYGKDNAIRIGENSDVLVTREPYVSCEPDECRFYALSQGTTIRGRHSNGTIHDRSQYRSLISWPLSSPPTVYNTRIECIGWSSTSCHDGKSRMSICVSGPNNNASAVVWYNXRPVAEINTWARNILRTQESECVCHSGICPVVFTDGSATGPADTRIYYFXXXXXXXXXXLAGTAKHIEECSSYXXXXXVTCTCRDNWQGSNRPVIRIDPXVMTHTSQYICSPILTDNPRPNDPTIGKCNDPYPGNNBNGVKGFSYLNGXNTWLGRTISIASRSGYEMLKVPNALTDNRSKPXQGQTVVLNTDWSGYSGSFIDYWAKGECYRACFYVELIRGRPKEEKVWWTSNSIVXXCSSTEFLGQWDWPDGAKIEYFX

SEQ ID NO: 419734 - protein, 470 aa, Influenza virus
  MOD_RES (16)..(26): Any amino acid
  MOD_RES (40)..(84): Any amino acid
  MOD_RES (139)..(149): Any amino acid
  MOD_RES (211)..(211): Any amino acid
  MOD_RES (225)..(225): Any amino acid
  MOD_RES (260)..(269): Any amino acid
  MOD_RES (286)..(288): Any amino acid
  MOD_RES (310)..(310): Any amino acid
  MOD_RES (322)..(323): Any amino acid
  MOD_RES (359)..(359): Any amino acid
  MOD_RES (392)..(392): Any amino acid
  MOD_RES (448)..(454): Any amino acid
MNPNQKILFASATAIXXXXXXXXXXXANLGLNVGLHLKPXXXXXXXXXXXXXXXXXXXXXXXXXXXXXXXXXXXXXXXXXXXXXFNNLTRGLCTINSWHIFGKDNAIRIGEDSDILVTREPYVSCDPNECRFYALSQGXXXXXXXXXXXIHDRSQYRALVSWPLSSPPTVYNNKVECIGWSSTSCHDGKARMSVCISGPNNNASAIVWYNXRPITEINTWARNIXRTEESECVCHNGICPVVFTDGSATGPAETRIYYFXXXXXXXXXXLNGTAKHIEECSCYGVXXXIICTCRDNWQGSNRPVIQINPXMMTHTSQYICSXXLTDNPRPNDPNVGKCNEPYPGNNNNGVKGFAYLDGXNTWLGRTLNTASRSGYEMLKVPNALTNDRSKPXQGQTIVLTTDWSGYSGSFVDYWAEGDCYRACFYVELIRGRPKEDRVWWTSNSIVSXXXXXXXLGQWNWPDGAEIEYFL

SEQ ID NO: 419735 - protein, 470 aa, Influenza virus
  MOD_RES (14)..(26): Any amino acid
  MOD_RES (38)..(84): Any amino acid
  MOD_RES (140)..(153): Any amino acid
  MOD_RES (174)..(179): Any amino acid
  MOD_RES (194)..(196): Any amino acid
  MOD_RES (208)..(211): Any amino acid
  MOD_RES (225)..(227): Any amino acid
  MOD_RES (260)..(271): Any amino acid
  MOD_RES (283)..(310): Any amino acid
  MOD_RES (322)..(323): Any amino acid
  MOD_RES (335)..(336): Any amino acid
  MOD_RES (358)..(359): Any amino acid
  MOD_RES (392)..(392): Any amino acid
  MOD_RES (404)..(405): Any amino acid
  MOD_RES (418)..(427): Any amino acid
  MOD_RES (448)..(457): Any amino acid
  MOD_RES (470)..(470): Any amino acid
MNPNQRILCTSATXXXXXXXXXXXXXTNLGLNIGLHLXXXXXXXXXXXXXXXXXXXXXXXXXXXXXXXXXXXXXXXXXXXXXXXFNNLTKRLCTINSWHIYGKDNAVRIGENSGVLVTREPYVSCDPDGCRFYALSQGTXXXXXXXXXXXXXXSQYRALISWPQSSPPTVYNSXXXXXXWSSTSCHDGKFRMSXXXSGPNNNASTVIXXXXRPTTEINTWARNIXXXQESECVCHNGICPVAFTDGSATGPADTRVYYFXXXXXXXXXXXXGTATHIEECSCXXXXXXXXXXXXXXXXXXXXXXXXXXXXTMTHTSQYICSXXLTDNPRPNDPVXXKCNDPYPGSNNNGVKGFSYLNXXNTWLGRTTSTASRSGYEVLRVPNALTDDKSKPXQGQIIVLNTDWXXYSGSFIDYWAEGXXXXXXXXXXLIRGRPKEDEVWWTSNSIVSXXXXXXXXXXWNWPDGAKIETLX

SEQ ID NO: 419736 - protein, 470 aa, Influenza virus
  MOD_RES (1)..(2): Any amino acid
  MOD_RES (16)..(84): Any amino acid
  MOD_RES (120)..(179): Any amino acid
  MOD_RES (194)..(197): Any amino acid
  MOD_RES (211)..(227): Any amino acid
  MOD_RES (247)..(273): Any amino acid
  MOD_RES (286)..(310): Any amino acid
  MOD_RES (335)..(337): Any amino acid
  MOD_RES (353)..(363): Any amino acid
  MOD_RES (390)..(393): Any amino acid
  MOD_RES (428)..(435): Any amino acid
  MOD_RES (457)..(458): Any amino acid
XXPNQKILCTSAIAIXXXXXXXXXXXXXXXXXXXXXXXXXXXXXXXXXXXXXXXXXXXXXXXXXXXXXXXXXXXXXXXXXXXXXFNNLTKGLCIINSWHIYGKDNAIRIGGNSDVLVTRXXXXXXXXXXXXXXXXXXXXXXXXXXXXXXXXXXXXXXXXXXXXXXXXXXXXXXXXXXXXWSSTSCHDGKTRMSXXXXGPNNNASAIIWYNXXXXXXXXXXXXXXXXXQESECVCHDGVCPVVFTDGXXXXXXXXXXXXXXXXXXXXXXXXXXXARHIEECSCYGDXXXXXXXXXXXXXXXXXXXXXXXXXAMKHTSQYICSPVLTDNPRPNDPSXXXCNDPYPGNNNKGVKGXXXXXXXXXXXGRTISTASRAGYEMLKVPNALTDDKSXXXXGQTIVLDTDWSGYSGSFIDYWAKEECYRACFYVEXXXXXXXXDKVWWTSNSIISMCSSTEFLGXXDWPDGAKIKYFL

SEQ ID NO: 419737 - protein, 470 aa, Influenza virus
  MOD_RES (1)..(3): Any amino acid
  MOD_RES (16)..(85): Any amino acid
  MOD_RES (119)..(198): Any amino acid
  MOD_RES (210)..(227): Any amino acid
  MOD_RES (245)..(274): Any amino acid
  MOD_RES (286)..(337): Any amino acid
  MOD_RES (354)..(363): Any amino acid
  MOD_RES (392)..(397): Any amino acid
  MOD_RES (410)..(411): Any amino acid
  MOD_RES (427)..(470): Any amino acid
XXXSQKILCTSATALXXXXXXXXXXXXXXXXXXXXXXXXXXXXXXXXXXXXXXXXXXXXXXXXXXXXXXXXXXXXXXXXXXXXXXNNLTRGLCKINSWHIFGKDNAVRIGESSDVLVTXXXXXXXXXXXXXXXXXXXXXXXXXXXXXXXXXXXXXXXXXXXXXXXXXXXXXXXXXXXXXXXXXXXXXXXXXXXXXXXXPNNNASPVIWYXXXXXXXXXXXXXXXXXXQESECVCQNGVCPVVFTXXXXXXXXXXXXXXXXXXXXXXXXXXXXXXKHIEECSCYGKXXXXXXXXXXXXXXXXXXXXXXXXXXXXXXXXXXXXXXXXXXXXXXXXXXXXCNDPYPGNNNGVKGFSXXXXXXXXXXGRTINTASRSGYEILKVPNALTDERSKPXXXXXXVSNTDWSGYSGSXXDYWAKGDCYRACFYVXXXXXXXXXXXXXXXXXXXXXXXXXXXXXXXXXXXXXXXXXXXX

SEQ ID NO: 419738 - protein, 470 aa, Influenza virus
  MOD_RES (1)..(86): Any amino acid
  MOD_RES (105)..(108): Any amino acid
  MOD_RES (123)..(199): Any amino acid
  MOD_RES (211)..(232): Any amino acid
  MOD_RES (246)..(343): Any amino acid
  MOD_RES (359)..(364): Any amino acid
  MOD_RES (391)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXNLTKELCTINSWHIHGKDXXXXIGEKSDVLVTREPYXXXXXXXXXXXXXXXXXXXXXXXXXXXXXXXXXXXXXXXXXXXXXXXXXXXXXXXXXXXXXXXXXXXXXXXXXXXXXNNNASAVIWYKXXXXXXXXXXXXXXXXXXXXXXVCHSGVCPVVFTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNSNNGVKGFSYLDEXXXXXXRTISTASRYGYEMLKVPNALIDDRSKXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419739 - protein, 470 aa, Influenza virus
  MOD_RES (1)..(111): Any amino acid
  MOD_RES (123)..(367): Any amino acid
  MOD_RES (380)..(470): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDSDVLVTRESYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIASRSGYEILKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419740 - protein, 568 aa, Influenza virus
  MOD_RES (1)..(15): Any amino acid
  MOD_RES (32)..(39): Any amino acid
  MOD_RES (53)..(110): Any amino acid
  MOD_RES (126)..(168): Any amino acid
  MOD_RES (184)..(203): Any amino acid
  MOD_RES (245)..(248): Any amino acid
  MOD_RES (268)..(286): Any amino acid
  MOD_RES (321)..(321): Any amino acid
  MOD_RES (337)..(337): Any amino acid
  MOD_RES (483)..(486): Any amino acid
  MOD_RES (541)..(551): Any amino acid
XXXXXXXXXXXXXXXGLDKICLGHHAVSNGTXXXXXXXXKEEVTNATETVESXXXXXXXXXXXXXXXXXXXXXXXXXXXXXXXXXXXXXXXXXXXXXXXXXXXXXXXXXXNEEALRQKIMESGGIXXXXXXXXXXXXXXXXXXXXXXXXXXXXXXXXXXXXXXXXXXXQNFPQTTNTYRNTDSXXXXXXXXXXXXXXXXXXXXLYGTQSLSISVGSSTYQNNFVPVVGARPQVNGQSGRIDFHWXXXXPGDNITFSHNGGLIAPSRVXXXXXXXXXXXXXXXXXXXCESKCFWKGGSINTKLPFQNLSPRTVGQCPKYVNXKSLLLATGMRNVPEVXQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHXXXXNCMESIRNNTYDHTQYREEALLNRLNINPVKLSSGYKDVILWFSFGASCFVLLAXXXXXXXXXXXNGNMRCTISLVKTTLFL

SEQ ID NO: 419741 - protein, 568 aa, Influenza virus
  MOD_RES (1)..(15): Any amino acid
  MOD_RES (32)..(39): Any amino acid
  MOD_RES (53)..(110): Any amino acid
  MOD_RES (125)..(168): Any amino acid
  MOD_RES (184)..(203): Any amino acid
  MOD_RES (245)..(248): Any amino acid
  MOD_RES (268)..(286): Any amino acid
  MOD_RES (321)..(321): Any amino acid
  MOD_RES (337)..(337): Any amino acid
  MOD_RES (397)..(400): Any amino acid
  MOD_RES (422)..(424): Any amino acid
  MOD_RES (462)..(464): Any amino acid
  MOD_RES (483)..(486): Any amino acid
  MOD_RES (541)..(568): Any amino acid
XXXXXXXXXXXXXXXGIDKICLGHHAVPNGTXXXXXXXXQEEVTNATETVENXXXXXXXXXXXXXXXXXXXXXXXXXXXXXXXXXXXXXXXXXXXXXXXXXXXXXXXXXXNEGALRQKIMESGEXXXXXXXXXXXXXXXXXXXXXXXXXXXXXXXXXXXXXXXXXXXXQNFPQTANTYRNTDSXXXXXXXXXXXXXXXXXXXXLYGTQSLSISIGSSTYQNNFVPVIGARPQVNGQRGRIDFHWXXXXPGDSITFSHNGGRIAPSRVXXXXXXXXXXXXXXXXXXXCESKCFWRGGSINTRLPFQNLSPRTVGQCPKYVSXRSLLLATGMRNVPEIXQERGLFGAIAGFIENGWEGMIDGWYGFRHQNAQGIGQAADYKSTQTAINQITGKLNRLIXXXXTEFESIESEFNEIEHQIGNVIXXXKDSITYIWTYQAELLVAMENQHTIDMGDSEMLNLYERXXXQLRQNAEEDGRGCFEIYHXXXXSCMESIRNNTYNHTQYREESLLNRLSINPVTLSSGYKDIILWFSFGASCFILLAXXXXXXXXXXXXXXXXXXXXXXXXXXXX

SEQ ID NO: 419742 - protein, 568 aa, Influenza virus
  MOD_RES (1)..(15): Any amino acid
  MOD_RES (32)..(39): Any amino acid
  MOD_RES (53)..(110): Any amino acid
  MOD_RES (126)..(168): Any amino acid
  MOD_RES (184)..(203): Any amino acid
  MOD_RES (245)..(248): Any amino acid
  MOD_RES (265)..(286): Any amino acid
  MOD_RES (321)..(321): Any amino acid
  MOD_RES (337)..(337): Any amino acid
  MOD_RES (361)..(364): Any amino acid
  MOD_RES (376)..(383): Any amino acid
  MOD_RES (396)..(402): Any amino acid
  MOD_RES (424)..(429): Any amino acid
  MOD_RES (462)..(486): Any amino acid
  MOD_RES (541)..(568): Any amino acid
XXXXXXXXXXXXXXXGLDRICLGHHAVANGTXXXXXXXXHEEVTNATETVETXXXXXXXXXXXXXXXXXXXXXXXXXXXXXXXXXXXXXXXXXXXXXXXXXXXXXXXXXXSEEALRQKIMESGGVXXXXXXXXXXXXXXXXXXXXXXXXXXXXXXXXXXXXXXXXXXXQNFPRTTNTYRNTDSXXXXXXXXXXXXXXXXXXXXLYGAQSLSISVGSSIYQNSFVPVVGARPKVNGQSGRIEFHWXXXXPGHNITFSHNGGLVAPXXXXXXXXXXXXXXXXXXXXXXCKSKCFWRGGSIITELPFQNLSPRTVGQCPKYVKXKSLMLATGMRNVPETXQGRGLFGAKAGFIENGWEGMVNGXXXXRHQNAQGTGQVXXXXXXXXAVDQITGKLNRLXXXXXXXFESIESEFSETEHQIGNVINWXXXXXXDIWTYNAELLVAMENQHTIEMTDSEMLNLYERXXXXXXXXXXXXXXXXXXXXXXXXXDCMESIRNNTYDHSQYREEALLNRININPVELSSGYKNVILWFSFGASSFVLLAXXXXXXXXXXXXXXXXXXXXXXXXXXXX

SEQ ID NO: 419743 - protein, 568 aa, Influenza virus
  MOD_RES (1)..(15): Any amino acid
  MOD_RES (30)..(39): Any amino acid
  MOD_RES (51)..(114): Any amino acid
  MOD_RES (126)..(168): Any amino acid
  MOD_RES (184)..(203): Any amino acid
  MOD_RES (245)..(248): Any amino acid
  MOD_RES (268)..(286): Any amino acid
  MOD_RES (310)..(321): Any amino acid
  MOD_RES (333)..(348): Any amino acid
  MOD_RES (360)..(365): Any amino acid
  MOD_RES (399)..(404): Any amino acid
  MOD_RES (426)..(430): Any amino acid
  MOD_RES (465)..(486): Any amino acid
  MOD_RES (517)..(517): Any amino acid
  MOD_RES (536)..(568): Any amino acid
XXXXXXXXXXXXXXXSLDKICLGHHAVANXXXXXXXXXXKEKVTNATETVXXXXXXXXXXXXXXXXXXXXXXXXXXXXXXXXXXXXXXXXXXXXXXXXXXXXXXXXXXXXXXXXLRQKVMESGGIXXXXXXXXXXXXXXXXXXXXXXXXXXXXXXXXXXXXXXXXXXXQSFPQTTNTYRNTDTXXXXXXXXXXXXXXXXXXXXLYGTQPLSISVGSSTYQSNFVPVMGARPQVNGQSGRIVFHWXXXXPGDHITFSHNGGLIAPDRVXXXXXXXXXXXXXXXXXXXCESKCFWKGGTIKTKLPFQNLSPXXXXXXXXXXXXRSLMLATGMRNXXXXXXXXXXXXXXXXFLENGWEGMVDXXXXXXHQNDQGTGQAADYKSTQKTIDQVTGKLNRLIEKXXXXXXSIESEFNEIEYQIGNVINWTKXXXXXIWTYQEELLVAMENQHTIDMADSTMLNLYERVRKXXXXXXXXXXXXXXXXXXXXXXSCMERIRNNTYDHAQYREEALLNRLSINPVXLFSGYKDIILWFSFGASSXXXXXXXXXXXXXXXXXXXXXXXXXXXXXXXXX

SEQ ID NO: 419744 - protein, 568 aa, Influenza virus
  MOD_RES (1)..(17): Any amino acid
  MOD_RES (32)..(39): Any amino acid
  MOD_RES (51)..(168): Any amino acid
  MOD_RES (184)..(204): Any amino acid
  MOD_RES (245)..(248): Any amino acid
  MOD_RES (268)..(287): Any amino acid
  MOD_RES (306)..(321): Any amino acid
  MOD_RES (333)..(366): Any amino acid
  MOD_RES (397)..(407): Any amino acid
  MOD_RES (423)..(433): Any amino acid
  MOD_RES (471)..(486): Any amino acid
  MOD_RES (524)..(568): Any amino acid
XXXXXXXXXXXXXXXXXDKICLGHHAVTNGTXXXXXXXXMEEVTNATETVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNFPQTTNTYRNTDPXXXXXXXXXXXXXXXXXXXXXYGTQSLSISVESSTYQNNFVPVMGARPLVNGQSGRINFHWXXXXPGDNIIFSHNGGLIAPNRVXXXXXXXXXXXXXXXXXXXXESKCFWKSGSINTKLPFQXXXXXXXXXXXXXXXXGSLLLATGMRNXXXXXXXXXXXXXXXXXXXXXXXXXXXXXXXXXXQNAQGTGLAADYKSTQAAVVQITGKLNRLIXXXXXXXXXXXSEFSEIEHQISNVINXXXXXXXXXXXYQAELLIAMENQHTIDMADSEMLNLYDRVRKQLRQNAXXXXXXXXXXXXXXXXNCMERIRNNTYDHSHYREEALLNRLNINSVKLSSGYKXXXXXXXXXXXXXXXXXXXXXXXXXXXXXXXXXXXXXXXXXXXXX

SEQ ID NO: 419745 - protein, 568 aa, Influenza virus
  MOD_RES (1)..(207): Any amino acid
  MOD_RES (239)..(249): Any amino acid
  MOD_RES (268)..(288): Any amino acid
  MOD_RES (308)..(368): Any amino acid
  MOD_RES (396)..(444): Any amino acid
  MOD_RES (461)..(501): Any amino acid
  MOD_RES (517)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXESLSISVGSSTYHNSFVPVVRARPQVNGQSGXXXXXXXXXXXGDNITFLHNGGLIAPTRVXXXXXXXXXXXXXXXXXXXXXSKCFWKGGSIKTKLPFQNLXXXXXXXXXXXXXXXXXXXXXXXXXXXXXXXXXXXXXXXXXXXXXXXXXXXXXXXXXXXXXAQGTGQAADYESTQAAIVQITGKLNRLXXXXXXXXXXXXXXXXXXXXXXXXXXXXXXXXXXXXXXXXXXXXXXXXXQHTIDLADSEMLNLYEXXXXXXXXXXXXXXXXXXXXXXXXXXXXXXXXXXXXXXXXXYREEALLSRLNINPVXXXXXXXXXXXXXXXXXXXXXXXXXXXXXXXXXXXXXXXXXXXXXXXXXXXX

SEQ ID NO: 419746 - protein, 568 aa, Influenza virus
  MOD_RES (1)..(213): Any amino acid
  MOD_RES (241)..(252): Any amino acid
  MOD_RES (265)..(512): Any amino acid
  MOD_RES (524)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGSSTYQNSFVPVVGDRPLVNGQRGRIXXXXXXXXXXXXITFSDNGGLIAPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINSVKLFSGYKXXXXXXXXXXXXXXXXXXXXXXXXXXXXXXXXXXXXXXXXXXXXX

SEQ ID NO: 419747 - protein, 568 aa, Influenza virus
  MOD_RES (1)..(220): Any amino acid
  MOD_RES (232)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNNFVPVVRARPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419748 - protein, 568 aa, Influenza virus
  MOD_RES (1)..(225): Any amino acid
  MOD_RES (237)..(568): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVGARPLVNGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419749 - protein, 561 aa, Influenza virus
  MOD_RES (1)..(15): Any amino acid
  MOD_RES (54)..(65): Any amino acid
  MOD_RES (77)..(78): Any amino acid
  MOD_RES (100)..(101): Any amino acid
  MOD_RES (131)..(150): Any amino acid
  MOD_RES (184)..(184): Any amino acid
  MOD_RES (246)..(246): Any amino acid
  MOD_RES (271)..(286): Any amino acid
  MOD_RES (337)..(337): Any amino acid
  MOD_RES (485)..(485): Any amino acid
XXXXXXXXXXXXXXXGLDKICLGHHAVSNGTIVKTLTNEKEEVTNATETVESKXXXXXXXXXXXXKDLGNCHPIGMXXGTPACDLHLTGTWDTLIERDNXXAYCYPGATVNEEALRQKIMESGGIDKISTXXXXXXXXXXXXXXXXXXXXGGNSFYAELKWLVSKSKGQNFPQTTNTYRNTDSXEHLIIWGIHHPSSTQEKNDLYGTQSLSISVGSSTYQNNFVPVVGARPQVNGQSGRIDFHWTXVQPGDNITFSHNGGLIAPSRVSKLXXXXXXXXXXXXXXXXCESKCFWKGGSINTKLPFQNLSPRTVGQCPKYVNKKSLLLATGMRNVPEVXQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCXDNCMESIRNNTYDHTQYREEALLNRLNINPVKLSSGYKDVILWFSFGASCFVLLAVIMGLVFFCLKNGNMRCTICI

SEQ ID NO: 419750 - protein, 561 aa, Influenza virus
  MOD_RES (1)..(15): Any amino acid
  MOD_RES (54)..(65): Any amino acid
  MOD_RES (77)..(78): Any amino acid
  MOD_RES (100)..(101): Any amino acid
  MOD_RES (131)..(150): Any amino acid
  MOD_RES (184)..(184): Any amino acid
  MOD_RES (246)..(246): Any amino acid
  MOD_RES (270)..(286): Any amino acid
  MOD_RES (305)..(309): Any amino acid
  MOD_RES (337)..(337): Any amino acid
  MOD_RES (360)..(368): Any amino acid
  MOD_RES (390)..(400): Any amino acid
  MOD_RES (422)..(429): Any amino acid
  MOD_RES (485)..(485): Any amino acid
  MOD_RES (553)..(561): Any amino acid
XXXXXXXXXXXXXXXGIDKICLGHHAVPNGTIVKTLTSEKEKVTNATETVESTXXXXXXXXXXXXKDLGSCHPIGMXXGTPVCDPHLTGTWDTLIERENXXAHCYPGATINEEALRQKIMESGGISKISTXXXXXXXXXXXXXXXXXXXXGGDSFYAELKWLVSKTKGQNFPQTANTYRNTDSXEHLIVWGIHHPSSTKEKNDLYGTQPLSISVGSSTYHNSFVPVVGARPQVNGQSGRINFHWTXVRPGDNITFSHNGGLVAPSRVSKXXXXXXXXXXXXXXXXXCESKCFWRGGSINTKLPFXXXXXRTVGQCPKYVSKRSLLLATGMRNVPEIXQERGLFGAIAGFLENGWEGMVDXXXXXXXXXAQGTGQAADYESTQAAIDQITXXXXXXXXXXXTEFESIESEFNEIEHQIGNVIXXXXXXXXDIWTYNAELLVAMENQHTIDLADSEMLNLYDRVRKQLRQNAEEDGRGCFEIYHKCXDSCMESIRNNTYDHAQYREEALLNRLSINPVKLSSGYKDIILWFSFGASCFILLAVVMGLVFFCLKNXXXXXXXXX

SEQ ID NO: 419751 - protein, 561 aa, Influenza virus
  MOD_RES (1)..(15): Any amino acid
  MOD_RES (52)..(65): Any amino acid
  MOD_RES (77)..(78): Any amino acid
  MOD_RES (100)..(101): Any amino acid
  MOD_RES (131)..(150): Any amino acid
  MOD_RES (184)..(184): Any amino acid
  MOD_RES (231)..(234): Any amino acid
  MOD_RES (246)..(246): Any amino acid
  MOD_RES (271)..(288): Any amino acid
  MOD_RES (310)..(310): Any amino acid
  MOD_RES (337)..(339): Any amino acid
  MOD_RES (361)..(372): Any amino acid
  MOD_RES (399)..(402): Any amino acid
  MOD_RES (424)..(430): Any amino acid
  MOD_RES (465)..(472): Any amino acid
  MOD_RES (485)..(485): Any amino acid
XXXXXXXXXXXXXXXGLDRICLGHHAVANGTIIKTLTNEKEEVINATETVEXXXXXXXXXXXXXXKDLDNCHPIGMXXGTPACDLYLTGTWDTLIERGSXXAYCYPGTTVNEEALRQKIMESGGISKMSTXXXXXXXXXXXXXXXXXXXXGKNSFYAELKWLISKSKEQNFPRTTNTYRNTDSXEHLITWGIHHPSSAQEKNDLYGAQSLSISVESSTYQNNFVPVIGARXXXXGQSGRIDFHWAXIQPGDNITFSHNGGLIAPDRVSKLXXXXXXXXXXXXXXXXXXSKCFWKGGSIKTKLPFQNLSPXTVGQCPKYVNQKSLMLATGMRNVPETXXXRGLFGAKAGFIENGWEGMVNGXXXXXXXXXXXXGQAADYKSTQKTIDQVTGKLNRLIEKXXXXFESIESEFSETEHQIGNVINWXXXXXXXIWTYQAELLIAMENQHTIDMADSTMLNLYERVRKXXXXXXXXDGKGCFEIYHACXNNCMESIRNNTYDHSQYREEALLNRLNINSVKLSSGYKDIILWFSFGESCFVLLAVIMGLVFFCLRNGNMRCTICI

SEQ ID NO: 419752 - protein, 561 aa, Influenza virus
  MOD_RES (1)..(15): Any amino acid
  MOD_RES (33)..(38): Any amino acid
  MOD_RES (54)..(65): Any amino acid
  MOD_RES (77)..(78): Any amino acid
  MOD_RES (99)..(101): Any amino acid
  MOD_RES (131)..(150): Any amino acid
  MOD_RES (184)..(184): Any amino acid
  MOD_RES (225)..(246): Any amino acid
  MOD_RES (271)..(290): Any amino acid
  MOD_RES (333)..(373): Any amino acid
  MOD_RES (394)..(404): Any amino acid
  MOD_RES (426)..(449): Any amino acid
  MOD_RES (461)..(472): Any amino acid
  MOD_RES (485)..(485): Any amino acid
  MOD_RES (502)..(506): Any amino acid
  MOD_RES (528)..(530): Any amino acid
  MOD_RES (557)..(561): Any amino acid
XXXXXXXXXXXXXXXSLDKICLGHHAVANGTVXXXXXXEQEEVTNATETVENKXXXXXXXXXXXXKDLGNCHPVGMXXGAPACDLHLTGMWDTLIERDXXXAYCYPGSTVNEEALRQKIMESGGIDKVSTXXXXXXXXXXXXXXXXXXXXGENSFYAELKWLVSKNKGQSFPQTTNTYRNTDTXEHLIMWGIHHPSSTKEKNELYGTQSLSISIGSSTYQNNFVXXXXXXXXXXXXXXXXXXXXXXVQPGDNITFLHNGGLIAPSRVTKLXXXXXXXXXXXXXXXXXXXXCFWRGGSINTRLPFQNLSPRTVGQCPKYVSQGSLLLATGMRNXXXXXXXXXXXXXXXXXXXXXXXXXXXXXXXXXXXXXXXXXQAADYKSTQATIDQITGKLNXXXXXXXXXXXSIESEFNEIEYQIGNVINWTKXXXXXXXXXXXXXXXXXXXXXXXXMADSEMLNLYDXXXXXXXXXXXXDGKGCFEIYHTCXDNCMERIRNNTYDHTQXXXXXLLNRLNINPVTLSSGYKDIILXXXFGASCFVLLAAIMGLFFFCLKNGNMRXXXXX

SEQ ID NO: 419753 - protein, 561 aa, Influenza virus
  MOD_RES (1)..(17): Any amino acid
  MOD_RES (42)..(42): Any amino acid
  MOD_RES (54)..(65): Any amino acid
  MOD_RES (77)..(78): Any amino acid
  MOD_RES (100)..(101): Any amino acid
  MOD_RES (131)..(151): Any amino acid
  MOD_RES (184)..(184): Any amino acid
  MOD_RES (231)..(246): Any amino acid
  MOD_RES (265)..(321): Any amino acid
  MOD_RES (333)..(374): Any amino acid
  MOD_RES (396)..(450): Any amino acid
  MOD_RES (463)..(472): Any amino acid
  MOD_RES (485)..(485): Any amino acid
  MOD_RES (501)..(506): Any amino acid
  MOD_RES (554)..(561): Any amino acid
XXXXXXXXXXXXXXXXXDKICLGHHAVTNGTIVKTLTNEQEXVTNATETVESRXXXXXXXXXXXXRDLGNCHPIGMXXGAPSCDLHLTGIWDTLIERDNXXANCYPGATVNEGALRQKIMESGGIDKIGTXXXXXXXXXXXXXXXXXXXXXRNSFYAELKWLVSKDKGRNFPQTTNTYRNTDPXEHIIMWGIHHPSSTQERNDLYGTQSLSISVESSTYQNSFVPVVGARXXXXXXXXXXXXXXXXVQPGDNITFSDNGGLIAPXXXXXXXXXXXXXXXXXXXXXXXXXXXXXXXXXXXXXXXXXXXXXXXXXXXXXXXXXRSLMLATGMRNXXXXXXXXXXXXXXXXXXXXXXXXXXXXXXXXXXXXXXXXXXAADYKSTQAAVDQITGKLNRLXXXXXXXXXXXXXXXXXXXXXXXXXXXXXXXXXXXXXXXXXXXXXXXXXXXXXXXADSEMLNLYEGVXXXXXXXXXXDGKGCFEIYHNCXDNCMESIRDNTYDHTXXXXXXLLSRLNINPVKLSSGYKNVILWFSFGASCFVLLAIIVGLVFFCLKNGXXXXXXXX

SEQ ID NO: 419754 - protein, 561 aa, Influenza virus
  MOD_RES (1)..(18): Any amino acid
  MOD_RES (51)..(84): Any amino acid
  MOD_RES (100)..(185): Any amino acid
  MOD_RES (228)..(248): Any amino acid
  MOD_RES (265)..(379): Any amino acid
  MOD_RES (395)..(486): Any amino acid
  MOD_RES (498)..(513): Any amino acid
  MOD_RES (528)..(549): Any amino acid
  MOD_RES (561)..(561): Any amino acid
XXXXXXXXXXXXXXXXXXKICLGHHAIPNGTIVKTLTNEREEVTNATETVXXXXXXXXXXXXXXXXXXXXXXXXXXXXXXXXXXLHLTGKWDTLIERENXXXXXXXXXXXXXXXXXXXXXXXXXXXXXXXXXXXXXXXXXXXXXXXXXXXXXXXXXXXXXXXXXXXXXXXXXXXXXXXXXXXXXXHLVMWGIHHPSSTQEKNALYGTQSLSISVGSSIYQNSFVPVVXXXXXXXXXXXXXXXXXXXXXPGDNIIFSHNGGLIAPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSTQAAIDQMTGKLNRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPCMESIRNNTYXXXXXXXXXXXXXXXXNPVRLSSGYKDIILXXXXXXXXXXXXXXXXXXXXXXLKDGNMRCTICX

SEQ ID NO: 419755 - protein, 561 aa, Influenza virus
  MOD_RES (1)..(38): Any amino acid
  MOD_RES (51)..(211): Any amino acid
  MOD_RES (226)..(561): Any amino acid
XXXXXXXXXXXXXXXXXXXXXXXXXXXXXXXXXXXXXXEHEEVTNATETVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISVGSSTYQNSFVPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419756 - protein, 471 aa, Influenza virus
  MOD_RES (18)..(19): Any amino acid
  MOD_RES (50)..(53): Any amino acid
  MOD_RES (73)..(82): Any amino acid
  MOD_RES (308)..(308): Any amino acid
  MOD_RES (332)..(333): Any amino acid
  MOD_RES (389)..(398): Any amino acid
  MOD_RES (416)..(416): Any amino acid
MNPNQKLFALSGVAIALXXLNLLIGISNVGLNVSLHLKEKGTKQEENLTXXXXTQNNTTLIENTYVNNTTVIXXXXXXXXXXYLMLNKSLCKVEGWVVVAKDNAIRFGESEQIIVTREPYVSCDPLGCKMYALHQGTTIRNKHSNGTIHDRTAFRGLISTPLGSPPIVSNSDFLCVGWSSTSCHDGIGRMTICVQGNNDNATATVYYDRRLTTTIKTWAGNILRTQESECVCHNGTCVVIMTDGSASSQAYTKVLYFHKGLVIKEEALKGSARHIEECSCYGHNSKVTCVCRDNWQGANRPVIEIDMXAMEHTSQYLCTGVLTDTSRPSDKXXGDCNNPITGSPGAPGVKGFGFLDSGNTWLGRTISPRSRSGFEMLKIPNAGTDPNSXXXXXXXXXXNNNWSGYSGSFIDYWDEXSECYNPCFYVELIRGRPEEAKYVWWTSNSLVALCGSPISVGSGSFPDGAQIQYFS

SEQ ID NO: 419757 - protein, 471 aa, Influenza virus
  MOD_RES (18)..(19): Any amino acid
  MOD_RES (50)..(53): Any amino acid
  MOD_RES (73)..(82): Any amino acid
  MOD_RES (308)..(308): Any amino acid
  MOD_RES (332)..(333): Any amino acid
  MOD_RES (389)..(398): Any amino acid
  MOD_RES (416)..(416): Any amino acid
MNPNQKLFTLSGVAIALXXLNLIIGISNVGLNVSLHLREKGAKQEENLTXXXXTQNNTTVVENTYVNNTTIIXXXXXXXXXXYLVLNKSLCKVEEWVVVAKDNAVRFGESEQIIVTREPYVSCDPSGCKMYALHQGTTIRNRHSNGTIHDRTAFRGLMSTPLGTPPTVSNSDFICVGWSSTSCHDGVGRMTICVQGNNNNATATVYYDRRLTTTIKPWARNILRTQESECVCHNGTCAVVMTDGSASSQAHTKVLYFHKGLIIKEEPLKGSAKHIEECSCYGHDSKITCVCRDNWQGANRPIIEIDMXTLEHTSRYVCTGILTDTSRPGDKXXGDCSNPITGSPGAPGVKGFGFLNGSNTWLGRTISPHSRSGFEMLKVPNAGTDPNSXXXXXXXXXXNSNWSGYSGSFIDYWNDXNECYNPCFYVELIRGRPEEVKYVWWTSNSLIALCGSPFPVGSGSFPDGAKIQYFS

SEQ ID NO: 419758 - protein, 471 aa, Influenza virus
  MOD_RES (17)..(19): Any amino acid
  MOD_RES (36)..(38): Any amino acid
  MOD_RES (50)..(53): Any amino acid
  MOD_RES (73)..(82): Any amino acid
  MOD_RES (137)..(153): Any amino acid
  MOD_RES (183)..(183): Any amino acid
  MOD_RES (308)..(308): Any amino acid
  MOD_RES (332)..(334): Any amino acid
  MOD_RES (380)..(398): Any amino acid
  MOD_RES (416)..(416): Any amino acid
  MOD_RES (429)..(443): Any amino acid
  MOD_RES (471)..(471): Any amino acid
MNPNQNLFTLSGVAIAXXXMNLLIGISNVGLKVSLXXXERGTKQEENLTXXXXNQNNTTVVENTYVNKTTVIXXXXXXXXXXYLLLNKSLCNVEGWVVIAKDNAVRFGESEQVIVTREPYVSCDPTGCKMYALHQGXXXXXXXXXXXXXXXXXFRGLISTPLGTPPTVSNSEFLCVGWSSTSXHDGVGRMTICIQGNNDNATATVYYNRRLTTTIKPWAGKILRTQESECVCHNGTCVVVMTDGSASGQAYTKVMYFHKGIVIKEEVLKGSARHVEECSCYGHNQKVTCVCRDNWQGANRPVIKIDMXVMEHTSQYLCTGILTDTSRPSDKXXXDCSNPITGSPSAPGVKGFGFLDGDNTWLGRTISPRSRSGFEMLKVXXXXXXXXXXXXXXXXXXXNSDWSGYSGSFIDYWDDXSVCYNPCFYVELXXXXXXXXXXXXXXXNSLVALCGSPVSVGSGSFPDGARIQYFX

SEQ ID NO: 419759 - protein, 471 aa, Influenza virus
  MOD_RES (1)..(1): Any amino acid
  MOD_RES (15)..(19): Any amino acid
  MOD_RES (50)..(53): Any amino acid
  MOD_RES (65)..(82): Any amino acid
  MOD_RES (137)..(154): Any amino acid
  MOD_RES (228)..(234): Any amino acid
  MOD_RES (308)..(308): Any amino acid
  MOD_RES (332)..(334): Any amino acid
  MOD_RES (346)..(346): Any amino acid
  MOD_RES (389)..(398): Any amino acid
  MOD_RES (411)..(416): Any amino acid
  MOD_RES (429)..(444): Any amino acid
  MOD_RES (465)..(471): Any amino acid
XNPKSKLFTLSGVAXXXXXFNLLIGISNVGLNISLHLKEKGPKQEENLTXXXXTGTAKQNYLMLXXXXXXXXXXXXXXXXXXYLLLNKSLCSVEGWVVIAKDNAIRFGEGEQIIVTREPYVSCDPIGCKMYALHQGXXXXXXXXXXXXXXXXXXRGLMSTPLGSPPVVSNSDFMCVGWSSTTCHDGIGRMTICIQGNNKNATATVYYDRRLTTTIKTWARNILRTQEXXXXXXXGTCVVIMTDGPASSQAYTKIMYFHKGLVVKEEALQGSARHIEECSCYGHSQKITCVCRDNWQGANRPVIEINMXAMDHTSQYLCTGVLTDTSKPSDKXXXDCDNPITGSPGXPGVKGFGFLDNDNTWLGGTISPRSRSGFEMLKIPNAETDPNSXXXXXXXXXXNRNWSGYSGSFIXXXXXXSKCYNPCFYVELXXXXXXXXXXXXXXXXSLVALCGSPVPVGSGSFPDGXXXXXXX

SEQ ID NO: 419760 - protein, 471 aa, Influenza virus
  MOD_RES (1)..(4): Any amino acid
  MOD_RES (18)..(38): Any amino acid
  MOD_RES (50)..(53): Any amino acid
  MOD_RES (71)..(82): Any amino acid
  MOD_RES (98)..(102): Any amino acid
  MOD_RES (116)..(118): Any amino acid
  MOD_RES (140)..(156): Any amino acid
  MOD_RES (169)..(171): Any amino acid
  MOD_RES (228)..(236): Any amino acid
  MOD_RES (307)..(308): Any amino acid
  MOD_RES (332)..(335): Any amino acid
  MOD_RES (348)..(359): Any amino acid
  MOD_RES (389)..(398): Any amino acid
  MOD_RES (412)..(416): Any amino acid
  MOD_RES (429)..(444): Any amino acid
  MOD_RES (465)..(471): Any amino acid
XXXXQKLFALSGVAVALXXXXXXXXXXXXXXXXXXXXXEKGPKQEENSTXXXXNQNNTTVVENKYVNNTTXXXXXXXXXXXXYLMLSKSLCKVEGWVXXXXXNAIRFGESEQVIVXXXPYVSCDPLGCRMYALHQGTTIXXXXXXXXXXXXXXXXXLISTPLGSPPVVXXXDFICVGWSSTTCHDGVGRMTICVQGKNDNATATVYYERRLTTTIKTWAGKILRTQEXXXXXXXXXCVVIMTDGPANSQAYTKILYFHKGLLIKEETLKGSARHIEECPCYGHNSKVTCICRDNWQGANRPAIEIDXXAMKHTSQYLCTGVLTDTSRPSDRXXXXCNNPITGSPEAPXXXXXXXXXXXXTWLGRTFSPRSRSGFEMLKIPNAGIDPNSXXXXXXXXXXNNNLSGYSGSFIDXXXXXSACYNPCFYVELXXXXXXXXXXXXXXXXSLIALCGSPFSVGSGSFPDGXXXXXXX

SEQ ID NO: 419761 - protein, 471 aa, Influenza virus
  MOD_RES (1)..(5): Any amino acid
  MOD_RES (18)..(54): Any amino acid
  MOD_RES (72)..(86): Any amino acid
  MOD_RES (98)..(119): Any amino acid
  MOD_RES (135)..(156): Any amino acid
  MOD_RES (174)..(186): Any amino acid
  MOD_RES (198)..(198): Any amino acid
  MOD_RES (210)..(238): Any amino acid
  MOD_RES (254)..(274): Any amino acid
  MOD_RES (296)..(296): Any amino acid
  MOD_RES (308)..(376): Any amino acid
  MOD_RES (389)..(399): Any amino acid
  MOD_RES (412)..(455): Any amino acid
XXXXXKLFALSGVAISLXXXXXXXXXXXXXXXXXXXXXXXXXXXXXXXXXXXXXQTNTTLIENTYVNKTTVXXXXXXXXXXXXXXXNKRLCKVEGWVXXXXXXXXXXXXXXXXXXXXXXYVSCDPLGCKTYALHXXXXXXXXXXXXXXXXXXXXXXLISTPLGSPPMVSNSDFXXXXXXXXXXXXXIGRMTICVQGKXNNATATVYYERXXXXXXXXXXXXXXXXXXXXXXXXXXXXXVIMTDGSANSQAYTKXXXXXXXXXXXXXXXXXXXXXIEECSCYGHNQKATCVCRDNWXGANRPIIEINMXXXXXXXXXXXXXXXXXXXXXXXXXXXXXXXXXXXXXXXXXXXXXXXXXXXXXXXXXXXXXXXXXXXXXLKIPNAETDPSSXXXXXXXXXXXNKWSGYSGSFIDXXXXXXXXXXXXXXXXXXXXXXXXXXXXXXXXXXXXXXXXXXXXVGSGSFPNGAQIQYFS

SEQ ID NO: 419762 - protein, 471 aa, Influenza virus
  MOD_RES (1)..(6): Any amino acid
  MOD_RES (18)..(60): Any amino acid
  MOD_RES (72)..(161): Any amino acid
  MOD_RES (174)..(188): Any amino acid
  MOD_RES (220)..(248): Any amino acid
  MOD_RES (260)..(471): Any amino acid
XXXXXXLFALSGVAITLXXXXXXXXXXXXXXXXXXXXXXXXXXXXXXXXXXXXXXXXXXXIENTYVNNTTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGSPPIVSNSEFXXXXXXXXXXXXXXXRMTICVQGNNKNATATVYYNGRLTTTIKTWAXXXXXXXXXXXXXXXXXXXXXXXXXXXXXQAHTKILYFHKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419763 - protein, 471 aa, Influenza virus
  MOD_RES (1)..(188): Any amino acid
  MOD_RES (200)..(201): Any amino acid
  MOD_RES (218)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRMIICIQGNNDXXTATVYYNRRPTTTIKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419764 - protein, 471 aa, Influenza virus
  MOD_RES (1)..(206): Any amino acid
  MOD_RES (219)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYNRRLTTTIKTWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419765 - protein, 565 aa, Influenza virus
  MOD_RES (1)..(14): Any amino acid
  MOD_RES (52)..(52): Any amino acid
  MOD_RES (102)..(234): Any amino acid
  MOD_RES (249)..(255): Any amino acid
  MOD_RES (269)..(308): Any amino acid
  MOD_RES (339)..(340): Any amino acid
  MOD_RES (386)..(431): Any amino acid
  MOD_RES (464)..(467): Any amino acid
  MOD_RES (522)..(523): Any amino acid
  MOD_RES (549)..(551): Any amino acid
XXXXXXXXXXXXXXQADEICIGYLSNNSTEKVDTIIESNVTVTSSVELVENXHTGSFCSIDGKAPISLGDCSFAGWILGNPMCDDLIGKTSWSYIVEKPNPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVNGQAGRMTFYWTIXXXXXXXTFESNGAFLAPRYXXXXXXXXXXXXXXXXXXXXXXXXXXXXXXXXXXXXXXXXNVHRNTIGDCPKYVNVKSLKLATGLRNVPAXXTRGLFGAIAGFIEGGWPGLINGWYGFQHRNEEGTGIAADKESTQKXXXXXXXXXXXXXXXXXXXXXXXXXXXXXXXXXXXXXXXXXXXXXXDIWSYNAQLLVLLENEKTLDLHDSNVRNLHEKXXXXLKDNAKDEGNGCFTFYHKCDNECIEKVRNGTYDHKEFEEESKLNRQEIEGVKLDXXGNVYKILSIYSCIASSLVLAAIIMGXXXWACSNGSCRCTICI

SEQ ID NO: 419766 - protein, 565 aa, Influenza virus
  MOD_RES (1)..(14): Any amino acid
  MOD_RES (52)..(52): Any amino acid
  MOD_RES (102)..(234): Any amino acid
  MOD_RES (249)..(255): Any amino acid
  MOD_RES (269)..(308): Any amino acid
  MOD_RES (339)..(340): Any amino acid
  MOD_RES (352)..(359): Any amino acid
  MOD_RES (386)..(431): Any amino acid
  MOD_RES (464)..(467): Any amino acid
  MOD_RES (522)..(523): Any amino acid
  MOD_RES (549)..(551): Any amino acid
  MOD_RES (564)..(565): Any amino acid
XXXXXXXXXXXXXXKADEICIGYLSNNSTDKVDTIIENNVTVTSSVELVETXHTGSFCSINGKQPISLGDCSFAGWLLGNPMCDELIGKTSWSYIVERPNPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINGQAGRMTFYWKIXXXXXXXTFESNGAFIAPRYXXXXXXXXXXXXXXXXXXXXXXXXXXXXXXXXXXXXXXXXSVHRNTIGDCPKYMNVKSLKLATGPRNVPAXXSRGLFGAIAGFXXXXXXXXINGWYGFQHRDEEGTGIAADKESTQTXXXXXXXXXXXXXXXXXXXXXXXXXXXXXXXXXXXXXXXXXXXXXXNIWSYNAQLLVWLENEKTLDLHDSNVTNLHEKXXXXLRDNAKDEGNGCFPFYHKCDNKCIERVRNGTYDHKEFKEESKINRQEIEGVKLNXXGNIYKILSIYSCIASSLILAAIIMGXXXWTCSNGSCRCTIXX

SEQ ID NO: 419767 - protein, 565 aa, Influenza virus
  MOD_RES (1)..(14): Any amino acid
  MOD_RES (52)..(52): Any amino acid
  MOD_RES (101)..(236): Any amino acid
  MOD_RES (249)..(255): Any amino acid
  MOD_RES (269)..(308): Any amino acid
  MOD_RES (339)..(340): Any amino acid
  MOD_RES (352)..(360): Any amino acid
  MOD_RES (386)..(431): Any amino acid
  MOD_RES (464)..(467): Any amino acid
  MOD_RES (522)..(523): Any amino acid
  MOD_RES (546)..(551): Any amino acid
XXXXXXXXXXXXXXRADEICIGYLSNNSTERVDTIIESNVTVTSSIELVENXHTGSFCSLDGKAPISLGGCSFAGWILGNPRCDDLIGKNSWSYIVEKPNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGQAGRMTFYWAIXXXXXXXTFESDGAFLAPRYXXXXXXXXXXXXXXXXXXXXXXXXXXXXXXXXXXXXXXXXNVHRNAIGDCPKYVNVRSLKLATGLRNIPAXXARGLFGAIAGFXXXXXXXXXNGWYGFQHRNDEGTGIAADRESTQKXXXXXXXXXXXXXXXXXXXXXXXXXXXXXXXXXXXXXXXXXXXXXXDIWSYNARLLVLLENEKTLDLHDSNVRSLHEKXXXXLKGNAKDEGNGCFTFYHRCDNECIERVRNGTYDHKEFEKESKLNRQEIGGVKLDXXGDVYKILSIYSCVASSLVLAAIXXXXXXWACNNGSCRCTICI

SEQ ID NO: 419768 - protein, 565 aa, Influenza virus
  MOD_RES (1)..(14): Any amino acid
  MOD_RES (50)..(52): Any amino acid
  MOD_RES (101)..(236): Any amino acid
  MOD_RES (249)..(255): Any amino acid
  MOD_RES (269)..(308): Any amino acid
  MOD_RES (339)..(340): Any amino acid
  MOD_RES (359)..(365): Any amino acid
  MOD_RES (386)..(431): Any amino acid
  MOD_RES (444)..(448): Any amino acid
  MOD_RES (462)..(467): Any amino acid
  MOD_RES (522)..(523): Any amino acid
  MOD_RES (549)..(551): Any amino acid
XXXXXXXXXXXXXXQADEICIGYMSNNSTEKVDTIIENNITVTSSVELVXXXYTGSFCSIDGKEPISLGDCSFAGWILGNPMCDELIEKTSWSYIVEKSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGQAGRMTFYWIIXXXXXXXTFESNGALLAPRYXXXXXXXXXXXXXXXXXXXXXXXXXXXXXXXXXXXXXXXXNVHRSTIGDCPKYVNIKSLKLASGLRNVPAXXSRGLFGAKAGFIEGGWPGXXXXXXXFQHRNEEGTGVAADKESTQKXXXXXXXXXXXXXXXXXXXXXXXXXXXXXXXXXXXXXXXXXXXXXXDLWSYNAQLLVLXXXXXTLDLHDSNVKNLHXXXXXXLKNNAKDEGNGCFTFYHKCNNECIEKIRNGTYDHKEFEEESRLNRQEIEGVRLDXXGNVYKILSICSCIASSLVLAALIMGXXXWACGNGSCRCTICI

SEQ ID NO: 419769 - protein, 565 aa, Influenza virus
  MOD_RES (1)..(15): Any amino acid
  MOD_RES (51)..(52): Any amino acid
  MOD_RES (102)..(237): Any amino acid
  MOD_RES (249)..(255): Any amino acid
  MOD_RES (269)..(308): Any amino acid
  MOD_RES (324)..(324): Any amino acid
  MOD_RES (339)..(369): Any amino acid
  MOD_RES (382)..(432): Any amino acid
  MOD_RES (447)..(452): Any amino acid
  MOD_RES (464)..(467): Any amino acid
  MOD_RES (521)..(534): Any amino acid
  MOD_RES (549)..(551): Any amino acid
  MOD_RES (564)..(565): Any amino acid
XXXXXXXXXXXXXXXADEICIGHLSNNSTDKVNTIIENNVTVTNSVELVEXXHTGTFCSINGKAPISLGDCSFTGWILGNPMCDNLIGKTSWSYIVEKLNPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQAGRMTFYWTMXXXXXXXTFESNGVFLAPRYXXXXXXXXXXXXXXXXXXXXXXXXXXXXXXXXXXXXXXXXNVHRNTIGNCPKYVNXKSLKLAIGPRNVPAXXXXXXXXXXXXXXXXXXXXXXXXXXXXXXXNEEGTGIAADREXXXXXXXXXXXXXXXXXXXXXXXXXXXXXXXXXXXXXXXXXXXXXXXXXXXIWSYNAKLLVLLENXXXXXXHDSNVRNLHERXXXXLQDNAKDEGNGCFTFYHKCDDECIEKVRNGTYDHKDFEEESRINRQEIEGVRLXXXXXXXXXXXXXXCIASSLILAALIMGXXXWVCSNGSCRCTIXX

SEQ ID NO: 419770 - protein, 565 aa, Influenza virus
  MOD_RES (1)..(16): Any amino acid
  MOD_RES (49)..(56): Any amino acid
  MOD_RES (72)..(74): Any amino acid
  MOD_RES (102)..(256): Any amino acid
  MOD_RES (268)..(309): Any amino acid
  MOD_RES (338)..(374): Any amino acid
  MOD_RES (386)..(471): Any amino acid
  MOD_RES (484)..(498): Any amino acid
  MOD_RES (522)..(536): Any amino acid
  MOD_RES (548)..(565): Any amino acid
XXXXXXXXXXXXXXXXDKICIGYLSNNSTEKVNTIIESNVTVTNSVELXXXXXXXXFCSINGKEPISLGDCXXXGWILGNPMCDYLIGKTSWSYIVEKTNPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFESNGAFLAPGXXXXXXXXXXXXXXXXXXXXXXXXXXXXXXXXXXXXXXXXXXVHRNTFGDCPKYVNVKSLKLVTGLRNVPXXXXXXXXXXXXXXXXXXXXXXXXXXXXXXXXXXXXXGIAADKESTQEXXXXXXXXXXXXXXXXXXXXXXXXXXXXXXXXXXXXXXXXXXXXXXXXXXXXXXXXXXXXXXXXXXXXXXXXXXXXXXXXXXXXXXARDEGNGCFTFYXXXXXXXXXXXXXXXYDHKEFEKESRINRQEIEGARLDXXXXXXXXXXXXXXXASSLVLAALNMXXXXXXXXXXXXXXXXXX

SEQ ID NO: 419771 - protein, 565 aa, Influenza virus
  MOD_RES (1)..(30): Any amino acid
  MOD_RES (48)..(57): Any amino acid
  MOD_RES (72)..(83): Any amino acid
  MOD_RES (95)..(537): Any amino acid
  MOD_RES (549)..(565): Any amino acid
XXXXXXXXXXXXXXXXXXXXXXXXXXXXXXKVDTIIESNITVTSSVEXXXXXXXXXXCSINGRAPISLGDCXXXXXXXXXXXXDDLIEKTSWSYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSLVLAASIMGXXXXXXXXXXXXXXXXX

SEQ ID NO: 419772 - protein, 564 aa, Influenza virus
  MOD_RES (1)..(14): Any amino acid
  MOD_RES (57)..(60): Any amino acid
  MOD_RES (152)..(153): Any amino acid
  MOD_RES (189)..(189): Any amino acid
  MOD_RES (205)..(219): Any amino acid
  MOD_RES (287)..(291): Any amino acid
  MOD_RES (406)..(417): Any amino acid
  MOD_RES (467)..(469): Any amino acid
  MOD_RES (489)..(503): Any amino acid
XXXXXXXXXXXXXXFAYDKICIGYQTNNSTETVNTLIEQNVPVTQVEELVHGGIDPXXXXTELGSPLVLDDCSLEGLILGNPKCDLYLNGREWSYIVERPKEMEGICYPGSIENQEELRSLFSSIKKYERVKMFDFTKWNVTYTGTSKACNXXSNQGSFYRSMRWLTLKSGQFPVQTDEYKNTRDSDIXFTWAIHHPPTSDEQVXXXXXXXXXXXXXXXEINRSFKPNIGPRPLVRGQQGRMDYYWAVLKPGQTVKIQTNGNLIAPEYGHLITGKSHGRILKNNLPXXXXXTECQLNEGVMNTSKPFQNTSKHYIGKCPKYIPSGSLKLAIGLRNVPQAQDRGLFGAIAGFIEGGWPGLVAGWYGFQHQNAEGTGIAADRDSTQKAIDNMQNKLNNVIDKMNKQFXXXXXXXXXXXXRINMINSKIDDQITDIWAYNAELLVLLENQKTLDEHDANVRNLHDRVRRXXXENAIDTGDGCFEILHKCDNXXXXXXXXXXXXXXXYEEESKIERQKINGVKLEENSTYKILSIYSSVASSLVLLLMIIGGFIFGCQNGNVRCTFCI

SEQ ID NO: 419773 - protein, 564 aa, Influenza virus
  MOD_RES (1)..(14): Any amino acid
  MOD_RES (57)..(60): Any amino acid
  MOD_RES (152)..(153): Any amino acid
  MOD_RES (189)..(189): Any amino acid
  MOD_RES (205)..(219): Any amino acid
  MOD_RES (287)..(291): Any amino acid
  MOD_RES (406)..(417): Any amino acid
  MOD_RES (467)..(469): Any amino acid
  MOD_RES (489)..(503): Any amino acid
  MOD_RES (526)..(532): Any amino acid
XXXXXXXXXXXXXXLAYDKICIGYQTNNSTDTVNTLIEQNIPVTQVEELVHRGIDPXXXXTELGAPLVLDDCSLEGIILGNPKCDLYLSGREWSYIVERTKEMEGICYPGSVENQEELRSLFSSIKRYERVKMFDFTKWNVTHTGTSKACNXXSNRGSFYRSMRWLTLKLGQFPVQTDEYKNTGDSDIXFTWAIHHPPTTDEQMXXXXXXXXXXXXXXXEINRSFRPNIGPRPLVREQQGRMDYYWAILKPGQTVKIQTSGNLIAPEYGHLVTGKSHGRILKNDLPXXXXXTKCQLNEGVMNTSKPLQNTSKHYIGKCPRYIPSGSLKLAIGPRNVPQVQNRGLFGAIAGFIEGRWPGLVAGWYGFQHQNSEGTGIAADRGSTQKAIDNMQNRLNNVIDKMNKQLXXXXXXXXXXXXRINTINSKIDDQVTDIWAYNAELIVLLENQKTLDEHDANVRNLHERIRRXXXENAIDAGDGCFEILHKCNDXXXXXXXXXXXXXXXYEEESKLERQKVNGVKLEENSTXXXXXXXSSVASSLVLLFMIIGGFIFGCQNGNIRCTFCI

SEQ ID NO: 419774 - protein, 564 aa, Influenza virus
  MOD_RES (1)..(14): Any amino acid
  MOD_RES (26)..(26): Any amino acid
  MOD_RES (57)..(60): Any amino acid
  MOD_RES (152)..(153): Any amino acid
  MOD_RES (174)..(176): Any amino acid
  MOD_RES (189)..(189): Any amino acid
  MOD_RES (205)..(219): Any amino acid
  MOD_RES (246)..(247): Any amino acid
  MOD_RES (281)..(291): Any amino acid
  MOD_RES (359)..(363): Any amino acid
  MOD_RES (406)..(417): Any amino acid
  MOD_RES (442)..(453): Any amino acid
  MOD_RES (467)..(469): Any amino acid
  MOD_RES (489)..(503): Any amino acid
  MOD_RES (525)..(564): Any amino acid
XXXXXXXXXXXXXXVAYDKICIGYQXNNSTETVNTLSEQNVPVTQVEELVHGQVNPXXXXTKLGSPLVLDDCSLKGLILGNPKCDPYLNGREWSYIVERPKEIEGICYPGSIENQEELKSLFSSIKKYERVKMFDFSKWNVTYTGTSRACNXXSNQGSFYRSIRWLTLKSGQFXXXTDEYKNTRDSNIXFMWAIHHPPTSNEQVXXXXXXXXXXXXXXXEINRIFRPNIGPRPLIRGQQGRMDYYXXVLKPGQTVKIKTNGNLIAPEYGYLITGKSHGRIXXXXXXXXXXXTGCQLNEGVMNTSKPFQNICKPYIGKCPKYIPSNSLKLAIGLRNVPQVQDRGLFGAKAGFIEGGWPGXXXXXYGFQHQNAEGIGIAADRDSTQRAIDNMQNKLNNVIDKMYKQFXXXXXXXXXXXXRINMINSQIDDQIIDIWAYNAELLXXXXXXXXXXXXDANVRNLHDRIRRXXXENALDTGDGCFEILHRCDDXXXXXXXXXXXXXXXYEEESKLERQRINGVKLEENSXXXXXXXXXXXXXXXXXXXXXXXXXXXXXXXXXXXXXXXX

SEQ ID NO: 419775 - protein, 564 aa, Influenza virus
  MOD_RES (1)..(26): Any amino acid
  MOD_RES (57)..(67): Any amino acid
  MOD_RES (89)..(95): Any amino acid
  MOD_RES (148)..(153): Any amino acid
  MOD_RES (182)..(189): Any amino acid
  MOD_RES (205)..(219): Any amino acid
  MOD_RES (245)..(261): Any amino acid
  MOD_RES (283)..(291): Any amino acid
  MOD_RES (352)..(365): Any amino acid
  MOD_RES (406)..(417): Any amino acid
  MOD_RES (438)..(453): Any amino acid
  MOD_RES (467)..(469): Any amino acid
  MOD_RES (489)..(503): Any amino acid
  MOD_RES (527)..(564): Any amino acid
XXXXXXXXXXXXXXXXXXXXXXXXXXNNSTETVNTLTEQNVPVTQVEELVHGGVDPXXXXXXXXXXXVLDDCSLEGLVLGNPKCDLYLXXXXXXXIVERPKEMEGVCYPGSIENQEELRFLFSSIKKYERVKMFDFIKWNVTYTGTSXXXXXXSNQGSFYRNMRWLTLKSEQFPVQTDEYKXXXXXXXXFIWAIHHPPTSAEQVXXXXXXXXXXXXXXXEINRNFKPNIGPRPFVRGQQGRMDYXXXXXXXXXXXXXXXXXNLIAPEYGHLTTGKSHGRILKXXXXXXXXXTECQLNEGVINTSKPFQNTSRHYIGKCPKYISSGSLKLAIGLRNVPQIQNRGLFGAKAGFXXXXXXXXXXXXXXFQHQNAEGTGMAADRDSTQMAIDNMQNKLNNVIDKMNNQFXXXXXXXXXXXXRINMINSKINDQITDIWAYNXXXXXXXXXXXXXXXXDANVRNLHDRTRRXXXENAVDTGDGCFEILHRCNDXXXXXXXXXXXXXXXYEDESRIERQKISGVKLEENSTYXXXXXXXXXXXXXXXXXXXXXXXXXXXXXXXXXXXXXX

SEQ ID NO: 419776 - protein, 564 aa, Influenza virus
  MOD_RES (1)..(26): Any amino acid
  MOD_RES (41)..(44): Any amino acid
  MOD_RES (57)..(69): Any amino acid
  MOD_RES (91)..(102): Any amino acid
  MOD_RES (124)..(135): Any amino acid
  MOD_RES (152)..(153): Any amino acid
  MOD_RES (175)..(193): Any amino acid
  MOD_RES (205)..(219): Any amino acid
  MOD_RES (247)..(269): Any amino acid
  MOD_RES (287)..(291): Any amino acid
  MOD_RES (311)..(314): Any amino acid
  MOD_RES (348)..(366): Any amino acid
  MOD_RES (400)..(417): Any amino acid
  MOD_RES (438)..(454): Any amino acid
  MOD_RES (467)..(469): Any amino acid
  MOD_RES (489)..(503): Any amino acid
  MOD_RES (515)..(564): Any amino acid
XXXXXXXXXXXXXXXXXXXXXXXXXXNNSTDTVNTLTEQNXXXXQVEELVHGGINPXXXXXXXXXXXXXDDCSLEGLILSNPKCDLYLNGXXXXXXXXXXXXMEGVCYPGSIKNQEELRSLFSXXXXXXXXXXXXFTKWNVTYTGISKACNXXSNQDSFYRSMKWLTLKSGQFPXXXXXXXXXXXXXXXXXXXIHHPPTSDEQIXXXXXXXXXXXXXXXEIDRSFRPNIGPRPLVMGQQGRMDYYWXXXXXXXXXXXXXXXXXXXXXXXHLITGKSHGRVLKNNLPXXXXXTECQLNEGIMNTSKPFQNTXXXXIGKCPKYIPSRSLKLAIGLRNVPQAQNRGLFGAXXXXXXXXXXXXXXXXXXXQHQNSEGTGIVADRDSTQKAIDIMQNKLNNVIDXXXXXXXXXXXXXXXXXXRINMINSKIEDQITDIWAYNXXXXXXXXXXXXXXXXXANVRNLHDRVKRXXXENAIDNGDGCFEILHKCDDXXXXXXXXXXXXXXXYEEESRIERQKXXXXXXXXXXXXXXXXXXXXXXXXXXXXXXXXXXXXXXXXXXXXXXXXXX

SEQ ID NO: 419777 - protein, 564 aa, Influenza virus
  MOD_RES (1)..(223): Any amino acid
  MOD_RES (235)..(328): Any amino acid
  MOD_RES (341)..(564): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSFKPNIGPRPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAIGPRNVPQAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419778 - protein, 564 aa, Influenza virus
  MOD_RES (1)..(225): Any amino acid
  MOD_RES (237)..(564): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKPNIGPRPLVMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419779 - protein, 567 aa, Influenza virus
  MOD_RES (1)..(17): Any amino acid
  MOD_RES (63)..(63): Any amino acid
  MOD_RES (86)..(89): Any amino acid
  MOD_RES (138)..(172): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (468)..(472): Any amino acid
  MOD_RES (504)..(504): Any amino acid
  MOD_RES (564)..(567): Any amino acid
XXXXXXXXXXXXXXXXXADRICVGYLSTNSSERVDTLLENGVPVTSSVDLVETNHTGTYCSLXGISPVHLGDCSFEGWIVGNPACXXXXGIREWSYLIEDPSAPHGLCYPGELDNNGELRHLFSGIRSFSRTELIPPXXXXXXXXXXXXXXXXXXXXXXXXXXXXXXXXXXXGGYPVIKKTYNNTTGRDVLVLWGIHHPXXXXXXXXXXXXXXPYTLVSTSSWSXXXXXXXGVRPGYNGQRSWMKIYWXXXXXXXXISFESNGGLLAPRYGYIIEEYGKGRIFQSRIRXXKCNTKCQTSVGGINTNKTFQNIERNALGDCPKYIKSGQLKLATGLRNVPAXXXRGLFGAIAGFIEGGWPGLINGWYGFQHQNEQGVGMAADKESTQKAIDQITTKINNIIDKMNGNYDSIRGEFNQVEKRINMLADRIDDAVTDVWSYNAKLLVLLENDKTLDMHDANVRNLHDQVRXXXXXNAIDEGNGCFELLHKCNDSCMETIRNGTYNHXEYAEESKLKRQEIEGIKLKSEDNVYKALSIYSCIASSVVLVGLILAFIMWACSSGNCRFXXXX

SEQ ID NO: 419780 - protein, 567 aa, Influenza virus
  MOD_RES (1)..(17): Any amino acid
  MOD_RES (62)..(63): Any amino acid
  MOD_RES (86)..(89): Any amino acid
  MOD_RES (138)..(179): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (357)..(365): Any amino acid
  MOD_RES (468)..(472): Any amino acid
  MOD_RES (504)..(504): Any amino acid
  MOD_RES (564)..(567): Any amino acid
XXXXXXXXXXXXXXXXXADRICIGYLSTNSSERVDTLLENDVPVTSSVDLIETNHTGTYCSXXGVSPVHLGDCSFEGWIGGNPACXXXXGVREWSYLIEDPGAPHGLCYPGELNNNGELRHLFSGIKSFSRTELIAPXXXXXXXXXXXXXXXXXXXXXXXXXXXXXXXXXXXXXXXXXXGTYNNTTGRDVLVMWGIHHPXXXXXXXXXXXXXXPYTLVSTKSWSXXXXXXXGIRPGYNGQKSWMKIYWXXXXXXXXITFESNGGLLAPKYGYIIEEYGKGRIFQSPIRXXRCNTKCQTSVGGIDTNKTFQNIDKNALGDCPKYIKSDQLKLATGLRNIPAXXXRGFFGAIAGFIEGXXXXXXXXXYGFQHQNEQGTGIAADKESTQKAIDRITTKINNIIEKMNGNYDSIRGEFSQVEQRINMLADRIDDAVTDIWSYNAKLLVLLENDKTLNMHDANVRNLHEQVRXXXXXNAVDEGNGCFELLHKCNNSCMETIRNGTYDHXEYEEESKLKRQEINGIKLKSDDSVYKALSIYSCIASSIVLVGLILSFIMWACSNGSCRFXXXX

SEQ ID NO: 419781 - protein, 567 aa, Influenza virus
  MOD_RES (1)..(17): Any amino acid
  MOD_RES (63)..(63): Any amino acid
  MOD_RES (85)..(89): Any amino acid
  MOD_RES (113)..(122): Any amino acid
  MOD_RES (138)..(179): Any amino acid
  MOD_RES (200)..(213): Any amino acid
  MOD_RES (225)..(231): Any amino acid
  MOD_RES (249)..(256): Any amino acid
  MOD_RES (289)..(290): Any amino acid
  MOD_RES (341)..(343): Any amino acid
  MOD_RES (358)..(365): Any amino acid
  MOD_RES (387)..(390): Any amino acid
  MOD_RES (402)..(408): Any amino acid
  MOD_RES (430)..(430): Any amino acid
  MOD_RES (468)..(472): Any amino acid
  MOD_RES (502)..(504): Any amino acid
  MOD_RES (564)..(567): Any amino acid
XXXXXXXXXXXXXXXXXADKICVGYLSTNSTEKVDTLLENNVPVTSSIDLIETTHTGTYCSLXGVSPVHLGDCRFEGWIVGNPAXXXXXGTREWSYLIEDPAAPHGLCYPGEXXXXXXXXXXFSGIKSFSRTQLIAPXXXXXXXXXXXXXXXXXXXXXXXXXXXXXXXXXXXXXXXXXXRTYNNTTGRDVLVIWGIHHPXXXXXXXXXXXXXXPYTLVSTGSWSXXXXXXXGVRPGYNGQKSWTKIYWXXXXXXXXITFESNGGFLAPRYGYIIEEYGRGRIFQSRIRXXRCNTRCQTSVGGINTNRTFQNIDKNALGECPKYIKSDQLKLATGLKNVPAXXXRGLLGAIAGFIEGGXXXXXXXXYGFQHQNEQGMGMAADKESTQXXXXQITTKINNIIEXXXXXXXSIRGEFNQVENRINMLADRIDXAVTDIWSYNARLLVLLENDKTLDLHDANVRNLHEQIKXXXXXNAINEGNGCFELLHKCNNTCMETIRNGTYXXXKYEEESKLKRQEIDGIKLKSDDNVYKALSIYSCIASSIVMVGLILAFIMWTCNSGNCRFXXXX

SEQ ID NO: 419782 - protein, 567 aa, Influenza virus
  MOD_RES (1)..(21): Any amino acid
  MOD_RES (63)..(63): Any amino acid
  MOD_RES (85)..(91): Any amino acid
  MOD_RES (113)..(125): Any amino acid
  MOD_RES (138)..(179): Any amino acid
  MOD_RES (200)..(213): Any amino acid
  MOD_RES (225)..(231): Any amino acid
  MOD_RES (244)..(256): Any amino acid
  MOD_RES (268)..(275): Any amino acid
  MOD_RES (289)..(303): Any amino acid
  MOD_RES (324)..(325): Any amino acid
  MOD_RES (338)..(343): Any amino acid
  MOD_RES (360)..(367): Any amino acid
  MOD_RES (387)..(408): Any amino acid
  MOD_RES (430)..(449): Any amino acid
  MOD_RES (468)..(483): Any amino acid
  MOD_RES (504)..(510): Any amino acid
  MOD_RES (557)..(567): Any amino acid
XXXXXXXXXXXXXXXXXXXXXCVGYLSTNSSDKVDTLLESDVPVTSSIDLVETSHTGTYCSLXGVSPVHLGDCNFEGWIVGNPAXXXXXXXREWSYLIEDPTAPHGLCYPGEXXXXXXXXXXXXXIRSFSRTELIAPXXXXXXXXXXXXXXXXXXXXXXXXXXXXXXXXXXXXXXXXXXGAYNNTTGRDVLVMWGLHHPXXXXXXXXXXXXXXPYTLVTTSSWSXXXXXXXGTRPGYNGQKSWXXXXXXXXXXXXXVSFESNGGLLAXXXXXXXXEYGKGRIFQSHIRXXXXXXXXXXXXXXXNTNRTFQNIDRNALGDCPKYXXSGQLKLATGLKNXXXXXXRAVDGTIAGFIEGGWPXXXXXXXXFQHQNEQGVGIAADKESTQXXXXXXXXXXXXXXXXXXXXXXSIRGEFSQVERRINMLADRIDXXXXXXXXXXXXXXXXXXXXKTLDMHDANVKNLHEQVRXXXXXXXXXXXXXXXXLLHKCNDSCMDTIRNGTYNHXXXXXXXKLKRQEIEGIRLKSEDGVYKALSIYSCIASSVVLVGPILSFIMWAGXXXXXXXXXXX

SEQ ID NO: 419783 - protein, 567 aa, Influenza virus
  MOD_RES (1)..(22): Any amino acid
  MOD_RES (54)..(73): Any amino acid
  MOD_RES (86)..(95): Any amino acid
  MOD_RES (117)..(179): Any amino acid
  MOD_RES (192)..(213): Any amino acid
  MOD_RES (225)..(231): Any amino acid
  MOD_RES (247)..(277): Any amino acid
  MOD_RES (289)..(308): Any amino acid
  MOD_RES (341)..(370): Any amino acid
  MOD_RES (392)..(408): Any amino acid
  MOD_RES (426)..(455): Any amino acid
  MOD_RES (468)..(512): Any amino acid
  MOD_RES (541)..(542): Any amino acid
  MOD_RES (564)..(567): Any amino acid
XXXXXXXXXXXXXXXXXXXXXXVGYLSTNSSEKVDTLLENGVPVTSTIDLIETXXXXXXXXXXXXXXXXXXXXSFEGWIVGNPSCXXXXXXXXXXYLIEDPSAPHRLCYPGELDNNXXXXXXXXXXXXXXXXXXXXXXXXXXXXXXXXXXXXXXXXXXXXXXXXXXXXXXXXXXXXXXXGVYNNTTGRDVLXXXXXXXXXXXXXXXXXXXXXXPYTLVSTRSWSXXXXXXXGVRPRYNGQRSWMKIXXXXXXXXXXXXXXXXXXXXXXXXXXXXXXXGKGRIFQSRIIXXXXXXXXXXXXXXXXXXXXFQNIERNALGNCPKYIKSGQLKLATGLRNVPTXXXXXXXXXXXXXXXXXXXXXXXXXXXXXXQNEQGTGIAAEKESTQKAIDQXXXXXXXXXXXXXXXXXSIRGEFNQVEQRINMLAXXXXXXXXXXXXXXXXXXXXXXXXXXXXXXDANVRNLHDQIRXXXXXXXXXXXXXXXXXXXXXXXXXXXXXXXXXXXXXXXXXXXXXKRQEIEGIKLESEDNVYRALSIYSCIASXXVLVGLILTFIMWACNSGNCRFXXXX

SEQ ID NO: 419784 - protein, 567 aa, Influenza virus
  MOD_RES (1)..(24): Any amino acid
  MOD_RES (46)..(329): Any amino acid
  MOD_RES (341)..(550): Any amino acid
  MOD_RES (564)..(567): Any amino acid
XXXXXXXXXXXXXXXXXXXXXXXXYLSTNSSEKVNTLLENDVPVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLATGLRNVPSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFIMWACSNGNCRFXXXX

SEQ ID NO: 419785 - protein, 568 aa, Influenza virus; identical to SEQ ID NO: 418424

SEQ ID NO: 419786 - protein, 568 aa, Influenza virus
  MOD_RES (1)..(9): Any amino acid
  MOD_RES (23)..(162): Any amino acid
  MOD_RES (184)..(568): Any amino acid
XXXXXXXXXGSEHTAYSQITNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFFSRLNWLTKETNGNYGPINVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419787 - protein, 570 aa, Influenza virus; identical to SEQ ID NO: 418426

SEQ ID NO: 419788 - protein, 570 aa, Influenza virus
  MOD_RES (1)..(6): Any amino acid
  MOD_RES (68)..(75): Any amino acid
  MOD_RES (150)..(151): Any amino acid
  MOD_RES (191)..(195): Any amino acid
  MOD_RES (230)..(266): Any amino acid
  MOD_RES (288)..(308): Any amino acid
  MOD_RES (334)..(336): Any amino acid
  MOD_RES (358)..(399): Any amino acid
  MOD_RES (421)..(518): Any amino acid
  MOD_RES (540)..(570): Any amino acid
XXXXXXVILVLGLSMVRSDKICLGHHAVPNGTKVNTLTEKGVEVVNATETVEITGINKVCTKGKKAVXXXXXXXXGTIIGPPQCDSHLKFKADLIIERRNSSDICYPGKFTNEEALRQIIRESGGIDKEPMGFRYSGIKTDGATSACKRXXSSFYSEMKWLLSSKANQVFPQLNQTYRNNRKEPALIVWGXXXXXSLDEQNKLYGAGNKLITVGSSKYRQSFSPSPGARXXXXXXXXXXXXXXXXXXXXXXXXXXXXXXXXXXXXXTFLRSNAPSGVEYNGKSLGIQXXXXXXXXXXXXXXXXXXXXXSPLPFQNIDSWAVGRCPRYVKQSSLXXXLGMKNVPEKIHTRGLFGAIAGXXXXXXXXXXXXXXXXXXXXXXXXXXXXXXXXXXXXXXXXXXKLNRLIEKTNTQFELIDNEFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIMINPVKLSGGYKDVILWFSXXXXXXXXXXXXXXXXXXXXXXXXXXXXXXX

SEQ ID NO: 419789 - protein, 570 aa, Influenza virus
  MOD_RES (1)..(154): Any amino acid
  MOD_RES (176)..(217): Any amino acid
  MOD_RES (239)..(337): Any amino acid
  MOD_RES (366)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYSEMKWLSSSGNNQVFPQLNQXXXXXXXXXXXXXXXXXXXXXXXXXXXXXXXXXXXXXXXXXXYQQSFSPSPGDRPKVNGQAGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGMKNVPEKIRVKRRPVAKAGFIENGWEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419790 - protein, 570 aa, Influenza virus
  MOD_RES (1)..(155): Any amino acid
  MOD_RES (177)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSEMKWLLSSKDNQVFPQLNQTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419791 - protein, 569 aa, Influenza virus
  MOD_RES (13)..(15): Any amino acid
  MOD_RES (160)..(160): Any amino acid
  MOD_RES (172)..(173): Any amino acid
  MOD_RES (343)..(343): Any amino acid
  MOD_RES (471)..(471): Any amino acid
QPNDGQVLYFLIXXXGRYSKADKICIGYLSNNSSDTVDTLTENGVPVTSSIDLVETNHTGTYCSLNGVSPIHLGDCSFEGWIVGNPSCATNINIREWSYLIEDPNAPNKLCFPGELDNNGELRHLFSGVNSFSRTELISPSKWGNVLDGVTASCLDRGAXSFYRNLVWLVKXXIGEYPVVKGEYNNTTGRDVLVLWGIHHPDTETTATNLYVNKNPYTLVSTKEWSKRYELEIGTRIGDGQRSWMKLYWHLMRPGERITFESNGGLLAPRYGYIIEKYGTGRIFQSGVRMAKCNTKCQTSMGGINTNKTFQNIERNALGDCPKYIKSGQLKLATGLRNVPSIXGERGLFGAIAGFIEGGWPGLINGWYGFQHQNEQGTGIAADKASTQKAIDEITTKINNIIEKMNGNYDSIRGEFNQVEKRINMLADRVDDAVTDIWSYNAKLLVLIENDRTLDLHDANVRNLHDQVKRXLKNNAIDEGDGCFNLLHKCNDSCMETIRNGTYNHEDYKEESQLKRQEIEGIKLKTEDNVYKVLSIYSCIASSIVMVGLILAFIMWACSSGNCRFNVCI

SEQ ID NO: 419792 - protein, 569 aa, Influenza virus
  MOD_RES (1)..(15): Any amino acid
  MOD_RES (79)..(79): Any amino acid
  MOD_RES (127)..(128): Any amino acid
  MOD_RES (160)..(160): Any amino acid
  MOD_RES (172)..(173): Any amino acid
  MOD_RES (329)..(330): Any amino acid
  MOD_RES (352)..(374): Any amino acid
  MOD_RES (403)..(415): Any amino acid
  MOD_RES (471)..(471): Any amino acid
XXXXXXXXXXXXXXXVKYSRADKICIGYLSNNATDTVDTLTENGVPVTSSVDLVETNHTGTYCSLNGISPIHLGDCSFXGWIVGNPSCASNINIREWSYLIEDPNAPHKLCFPGEVDNNGELRHLFXXVNSFSRTELINPSKWGDILEGTTASCQNRGAXSFYRNLIWLVNXXNGKYPVIKGDYNNTTGRDVLVLWGIHHPDSETTATKLYVNKNPYTLVSTKEWSRRYELEIGTRIGEGQRSWMKIYWHLMHPGERIMFESNGGLIAPRYGYIIEKYGSGRIFQSGVRLAKCNTKCQTSVGGIDTNKTFQNIDRNAIGDCPKYIKSGXXKLATGLRNVPIPIGERGLFGAXXXXXXXXXXXXXXXXXXXXXXXEQGTGIAADKTSTQKAINEITTKINNIIXXXXXXXXXXXXXFNQVEKRINMIADRVDDAVTDVWSYNAKLLVLLENGRTLDLHDANVKNLHEQVKRXLKDNAIDEGDGCFSILHKCNDSCMEAIRNGTYNHEDYREESQLKRQEIEGIKLKSEDNVYKVLSIYSCIASSTVLVGLILAFIMWACSNGSCRFNVCI

SEQ ID NO: 419793 - protein, 569 aa, Influenza virus
  MOD_RES (1)..(15): Any amino acid
  MOD_RES (47)..(60): Any amino acid
  MOD_RES (82)..(99): Any amino acid
  MOD_RES (123)..(128): Any amino acid
  MOD_RES (160)..(160): Any amino acid
  MOD_RES (172)..(179): Any amino acid
  MOD_RES (191)..(194): Any amino acid
  MOD_RES (219)..(224): Any amino acid
  MOD_RES (274)..(276): Any amino acid
  MOD_RES (316)..(331): Any amino acid
  MOD_RES (343)..(343): Any amino acid
  MOD_RES (355)..(374): Any amino acid
  MOD_RES (396)..(418): Any amino acid
  MOD_RES (440)..(440): Any amino acid
  MOD_RES (471)..(471): Any amino acid
  MOD_RES (496)..(505): Any amino acid
XXXXXXXXXXXXXXXGRYSIADKICIGYLSNNSTDKVDTLTENGVPXXXXXXXXXXXXXXTYCSLNGVSPVHLGDCSFEGWXXXXXXXXXXXXXXXXXXLIEDPNAPNKFCYPGELDNNGELXXXXXXVNSFSRTELIPPSKWGDVLDGVTASCLDKGAXSFYRNLVWIVKXXXXXXXXVKGDYNNTTGRXXXXLWGIHHPDTEATANKLYVNKNPYTXXXXXXWSKRYELEIGARIGEGQRSWMKLYWHLMHPGERITFESSGGLLAPRYGYXXXKYGTGRIFQSRIRMGKCNTKCQTSLGGINTNKTFQNIDRXXXXXXXXXXXXXXXXLATGLRNVPSVXVERGLFGAIAGXXXXXXXXXXXXXXXXXXXXEQGTGIAADKVSTQKAINEITXXXXXXXXXXXXXXXXXXXXXXXVEKRINMLADWVDDAVTDIWSXNAKLLVLLENDRTLDLHDANVRNLHEQIKRXLKSNAIDEGDGCFSLLHKCNDSCMXXXXXXXXXXEDYREESQLKKQEIEGIKLKTEDNIYKILSIYSCIASSVVLVGLILAFILWACSSGNCRFSVCI

SEQ ID NO: 419794 - protein, 569 aa, Influenza virus
  MOD_RES (1)..(15): Any amino acid
  MOD_RES (54)..(60): Any amino acid
  MOD_RES (79)..(101): Any amino acid
  MOD_RES (121)..(130): Any amino acid
  MOD_RES (160)..(160): Any amino acid
  MOD_RES (172)..(179): Any amino acid
  MOD_RES (192)..(194): Any amino acid
  MOD_RES (224)..(236): Any amino acid
  MOD_RES (270)..(277): Any amino acid
  MOD_RES (326)..(343): Any amino acid
  MOD_RES (355)..(380): Any amino acid
  MOD_RES (402)..(444): Any amino acid
  MOD_RES (471)..(471): Any amino acid
  MOD_RES (498)..(522): Any amino acid
XXXXXXXXXXXXXXXGRYSRADKICIGYLSNNSTDTVDTLTETGVPVTSSVDLXXXXXXXTYCSLNGISPVHLGDCSFXXXXXXXXXXXXXXXXXXXXXXXEDPNAPNKLCYPGELDNNGXXXXXXXXXXSFSRTELINPNKWGNVLDGVTASCRDNGAXSFYRNLIWLVKXXXXXXXXVRGDYNNTTGRDXXXLWGIHHPDTEEVAINLYASKNPYTLVSTKXXXXXXXXXXXXXIGDGQRSWMKIYWHLMSPGERIMFESNGGLLAPXXXXXXXXYGTGRIFQSGIRMARCNTKCQTSLGGVNTNKTFQNIEKNALGDCPKYIXXXXXXXXXXXXXXXXXXNERGLFGAIAGXXXXXXXXXXXXXXXXXXXXXXXXXXAADKVSTQKALNEITTKINNIXXXXXXXXXXXXXXXXXXXXXXXXXXXXXXXXXXXXXXXXXXXLVLLENGRTLGLHDANVRNLHDQIKRXLQNNAIDEGDGCFNFFHKCNDSCMETXXXXXXXXXXXXXXXXXXXXXXXXXKLKTEDNVYKILSIYSCIASSIVLVGLILAFIMWACSNGNCRFNVCI

SEQ ID NO: 419795 - protein, 569 aa, Influenza virus
  MOD_RES (1)..(15): Any amino acid
  MOD_RES (48)..(101): Any amino acid
  MOD_RES (123)..(130): Any amino acid
  MOD_RES (157)..(160): Any amino acid
  MOD_RES (172)..(195): Any amino acid
  MOD_RES (220)..(242): Any amino acid
  MOD_RES (270)..(280): Any amino acid
  MOD_RES (303)..(343): Any amino acid
  MOD_RES (355)..(381): Any amino acid
  MOD_RES (396)..(455): Any amino acid
  MOD_RES (471)..(524): Any amino acid
  MOD_RES (546)..(569): Any amino acid
XXXXXXXXXXXXXXXSRYSKADKICIGYLSNNSTDKIDTLTETGVPVXXXXXXXXXXXXXXXXXXXXXXXXXXXXXXXXXXXXXXXXXXXXXXXXXXXXXXEDPNAPHKLCYPGEVDNNGELXXXXXXXXSFSRTELISPNKWGDILDGVTASCRDXXXXSFYRNLIWLVQXXXXXXXXXXXXXXXXXXXXXXXXWGIHHPDTEAVATRLYVNKNPYTLXXXXXXXXXXXXXXXXXXXXXXXSWMKLYWHLMSPGERTTFESNGGLIAPXXXXXXXXXXXGRIFQSGVRVARCNTKCQTSVGXXXXXXXXXXXXXXXXXXXXXXXXXXXXXXXXXXXXXXXXXSERGLFGAIAGXXXXXXXXXXXXXXXXXXXXXXXXXXXADKASTQKAINEITXXXXXXXXXXXXXXXXXXXXXXXXXXXXXXXXXXXXXXXXXXXXXXXXXXXXXXXXXXXXLHDANVKNLHDQIKRXXXXXXXXXXXXXXXXXXXXXXXXXXXXXXXXXXXXXXXXXXXXXXXXXXXXXXKTEDNVYKVLAIYSCIASSIVXXXXXXXXXXXXXXXXXXXXXXXX

SEQ ID NO: 419796 - protein, 569 aa, Influenza virus
  MOD_RES (1)..(33): Any amino acid
  MOD_RES (47)..(148): Any amino acid
  MOD_RES (160)..(247): Any amino acid
  MOD_RES (259)..(293): Any amino acid
  MOD_RES (305)..(343): Any amino acid
  MOD_RES (355)..(535): Any amino acid
  MOD_RES (555)..(569): Any amino acid
XXXXXXXXXXXXXXXXXXXXXXXXXXXXXXXXXTDKVDTLTETGVPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVTASCLDRGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXYWHLMRPGERTXXXXXXXXXXXXXXXXXXXXXXXXXXXXXXXXXXXNTKCQTSMGGVXXXXXXXXXXXXXXXXXXXXXXXXXXXXXXXXXXXXXXXDERGLFGAIAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIYSCIASSTVMVGLILAFIXXXXXXXXXXXXXXX

SEQ ID NO: 419797 - protein, 627 aa, Influenza virus
  MOD_RES (19)..(26): Any amino acid
  MOD_RES (48)..(304): Any amino acid
  MOD_RES (325)..(342): Any amino acid
  MOD_RES (356)..(385): Any amino acid
  MOD_RES (413)..(479): Any amino acid
  MOD_RES (491)..(603): Any amino acid
  MOD_RES (619)..(627): Any amino acid
KQGKTKATKMKAILVVLLXXXXXXXXTAYSQITNGTTGNPIICLGHHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSNAPSGIEYNGKSLGIQSDAXXXXXXXXXXXXXXXXXXTSLTSLPFQNIHPXXXXXXXXXXXXXXXXXXXXXXXXXXXXXXRGLFGAIAGFIEGGWTGMVDGWYGYHHXXXXXXXXXXXXXXXXXXXXXXXXXXXXXXXXXXXXXXXXXXXXXXXXXXXXXXXXXXXXXXXXXXXYNAELLVLLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLCSVEYASKTRISEIXXXXXXXXX

SEQ ID NO: 419798 - protein, 627 aa, Influenza virus
  MOD_RES (19)..(304): Any amino acid
  MOD_RES (322)..(387): Any amino acid
  MOD_RES (413)..(479): Any amino acid
  MOD_RES (491)..(609): Any amino acid
  MOD_RES (622)..(627): Any amino acid
KQGKTKATKMEAILVVLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSNAPSGVEYNGKSLGIQXXXXXXXXXXXXXXXXXXXXXXXXXXXXXXXXXXXXXXXXXXXXXXXXXXXXXXXXXXXXXXXXXXLFGAIAGFIENGWEGMVDGWYGFRHXXXXXXXXXXXXXXXXXXXXXXXXXXXXXXXXXXXXXXXXXXXXXXXXXXXXXXXXXXXXXXXXXXXYQAELLVAMENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLQCRICIRADGXXXXXX

SEQ ID NO: 419799 - protein, 627 aa, Influenza virus
  MOD_RES (1)..(3): Any amino acid
  MOD_RES (19)..(390): Any amino acid
  MOD_RES (413)..(479): Any amino acid
  MOD_RES (491)..(609): Any amino acid
XXXKTKATKMKAIIVVLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIAGFIEGGWPGLINGWYGFQHXXXXXXXXXXXXXXXXXXXXXXXXXXXXXXXXXXXXXXXXXXXXXXXXXXXXXXXXXXXXXXXXXXXYNAELLILLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLQCRICILDQNFRNIRK

SEQ ID NO: 419800 - protein, 627 aa, Influenza virus
  MOD_RES (1)..(6): Any amino acid
  MOD_RES (19)..(393): Any amino acid
  MOD_RES (413)..(479): Any amino acid
  MOD_RES (491)..(609): Any amino acid
  MOD_RES (625)..(627): Any amino acid
XXXXXXQPNDGQVLYFLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFIEGGWTGMIDGWYGYHHXXXXXXXXXXXXXXXXXXXXXXXXXXXXXXXXXXXXXXXXXXXXXXXXXXXXXXXXXXXXXXXXXXXYNAQLLVLLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNMRCTISLVKTTLFLXXX

SEQ ID NO: 419801 - protein, 627 aa, Influenza virus
  MOD_RES (1)..(393): Any amino acid
  MOD_RES (413)..(479): Any amino acid
  MOD_RES (491)..(609): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFIEGGWPGLVAGWYGFQHXXXXXXXXXXXXXXXXXXXXXXXXXXXXXXXXXXXXXXXXXXXXXXXXXXXXXXXXXXXXXXXXXXXYNAKLLVLLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLQCRICIDFRDMRKNTL

SEQ ID NO: 419802 - protein, 599 aa, Influenza virus
  MOD_RES (20)..(26): Any amino acid
  MOD_RES (62)..(83): Any amino acid
  MOD_RES (95)..(123): Any amino acid
  MOD_RES (147)..(180): Any amino acid
  MOD_RES (193)..(266): Any amino acid
  MOD_RES (278)..(316): Any amino acid
  MOD_RES (330)..(330): Any amino acid
  MOD_RES (343)..(343): Any amino acid
  MOD_RES (402)..(408): Any amino acid
  MOD_RES (430)..(434): Any amino acid
  MOD_RES (473)..(486): Any amino acid
  MOD_RES (506)..(506): Any amino acid
  MOD_RES (526)..(542): Any amino acid
  MOD_RES (594)..(599): Any amino acid
KQGKTKATKMKAILVVLLYXXXXXXXADTLCIGYHANNSTDTVDTVLEKNVTVTHSVNLLEXXXXXXXXXXXXXXXXXXXXXXIAGWILGNPECXXXXXXXXXXXXXXXXXXXXXXXXXXXXXDYEELREQLSSVSSFERFEIFPKXXXXXXXXXXXXXXXXXXXXXXXXXXXXXXXXXXKEKENSYPMINKXXXXXXXXXXXXXXXXXXXXXXXXXXXXXXXXXXXXXXXXXXXXXXXXXXXXXXXXXXXXXXXXXXXXXXXXXXDKITFEATGNLXXXXXXXXXXXXXXXXXXXXXXXXXXXXXXXXXXXXXXXTSLTSLPFQNIHPXTIGKCPKYVKSTXLRLATGLRNVPSIQSRGLFGAIAGFIEGGWTGMVDGWYGYHHQNEQGSGYAADLKSTQXXXXXXXNKVNSVIEKMNTQFTAVGKEFXXXXXRIENLNKKVDDGFLDIWTYNAELLVLLENERTLDYHDSXXXXXXXXXXXXXXNNAKEIGNGCFEFYHKCDNXCMESVKNGTYDYPKYSEEAXXXXXXXXXXXXXXXXXYQILAIYSTVASSLVLVVSLGAISFWMCSNGSLQCRICISLQCRICIRADGXXXXXX

SEQ ID NO: 419803 - protein, 599 aa, Influenza virus
  MOD_RES (20)..(26): Any amino acid
  MOD_RES (62)..(83): Any amino acid
  MOD_RES (95)..(123): Any amino acid
  MOD_RES (147)..(180): Any amino acid
  MOD_RES (193)..(266): Any amino acid
  MOD_RES (278)..(330): Any amino acid
  MOD_RES (343)..(343): Any amino acid
  MOD_RES (364)..(366): Any amino acid
  MOD_RES (402)..(408): Any amino acid
  MOD_RES (430)..(434): Any amino acid
  MOD_RES (473)..(486): Any amino acid
  MOD_RES (506)..(506): Any amino acid
  MOD_RES (526)..(542): Any amino acid
  MOD_RES (591)..(599): Any amino acid
KQGKTKATKMEAILVVLLYXXXXXXXADTICIGYHANNSTDTVDTILEKNVTVTHSVDLLEXXXXXXXXXXXXXXXXXXXXXXVAGWILGNPECXXXXXXXXXXXXXXXXXXXXXXXXXXXXXNYEELREQLSSVSSFEKFEIFPKXXXXXXXXXXXXXXXXXXXXXXXXXXXXXXXXXXKEKENSYPKINKXXXXXXXXXXXXXXXXXXXXXXXXXXXXXXXXXXXXXXXXXXXXXXXXXXXXXXXXXXXXXXXXXXXXXXXXXXDTIIFEANGNLXXXXXXXXXXXXXXXXXXXXXXXXXXXXXXXXXXXXXXXXXXXXXXXXXXXXXTIGECPKYVRSAXLRMVTGLRNIPSIQSRGLFGXXXGFIEGGWTGMIDGWYGYHHQNGQGSGYAADQKSTQXXXXXXXNKVNSIIEKMNTQFTVVGKEFXXXXXRMENLNKKVDDGLLDVWTYNAELLVLLENERTLDFHDSXXXXXXXXXXXXXXNNAKELGNGCFEFYHKCNDXCMESVKNGTYNYPKYSEESXXXXXXXXXXXXXXXXXYQILAIYSTAASSLVLLVSLGAISFWMCSGHSCRICIEYASKTRISEIXXXXXXXXX

SEQ ID NO: 419804 - protein, 599 aa, Influenza virus
  MOD_RES (1)..(3): Any amino acid
  MOD_RES (20)..(26): Any amino acid
  MOD_RES (62)..(83): Any amino acid
  MOD_RES (95)..(123): Any amino acid
  MOD_RES (147)..(266): Any amino acid
  MOD_RES (278)..(330): Any amino acid
  MOD_RES (343)..(343): Any amino acid
  MOD_RES (358)..(379): Any amino acid
  MOD_RES (399)..(408): Any amino acid
  MOD_RES (430)..(434): Any amino acid
  MOD_RES (473)..(486): Any amino acid
  MOD_RES (506)..(506): Any amino acid
  MOD_RES (526)..(542): Any amino acid
XXXKTKATKMKAIIVVLLYXXXXXXXADTICVGYHANNSTDTVDTLLEKNVTVTHSVNILEXXXXXXXXXXXXXXXXXXXXXXIAGWLLGNPECXXXXXXXXXXXXXXXXXXXXXXXXXXXXXDYEELKEQLSTVSSFERFEIFPNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTITFEATGNLXXXXXXXXXXXXXXXXXXXXXXXXXXXXXXXXXXXXXXXXXXXXXXXXXXXXXTIGECPKYVKSTXLRMATGLRNIPSIQXXXXXXXXXXXXXXXXXXXXXXWYGYHHQNAQGSGYAADLKXXXXXXXXXXNKVNSVVEKMNTQFTSVGKEFXXXXXRIENLNKKIDDGFLDVWTYNAELLILLENERTLDFHDLXXXXXXXXXXXXXXNNAKEVGNGCFEFYHKCDDXCMESVRNGTYDYPKYSKESXXXXXXXXXXXXXXXXXHQILAIYSTVASSSVLLVSLGAVSFWMCSNGSLRCRICISLQCRICIDFRDMRKNTL

SEQ ID NO: 419805 - protein, 599 aa, Influenza virus
  MOD_RES (1)..(8): Any amino acid
  MOD_RES (20)..(37): Any amino acid
  MOD_RES (58)..(83): Any amino acid
  MOD_RES (95)..(123): Any amino acid
  MOD_RES (147)..(266): Any amino acid
  MOD_RES (278)..(330): Any amino acid
  MOD_RES (343)..(343): Any amino acid
  MOD_RES (367)..(386): Any amino acid
  MOD_RES (399)..(408): Any amino acid
  MOD_RES (430)..(434): Any amino acid
  MOD_RES (450)..(461): Any amino acid
  MOD_RES (473)..(494): Any amino acid
  MOD_RES (506)..(506): Any amino acid
  MOD_RES (526)..(546): Any amino acid
XXXXXXXXEREAKLFVLFCXXXXXXXXXXXXXXXXXXNSTDTVDTVREKNVTVTHSVXXXXXXXXXXXXXXXXXXXXXXXXXXVAGWLLGNPECXXXXXXXXXXXXXXXXXXXXXXXXXXXXXDYEELREQLSTVSSFERFEMFPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTIIFEASGNLXXXXXXXXXXXXXXXXXXXXXXXXXXXXXXXXXXXXXXXXXXXXXXXXXXXXXTIGKCSKYVKSTXLRLATGLRNIPSVQSRGLFGAIAXXXXXXXXXXXXXXXXXXXXNEQGSGYAADQKXXXXXXXXXXNKVNTVIEKMNIQFTSVGKEFXXXXXRIENLNRKVDDGFLDXXXXXXXXXXXXENERTLDFHDFXXXXXXXXXXXXXXXXXXXXXXGCFEFYHKCNNXCMESIKNGTYDYPKYSEESXXXXXXXXXXXXXXXXXXXXXAIYSTVASSLILIVSLGAISFWMCSNGSLQCRVCISLQCRICILDQNFRNIRK

SEQ ID NO: 419806 - protein, 599 aa, Influenza virus
  MOD_RES (1)..(12): Any amino acid
  MOD_RES (24)..(38): Any amino acid
  MOD_RES (60)..(83): Any amino acid
  MOD_RES (95)..(123): Any amino acid
  MOD_RES (145)..(266): Any amino acid
  MOD_RES (278)..(331): Any amino acid
  MOD_RES (343)..(343): Any amino acid
  MOD_RES (364)..(386): Any amino acid
  MOD_RES (402)..(411): Any amino acid
  MOD_RES (430)..(434): Any amino acid
  MOD_RES (459)..(461): Any amino acid
  MOD_RES (473)..(552): Any amino acid
  MOD_RES (590)..(599): Any amino acid
XXXXXXXXXXXXIIIVVLLYTFAXXXXXXXXXXXXXXXSTDTVDTVLERNVTVTHSVNLXXXXXXXXXXXXXXXXXXXXXXXXVAGWILGNPKCXXXXXXXXXXXXXXXXXXXXXXXXXXXXXNYEELREHLSSVSSFERFEMFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTIIFEATGNLXXXXXXXXXXXXXXXXXXXXXXXXXXXXXXXXXXXXXXXXXXXXXXXXXXXXXXIGECPKYVRSTXLRMATGLRNVPSVQSRGLFGXXXXXXXXXXXXXXXXXXXXXXXNEQGSGYAADRKSTQXXXXXXXXXXNSVIEKMNIQFTAVGKEFXXXXXRIESLNNKVDDGFIDIWTYNAELLXXXENERTLDYHDFXXXXXXXXXXXXXXXXXXXXXXXXXXXXXXXXXXXXXXXXXXXXXXXXXXXXXXXXXXXXXXXXXXXXXXXXXXXXXXXXASSLVLIVSLGAIGFWMCSNGSLQCSVEYASKTRISEXXXXXXXXXX

SEQ ID NO: 419807 - protein, 599 aa, Influenza virus
  MOD_RES (1)..(127): Any amino acid
  MOD_RES (147)..(346): Any amino acid
  MOD_RES (358)..(411): Any amino acid
  MOD_RES (424)..(437): Any amino acid
  MOD_RES (459)..(552): Any amino acid
  MOD_RES (581)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKEQLSSVSSFKRFEIFPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTGLRNVPSIQXXXXXXXXXXXXXXXXXXXXXXXXXXXXXXXXXXXXXXXXXXXXXXXXXXXXXXNSIIEKMNIQFTXXXXXXXXXXXXXXNLNKKVDDGFIDVWTYNAELLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASTLVLLVSLGAIGFWMCSWSLQCRICIXXXXXXXXXXXXXXXXXXX

SEQ ID NO: 419808 - protein, 599 aa, Influenza virus
  MOD_RES (1)..(575): Any amino acid
  MOD_RES (587)..(599): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLCSVEYASKTRXXXXXXXXXXXXX

SEQ ID NO: 419809 - protein, 484 aa, Influenza virus
  MOD_RES (22)..(111): Any amino acid
  MOD_RES (227)..(233): Any amino acid
  MOD_RES (270)..(282): Any amino acid
  MOD_RES (296)..(301): Any amino acid
  MOD_RES (323)..(325): Any amino acid
  MOD_RES (341)..(360): Any amino acid
  MOD_RES (378)..(382): Any amino acid
  MOD_RES (395)..(409): Any amino acid
  MOD_RES (445)..(447): Any amino acid
  MOD_RES (464)..(468): Any amino acid
  MOD_RES (480)..(484): Any amino acid
IGLREQKQEFKMNPNQKIIIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTXXXXXXXILRTQESECACVNGSCFTVMTDGPSVMGQASYKIFKXXXXXXXXXXXXXAPNYHYEECSCYPXXXXXXCVCRDNWHGSNRPWVSFNQNLXXXIGYICSGIFGDNPRPXXXXXXXXXXXXXXXXXXXXGFSFKYGNGVWIGRTKSXXXXXGFEMIWDPNGWTXXXXXXXXXXXXXXXNEWSGYSGSFVQHPELTGLDCIRPCFWVELIRGRPXXXTTIWTSGSSISFCGVNXXXXXWSWPDGAELPFXXXXX

SEQ ID NO: 419810 - protein, 484 aa, Influenza virus
  MOD_RES (1)..(9): Any amino acid
  MOD_RES (22)..(111): Any amino acid
  MOD_RES (223)..(233): Any amino acid
  MOD_RES (259)..(282): Any amino acid
  MOD_RES (296)..(301): Any amino acid
  MOD_RES (323)..(325): Any amino acid
  MOD_RES (341)..(360): Any amino acid
  MOD_RES (378)..(382): Any amino acid
  MOD_RES (395)..(409): Any amino acid
  MOD_RES (445)..(447): Any amino acid
  MOD_RES (464)..(468): Any amino acid
XXXXXXXXXFKMNPNQKIITIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKDNSIRIGSKGDIFVIREPFISCSHLECKTFFLTQGALLNDRHSNGTVKDRSPYRALMSCPLGEAPSPYNSKFESVAWSASACHDGMGWLTIGISGPDDGAVAVLKYNGVXXXXXXXXXXXILRTQESECVCMNGSCFTIMTDGPSXXXXXXXXXXXXXXXXXXXXXXXXAPNFHYEECSCYPXXXXXXCVCRDNWHASNRPWVSFDQNLXXXIGYICSGVFGDNPRPXXXXXXXXXXXXXXXXXXXXGFSYKYGNGVWMGRTKSXXXXXGFEMIWDPDGWTXXXXXXXXXXXXXXXTDWSGYSGSFVQHPELTGMNCIRPCFWVELVRGLPXXXATIWTSGSSISFCGVDXXXXXWSWPDGADLPFTQEQK

SEQ ID NO: 419811 - protein, 484 aa, Influenza virus
  MOD_RES (1)..(111): Any amino acid
  MOD_RES (139)..(149): Any amino acid
  MOD_RES (188)..(188): Any amino acid
  MOD_RES (227)..(234): Any amino acid
  MOD_RES (259)..(282): Any amino acid
  MOD_RES (296)..(305): Any amino acid
  MOD_RES (323)..(325): Any amino acid
  MOD_RES (337)..(360): Any amino acid
  MOD_RES (376)..(382): Any amino acid
  MOD_RES (395)..(409): Any amino acid
  MOD_RES (445)..(448): Any amino acid
  MOD_RES (463)..(468): Any amino acid
  MOD_RES (480)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKDNSVRIGSKGDVFVMREPFISCSHLXXXXXXXXXXXLLNDKHSNGTVKDRSPHRTLMSCPIGEAPSPYNSRFESXAWSASACHDGTSWLTIGISGPDNEAVAVLKYNDIITDTXXXXXXXXLRTQESECVCVNGSCFTVLTDGPSXXXXXXXXXXXXXXXXXXXXXXXXAPNFYYEECSCYPXXXXXXXXXXDNWHASNRPWISFDQNLXXXMGYICSGIFGDXXXXXXXXXXXXXXXXXXXXXXXXGFSFRYGNGVWIGRTXXXXXXXGFEMVWDPNGWTXXXXXXXXXXXXXXXNDWSGYSGSFVQHPELTGLNCIKPCFWVELIRGQPXXXXTIWASGSSISFCGVXXXXXXWSWPDGAKLPFXXXXX

SEQ ID NO: 419812 - protein, 484 aa, Influenza virus
  MOD_RES (1)..(111): Any amino acid
  MOD_RES (141)..(149): Any amino acid
  MOD_RES (184)..(188): Any amino acid
  MOD_RES (227)..(234): Any amino acid
  MOD_RES (259)..(282): Any amino acid
  MOD_RES (296)..(308): Any amino acid
  MOD_RES (320)..(325): Any amino acid
  MOD_RES (341)..(360): Any amino acid
  MOD_RES (378)..(383): Any amino acid
  MOD_RES (395)..(409): Any amino acid
  MOD_RES (432)..(448): Any amino acid
  MOD_RES (464)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKDNGIRIGSKGDVFVIREPFISCSQLECXXXXXXXXXLLNDKHSNGTAKDRSPFRALMSCPVGEAPSPYNSXXXXXAWSASACHDGLGWITIGISGPDDGAVAVLKYKGIITGTXXXXXXXXLRTQESECVCINGSCFTIMTDGPNXXXXXXXXXXXXXXXXXXXXXXXXAPNSHYEECSCYPXXXXXXXXXXXXXHGSNRPWVSFDXXXXXXVGYICSGVFGDNPRSXXXXXXXXXXXXXXXXXXXXGFSYKYDNGVWIGRTKSXXXXXXFEIIWDPNGWTXXXXXXXXXXXXXXXTNWSGYSGSFVQHPELTGMDCIXXXXXXXXXXXXXXXXXTIWTSASSISFCGVNXXXXXXXXXXXXXXXXXXXXX

SEQ ID NO: 419813 - protein, 484 aa, Influenza virus
  MOD_RES (1)..(111): Any amino acid
  MOD_RES (127)..(127): Any amino acid
  MOD_RES (149)..(150): Any amino acid
  MOD_RES (173)..(188): Any amino acid
  MOD_RES (200)..(200): Any amino acid
  MOD_RES (222)..(234): Any amino acid
  MOD_RES (250)..(282): Any amino acid
  MOD_RES (296)..(308): Any amino acid
  MOD_RES (323)..(325): Any amino acid
  MOD_RES (337)..(360): Any amino acid
  MOD_RES (372)..(409): Any amino acid
  MOD_RES (442)..(448): Any amino acid
  MOD_RES (464)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKDNGVRIGSKGDVFXMREPFISCSHFECRTFFLTQGXXLNDRHSNGTIKNRSPYRALMSCXXXXXXXXXXXXXXXXAWSASACHDGVXWITIGISGPDNGAVAVLKYKGXXXXXXXXXXXXXLRTQESECACINGSCXXXXXXXXXXXXXXXXXXXXXXXXXXXXXXXXXAPNYYYEECSCYPXXXXXXXXXXXXXHASNRPWVSFNQDLXXXMGYICSGVFGDXXXXXXXXXXXXXXXXXXXXXXXXGFSYRYGNGVWXXXXXXXXXXXXXXXXXXXXXXXXXXXXXXXXXXXXXXKEWSGYSGSFVQHPELTGLDCMRPCFWVELIRXXXXXXXTIWTSGSIISFCGVNXXXXXXXXXXXXXXXXXXXXX

SEQ ID NO: 419814 - protein, 484 aa, Influenza virus
  MOD_RES (1)..(117): Any amino acid
  MOD_RES (136)..(203): Any amino acid
  MOD_RES (223)..(311): Any amino acid
  MOD_RES (323)..(329): Any amino acid
  MOD_RES (341)..(366): Any amino acid
  MOD_RES (378)..(428): Any amino acid
  MOD_RES (442)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIGSKGDIFVMREPFISCXXXXXXXXXXXXXXXXXXXXXXXXXXXXXXXXXXXXXXXXXXXXXXXXXXXXXXXXXXXXXXXXXXXXIGISGPDSGAVAVLKYNDIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNRPWVSFNHNLXXXXXXXCSGVLGDNPRPXXXXXXXXXXXXXXXXXXXXXXXXXXGDGVWIGRTKSXXXXXXXXXXXXXXXXXXXXXXXXXXXXXXXXXXXXXXXXXXXXXXXXXXXNCMRPCFWVELVRXXXXXXXXXXXXXXXXXXXXXXXXXXXXXXXXXXXXXXXXXXX

SEQ ID NO: 419815 - protein, 484 aa, Influenza virus
  MOD_RES (1)..(210): Any amino acid
  MOD_RES (222)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGAVAVLKYNDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419816 - protein, 484 aa, Influenza virus
  MOD_RES (1)..(214): Any amino acid
  MOD_RES (227)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVLKYNGIITGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419817 - protein, 484 aa, Influenza virus
  MOD_RES (1)..(214): Any amino acid
  MOD_RES (227)..(484): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVLKYNGIITETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419818 - protein, 566 aa, Influenza virus
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (369)..(434): Any amino acid
  MOD_RES (460)..(471): Any amino acid
  MOD_RES (491)..(550): Any amino acid
  MOD_RES (565)..(566): Any amino acid
XXXXXXXXXXXXXXXXXDTICIGYHANNSTDTVDTXXXKNVTVTHSVNLLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNVHPVTIGECPKYVRSXXXXXXXXXXXXXSIQSRGLFGAIAGFIEGGWTGMIDGWYGYXXXXXXXXXXXXXXXXXXXXXXXXXXXXXXXXXXXXXXXXXXXXXXXXXXXXXXXXXXXXXXXXXXIWTYNAELLVLLENERTLDFHDSNVXXXXXXXXXXXXNNAKEIGNGCFEFYHKCNNXXXXXXXXXXXXXXXXXXXXXXXXXXXXXXXXXXXXXXXXXXXXXXXXXXXXXXXXXXXXSFWMCSNGSLQCRIXX

SEQ ID NO: 419819 - protein, 566 aa, Influenza virus
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (369)..(434): Any amino acid
  MOD_RES (460)..(471): Any amino acid
  MOD_RES (491)..(550): Any amino acid
  MOD_RES (565)..(566): Any amino acid
XXXXXXXXXXXXXXXXXDTLCIGYHANNSTETVDTXXXKNVTVTHSINLLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNIHPVTIGKCPKYVKSXXXXXXXXXXXXXSIQTRGLFGAIAGFIEGGWTGMVDGWYGYXXXXXXXXXXXXXXXXXXXXXXXXXXXXXXXXXXXXXXXXXXXXXXXXXXXXXXXXXXXXXXXXXXVWTYNAELLVLLENERTLDYHDSNVXXXXXXXXXXXXNNAKELGNGCFEFYHKCDDXXXXXXXXXXXXXXXXXXXXXXXXXXXXXXXXXXXXXXXXXXXXXXXXXXXXXXXXXXXXCFWMCSNGSLQCKIXX

SEQ ID NO: 419820 - protein, 566 aa, Influenza virus
  MOD_RES (1)..(17): Any amino acid
  MOD_RES (36)..(38): Any amino acid
  MOD_RES (52)..(307): Any amino acid
  MOD_RES (327)..(339): Any amino acid
  MOD_RES (369)..(434): Any amino acid
  MOD_RES (460)..(471): Any amino acid
  MOD_RES (491)..(550): Any amino acid
  MOD_RES (564)..(566): Any amino acid
XXXXXXXXXXXXXXXXXDTICVGYHANNSTDTIDTXXXKNITVTHSVNLLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNVHPITIGECPKYVKSXXXXXXXXXXXXXSIHSRGLFGAIAGFIEGGWTGMVNGWYGYXXXXXXXXXXXXXXXXXXXXXXXXXXXXXXXXXXXXXXXXXXXXXXXXXXXXXXXXXXXXXXXXXXVWTYNAELLILLENERTLDLHDSNVXXXXXXXXXXXXNNAQEIGNGCFEFYHRCDDXXXXXXXXXXXXXXXXXXXXXXXXXXXXXXXXXXXXXXXXXXXXXXXXXXXXXXXXXXXXGFWMCSNGSLQSKXXX

SEQ ID NO: 419821 - protein, 566 aa, Influenza virus
  MOD_RES (1)..(17): Any amino acid
  MOD_RES (30)..(38): Any amino acid
  MOD_RES (52)..(307): Any amino acid
  MOD_RES (319)..(339): Any amino acid
  MOD_RES (352)..(352): Any amino acid
  MOD_RES (365)..(434): Any amino acid
  MOD_RES (460)..(471): Any amino acid
  MOD_RES (488)..(550): Any amino acid
  MOD_RES (565)..(566): Any amino acid
XXXXXXXXXXXXXXXXXDTLCICYHANNSXXXXXXXXXKNVAVTHSVNLLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNIHPITIGXXXXXXXXXXXXXXXXXXXXXSVQSRGLFGAIAXFIEGGWTGMIEGXXXXXXXXXXXXXXXXXXXXXXXXXXXXXXXXXXXXXXXXXXXXXXXXXXXXXXXXXXXXXXXXXXXXXXLWTYNAELLILLENERTLDFHDFNVXXXXXXXXXXXXNKVKEIGNGCFEFYHTXXXXXXXXXXXXXXXXXXXXXXXXXXXXXXXXXXXXXXXXXXXXXXXXXXXXXXXXXXXXXXXSFWMCSNGSLHGRIXX

SEQ ID NO: 419822 - protein, 566 aa, Influenza virus
  MOD_RES (1)..(19): Any amino acid
  MOD_RES (31)..(38): Any amino acid
  MOD_RES (50)..(307): Any amino acid
  MOD_RES (326)..(339): Any amino acid
  MOD_RES (355)..(434): Any amino acid
  MOD_RES (446)..(447): Any amino acid
  MOD_RES (459)..(471): Any amino acid
  MOD_RES (484)..(550): Any amino acid
  MOD_RES (564)..(566): Any amino acid
XXXXXXXXXXXXXXXXXXXLCIDYHAHNSTXXXXXXXXRNITVTHSVNLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFQNIHPATIGECPKYVKXXXXXXXXXXXXXXSIQSKGLFGAIAGFIXXXXXXXXXXXXXXXXXXXXXXXXXXXXXXXXXXXXXXXXXXXXXXXXXXXXXXXXXXXXXXXXXXXXXXXXXXXXXXXXIWTYNAELLILXXNERTLDYHDSHXXXXXXXXXXXXXDNAKEIGNGCFKXXXXXXXXXXXXXXXXXXXXXXXXXXXXXXXXXXXXXXXXXXXXXXXXXXXXXXXXXXXXXXXXXXXSFWMCPNGSLQCTXXX

SEQ ID NO: 419823 - protein, 566 aa, Influenza virus
  MOD_RES (1)..(22): Any amino acid
  MOD_RES (34)..(39): Any amino acid
  MOD_RES (51)..(314): Any amino acid
  MOD_RES (326)..(439): Any amino acid
  MOD_RES (455)..(472): Any amino acid
  MOD_RES (491)..(553): Any amino acid
  MOD_RES (565)..(566): Any amino acid
XXXXXXXXXXXXXXXXXXXXXXGYHANNSSDTVXXXXXXNVKVTHRENLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTIGECPKYVKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAEMLVLLENERTLDLXXXXXXXXXXXXXXXXXXNARELGNGCFEFYHKCNDXXXXXXXXXXXXXXXXXXXXXXXXXXXXXXXXXXXXXXXXXXXXXXXXXXXXXXXXXXXXXXXMCSNGSLQCRVXX

SEQ ID NO: 419824 - protein, 566 aa, Influenza virus
  MOD_RES (1)..(39): Any amino acid
  MOD_RES (51)..(448): Any amino acid
  MOD_RES (460)..(473): Any amino acid
  MOD_RES (491)..(553): Any amino acid
  MOD_RES (565)..(566): Any amino acid
XXXXXXXXXXXXXXXXXXXXXXXXXXXXXXXXXXXXXXXNVTVTHSVNLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXERTLDFHESNVXXXXXXXXXXXXXXAREIGNGCFEFYHKCDNXXXXXXXXXXXXXXXXXXXXXXXXXXXXXXXXXXXXXXXXXXXXXXXXXXXXXXXXXXXXXXXMCSNGSLQFRIXX

SEQ ID NO: 419825 - protein, 566 aa, Influenza virus
  MOD_RES (1)..(40): Any amino acid
  MOD_RES (52)..(474): Any amino acid
  MOD_RES (486)..(566): Any amino acid
XXXXXXXXXXXXXXXXXXXXXXXXXXXXXXXXXXXXXXXXLTVTHSVNLLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKETGNGCFEFYXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419826 - protein, 475 aa, Influenza virus
  MOD_RES (1)..(46): Any amino acid
  MOD_RES (58)..(94): Any amino acid
  MOD_RES (126)..(128): Any amino acid
  MOD_RES (144)..(154): Any amino acid
  MOD_RES (195)..(222): Any amino acid
  MOD_RES (235)..(236): Any amino acid
  MOD_RES (249)..(270): Any amino acid
  MOD_RES (287)..(287): Any amino acid
  MOD_RES (307)..(314): Any amino acid
  MOD_RES (329)..(345): Any amino acid
  MOD_RES (357)..(416): Any amino acid
  MOD_RES (433)..(436): Any amino acid
  MOD_RES (456)..(461): Any amino acid
XXXXXXXXXXXXXXXXXXXXXXXXXXXXXXXXXXXXXXXXXXXXXXKNNQVILCEPTXXXXXXXXXXXXXXXXXXXXXXXXXXXXXXXXXXXXXITGFAPFSKDNSIRLSAGGDIWVTREPYVSCXXXKCYQFALGQGTTLNNXXXXXXXXXXXPYRTLLMNELGVPFHLGTKQVCIAWSSSSCHDGKAWLHVCXXXXXXXXXXXXXXXXXXXXXXXXXXXXILRTQESECVCIXXTCTVVMTDGSASXXXXXXXXXXXXXXXXXXXXXXGSAQHVEECSCYPRYPXVRCVCRDNWKGSNRPIVDIXXXXXXXXSSYVCSGLVGDTPRXXXXXXXXXXXXXXXXXGGHGVKGWAFDXXXXXXXXXXXXXXXXXXXXXXXXXXXXXXXXXXXXXXXXXXXXXXXXXXXXXXXXXXXXSCINRCFYVELIRGRKXXXXVWWTSNSIVVFCGTSGTYGXXXXXXGRTSISCLYKLSQF

SEQ ID NO: 419827 - protein, 475 aa, Influenza virus
  MOD_RES (1)..(46): Any amino acid
  MOD_RES (58)..(94): Any amino acid
  MOD_RES (124)..(128): Any amino acid
  MOD_RES (144)..(154): Any amino acid
  MOD_RES (195)..(222): Any amino acid
  MOD_RES (235)..(236): Any amino acid
  MOD_RES (249)..(270): Any amino acid
  MOD_RES (287)..(287): Any amino acid
  MOD_RES (307)..(314): Any amino acid
  MOD_RES (329)..(345): Any amino acid
  MOD_RES (357)..(416): Any amino acid
  MOD_RES (433)..(436): Any amino acid
  MOD_RES (456)..(475): Any amino acid
XXXXXXXXXXXXXXXXXXXXXXXXXXXXXXXXXXXXXXXXXXXXXXKNNQVILCGPTXXXXXXXXXXXXXXXXXXXXXXXXXXXXXXXXXXXXXIKGFAPFSKDNSIRVSAGGDIWVTRKPYVXXXXXRCYQFALGQGTTLDNXXXXXXXXXXXPHRTLLMNELGVPFYLGTRQVCIAWSSSSCYDGKAWLHVCXXXXXXXXXXXXXXXXXXXXXXXXXXXXILRTQESECICIXXICTVVMTDGSATXXXXXXXXXXXXXXXXXXXXXXGSAQHIEECSCYPRYPXVRCICRDNWKGSNRPVVDIXXXXXXXXSSYMCSGLVGDTPRXXXXXXXXXXXXXXXXXGNHGVKGWAFDXXXXXXXXXXXXXXXXXXXXXXXXXXXXXXXXXXXXXXXXXXXXXXXXXXXXXXXXXXXXNCINRCFYVELIRGRRXXXXVLWTSNSIVVFCSTSGTYGXXXXXXXXXXXXXXXXXXXX

SEQ ID NO: 419828 - protein, 475 aa, Influenza virus
  MOD_RES (1)..(46): Any amino acid
  MOD_RES (58)..(94): Any amino acid
  MOD_RES (126)..(131): Any amino acid
  MOD_RES (144)..(154): Any amino acid
  MOD_RES (195)..(222): Any amino acid
  MOD_RES (235)..(236): Any amino acid
  MOD_RES (249)..(270): Any amino acid
  MOD_RES (287)..(287): Any amino acid
  MOD_RES (307)..(314): Any amino acid
  MOD_RES (329)..(345): Any amino acid
  MOD_RES (357)..(416): Any amino acid
  MOD_RES (433)..(436): Any amino acid
  MOD_RES (456)..(475): Any amino acid
XXXXXXXXXXXXXXXXXXXXXXXXXXXXXXXXXXXXXXXXXXXXXXKNNQVILCEQTXXXXXXXXXXXXXXXXXXXXXXXXXXXXXXXXXXXXXVTGFAPFSKDNSIRLSASGDVWVTREPYVSCXXXXXXQFALGQGTTLSNXXXXXXXXXXXSYRTLLMNELGIPFHLGTKQVCMAWSSSSCHDGRAWLHVCXXXXXXXXXXXXXXXXXXXXXXXXXXXXILRTHESECVCIXXTCTVIMTDGSASXXXXXXXXXXXXXXXXXXXXXXGGAQHVEECSCYPRFPXVRCVCRDNWRGSNRPIVDIXXXXXXXXSSYICSGLVGDTPRXXXXXXXXXXXXXXXXXGNPGVKGWAFDXXXXXXXXXXXXXXXXXXXXXXXXXXXXXXXXXXXXXXXXXXXXXXXXXXXXXXXXXXXXRCINRCFYVELIRGRNXXXXVGWTSNSIVVFCGASGTYGXXXXXXXXXXXXXXXXXXXX

SEQ ID NO: 419829 - protein, 475 aa, Influenza virus
  MOD_RES (1)..(94): Any amino acid
  MOD_RES (125)..(131): Any amino acid
  MOD_RES (144)..(154): Any amino acid
  MOD_RES (195)..(223): Any amino acid
  MOD_RES (235)..(236): Any amino acid
  MOD_RES (249)..(270): Any amino acid
  MOD_RES (287)..(287): Any amino acid
  MOD_RES (302)..(345): Any amino acid
  MOD_RES (357)..(416): Any amino acid
  MOD_RES (433)..(436): Any amino acid
  MOD_RES (454)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITGFAPFSEDNSIRLSAGGAIWVTREPYVSXXXXXXXQFALGQGTTLKNXXXXXXXXXXXPHRTLLMSELGVPFHLGTRQVCMAWSSSSCHDGKSWLHVCXXXXXXXXXXXXXXXXXXXXXXXXXXXXXLRTQESECVCVXXTCAVVMTDGSASXXXXXXXXXXXXXXXXXXXXXXGNAQHVEECSCYPRSPXVRCICRDNWRGSNRXXXXXXXXXXXXXXXXXXXXXXXXXXXXXXXXXXXXXXXXXXXXGDHGVKGWAFDXXXXXXXXXXXXXXXXXXXXXXXXXXXXXXXXXXXXXXXXXXXXXXXXXXXXXXXXXXXXSCVNRCFYVELIRGRPXXXXILWTSNSIVVFCGTPGTXXXXXXXXXXXXXXXXXXXXXX

SEQ ID NO: 419830 - protein, 475 aa, Influenza virus
  MOD_RES (1)..(94): Any amino acid
  MOD_RES (123)..(162): Any amino acid
  MOD_RES (174)..(182): Any amino acid
  MOD_RES (195)..(236): Any amino acid
  MOD_RES (248)..(273): Any amino acid
  MOD_RES (287)..(293): Any amino acid
  MOD_RES (307)..(345): Any amino acid
  MOD_RES (357)..(416): Any amino acid
  MOD_RES (428)..(436): Any amino acid
  MOD_RES (456)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAGFAPFSKDNSIRLSAGGAVWVTREPYXXXXXXXXXXXXXXXXXXXXXXXXXXXXXXXXXXXXXXXXELGIPFHLGTRXXXXXXXXXSCYDGKAWLHICXXXXXXXXXXXXXXXXXXXXXXXXXXXXXXXXXXXXXXXXXXICAVVMTDGSAXXXXXXXXXXXXXXXXXXXXXXXXXXQHIEEGSVYPRFLXXXXXXXDNWKGSNRPIIDIXXXXXXXXXXXXXXXXXXXXXXXXXXXXXXXXXXXXXXXGSHGVKGWAFDXXXXXXXXXXXXXXXXXXXXXXXXXXXXXXXXXXXXXXXXXXXXXXXXXXXXXXXXXXXXSCINRCFYVESXXXXXXXXXVWWTSTSIVVFCGTSGIYGXXXXXXXXXXXXXXXXXXXX

SEQ ID NO: 419831 - protein, 475 aa, Influenza virus
  MOD_RES (1)..(95): Any amino acid
  MOD_RES (126)..(237): Any amino acid
  MOD_RES (249)..(293): Any amino acid
  MOD_RES (307)..(421): Any amino acid
  MOD_RES (433)..(437): Any amino acid
  MOD_RES (454)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGFAPFSKDNSVRLSAGGDIWITREPYVSCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCTVVMTDGSVSXXXXXXXXXXXXXXXXXXXXXXXXXXXXXXXXXXXXXXXXXXXXXDNWKGSNRPVIDIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCFYVELIRGREXXXXXWWTSNSIVAFCGTSGTXXXXXXXXXXXXXXXXXXXXXX

SEQ ID NO: 419832 - protein, 475 aa, Influenza virus
  MOD_RES (1)..(107): Any amino acid
  MOD_RES (121)..(438): Any amino acid
  MOD_RES (453)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLSAGGDIWATREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWTSNSVVVFCGTSGXXXXXXXXXXXXXXXXXXXXXXX

SEQ ID NO: 419833 - protein, 475 aa, Influenza virus
  MOD_RES (1)..(113): Any amino acid
  MOD_RES (125)..(442): Any amino acid
  MOD_RES (456)..(475): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDIWVTREPYASXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIVEFCGTSGTYGXXXXXXXXXXXXXXXXXXXX

SEQ ID NO: 419834 - protein, 569 aa, Influenza virus
  MOD_RES (18)..(21): Any amino acid
  MOD_RES (37)..(38): Any amino acid
  MOD_RES (65)..(67): Any amino acid
  MOD_RES (94)..(94): Any amino acid
  MOD_RES (106)..(161): Any amino acid
  MOD_RES (173)..(183): Any amino acid
  MOD_RES (195)..(259): Any amino acid
  MOD_RES (289)..(294): Any amino acid
  MOD_RES (330)..(341): Any amino acid
  MOD_RES (392)..(418): Any amino acid
  MOD_RES (436)..(437): Any amino acid
  MOD_RES (499)..(501): Any amino acid
  MOD_RES (523)..(527): Any amino acid
MDNQTKTMTITFLILLFXXXXGDQICIGYHANNSTEXXDTILERNVTVTHAKDILEKTHNGKLCXXXGIPPLELGDCSIAGWLLGNPECDRLLXVPEWSYIVEKEXXXXXXXXXXXXXXXXXXXXXXXXXXXXXXXXXXXXXXXXXXXXXXXXXXXXXXXXPSFFRNMVWLTXXXXXXXXXXXSYNNTSGEQMLXXXXXXXXXXXXXXXXXXXXXXXXXXXXXXXXXXXXXXXXXXXXXXXXXXXXXXXXXXXXXXXXXINFESTGNLIAPEYGFKISKRGSSGIMKTXXXXXXCETKCQTPLGAINTTLPFHNIHPLTIGECPKYVKSXXXXXXXXXXXXPQIESRGLFGAIAGFIEGGWQGMVDGWYGYHHSNDQGSGYAADKESTQKAXXXXXXXXXXXXXXXXXXXXXXXXXXXNLERRLENLNKKMEDGFXXVWTYNAELLVLMENERTLDFHDSNVKNLYDKVRMQLRDNAKEIGNGCFEFYHKCDDECMNSXXXGTYDYPKYEEESKLNRNEIKGXXXXXMGVYQILAIYATVAGSLSLAIMIAGISFWMCSNGSLQCRICI

SEQ ID NO: 419835 - protein, 569 aa, Influenza virus
  MOD_RES (14)..(21): Any amino acid
  MOD_RES (37)..(38): Any amino acid
  MOD_RES (64)..(67): Any amino acid
  MOD_RES (94)..(94): Any amino acid
  MOD_RES (106)..(161): Any amino acid
  MOD_RES (173)..(183): Any amino acid
  MOD_RES (195)..(259): Any amino acid
  MOD_RES (289)..(294): Any amino acid
  MOD_RES (330)..(341): Any amino acid
  MOD_RES (392)..(418): Any amino acid
  MOD_RES (436)..(437): Any amino acid
  MOD_RES (463)..(464): Any amino acid
  MOD_RES (499)..(501): Any amino acid
  MOD_RES (523)..(527): Any amino acid
  MOD_RES (566)..(569): Any amino acid
MDKQTKTMTITFLXXXXXXXXGDQICIGYHSNNSTEXXDTILEQNVTVTHAKNILEKTHNGKLXXXXGIPPLELRDCSIAGWLLGNPKCDRLLXVPEWSYIMEKEXXXXXXXXXXXXXXXXXXXXXXXXXXXXXXXXXXXXXXXXXXXXXXXXXXXXXXXXSSFFRNMVWLTXXXXXXXXXXXSYNNTNGEQILXXXXXXXXXXXXXXXXXXXXXXXXXXXXXXXXXXXXXXXXXXXXXXXXXXXXXXXXXXXXXXXXXINFESTGNLVAPEYGFKISKRGGSGIMKTXXXXXXCETRCQTPLGAINTTLPFHNVHPLTIGECPKYIKSXXXXXXXXXXXXPQIEPRGLFGAIAGFIEGGWQGMIDGWYGYHHSNDQGAGYAADKESTQRAXXXXXXXXXXXXXXXXXXXXXXXXXXXNLEKRLENLNKKVEDGFXXVWTYNVELLVLMENERTLGFHDSNVXXLYNKVRMQLRDNVKELGNGCFEFYHKCNDECMNSXXXGTYDYSKYEEESKLNRTEIKGXXXXXMGIYQILAIYATVAGSLSLAIMMAGISLWMCSNGSLQCXXXX

SEQ ID NO: 419836 - protein, 569 aa, Influenza virus
  MOD_RES (18)..(21): Any amino acid
  MOD_RES (37)..(38): Any amino acid
  MOD_RES (65)..(67): Any amino acid
  MOD_RES (94)..(94): Any amino acid
  MOD_RES (106)..(161): Any amino acid
  MOD_RES (173)..(183): Any amino acid
  MOD_RES (195)..(259): Any amino acid
  MOD_RES (289)..(294): Any amino acid
  MOD_RES (330)..(341): Any amino acid
  MOD_RES (355)..(375): Any amino acid
  MOD_RES (392)..(418): Any amino acid
  MOD_RES (436)..(437): Any amino acid
  MOD_RES (499)..(501): Any amino acid
  MOD_RES (523)..(527): Any amino acid
  MOD_RES (539)..(539): Any amino acid
  MOD_RES (566)..(569): Any amino acid
MDNKTKKMTITFLILLFXXXXGDQICVGYHSNNSTEXXDTILEKNVTVTHAQDILEKVHNGKLCXXXGIPPLVLGDCSIAGWLLGNPECDILLXVPEWSYIVEREXXXXXXXXXXXXXXXXXXXXXXXXXXXXXXXXXXXXXXXXXXXXXXXXXXXXXXXXPSFFRNMIWLTXXXXXXXXXXXSYNNTSGEQILXXXXXXXXXXXXXXXXXXXXXXXXXXXXXXXXXXXXXXXXXXXXXXXXXXXXXXXXXXXXXXXXXISFESTGNLIAPEYGFRISKRGSSGIVKTXXXXXXCETQCQTPLGAINTTLPFHNIHPLAIGECPKYVKSXXXXXXXXXXXXPQMESRGLFGAIAXXXXXXXXXXXXXXXXXXXXXDQGSGYAADKASTQKAXXXXXXXXXXXXXXXXXXXXXXXXXXXSLERRLENLNKRMEDGFXXVWTYNAEVLVLMENERTLDYHDSNVKNLYEKVRMQLRDNAKELGNGCFEFYHKCDNECMDSXXXGTYNYPKYEEESKLKRNEIKGXXXXXMGVYQILVIYAXVAGSLSLAIMVAGISIWMCSNGSLQCXXXX

SEQ ID NO: 419837 - protein, 569 aa, Influenza virus
  MOD_RES (15)..(21): Any amino acid
  MOD_RES (35)..(41): Any amino acid
  MOD_RES (65)..(67): Any amino acid
  MOD_RES (80)..(80): Any amino acid
  MOD_RES (94)..(94): Any amino acid
  MOD_RES (106)..(183): Any amino acid
  MOD_RES (195)..(259): Any amino acid
  MOD_RES (289)..(294): Any amino acid
  MOD_RES (312)..(314): Any amino acid
  MOD_RES (326)..(341): Any amino acid
  MOD_RES (357)..(418): Any amino acid
  MOD_RES (436)..(437): Any amino acid
  MOD_RES (499)..(501): Any amino acid
  MOD_RES (523)..(528): Any amino acid
  MOD_RES (540)..(543): Any amino acid
  MOD_RES (565)..(569): Any amino acid
MDNQTKKMTITFLIXXXXXXXGDRICIGYHANNSXXXXXXXLERNVTVTHAQNILERTHNGKLCXXXGVPPLELGDCSIXGWLLGNPECDLLLXVPEWSYIIEKEXXXXXXXXXXXXXXXXXXXXXXXXXXXXXXXXXXXXXXXXXXXXXXXXXXXXXXXXXXXXXXXXXXXXXXXXXXXXXXSYNNTSGKQMLXXXXXXXXXXXXXXXXXXXXXXXXXXXXXXXXXXXXXXXXXXXXXXXXXXXXXXXXXXXXXXXXXISFESTGNLVAPEYGFKISKRGNSGIMKTXXXXXXCETKCQSPLGAINTTLPXXXIHPLTMGECPKXXXXXXXXXXXXXXXXPQIEARGLFGAIAGFXXXXXXXXXXXXXXXXXXXXXXXXXXXXXXXXXXXXXXXXXXXXXXXXXXXXXXXXXXXXXXNLEKRLGNLNKKMEDGFXXMWTYNAELLVLMENEMTLDFHDSNVRNLYDKVRMQLKDNAKEVGNGCFEFYHKCDDECMDSXXXGTYYYPKYEEESRLNRNEIKGXXXXXXGVYQVLAIYATXXXXLSLAIMIAGIFLWMCSNGSLQXXXXX

SEQ ID NO: 419838 - protein, 569 aa, Influenza virus
  MOD_RES (1)..(21): Any amino acid
  MOD_RES (35)..(44): Any amino acid
  MOD_RES (64)..(67): Any amino acid
  MOD_RES (80)..(81): Any amino acid
  MOD_RES (94)..(94): Any amino acid
  MOD_RES (106)..(183): Any amino acid
  MOD_RES (195)..(259): Any amino acid
  MOD_RES (289)..(294): Any amino acid
  MOD_RES (317)..(317): Any amino acid
  MOD_RES (330)..(341): Any amino acid
  MOD_RES (355)..(419): Any amino acid
  MOD_RES (431)..(447): Any amino acid
  MOD_RES (499)..(501): Any amino acid
  MOD_RES (523)..(529): Any amino acid
  MOD_RES (541)..(543): Any amino acid
  MOD_RES (565)..(569): Any amino acid
XXXXXXXXXXXXXXXXXXXXXGDQICVGYHANNSXXXXXXXXXXNITVTHAKDILERTHNGKLXXXXGIPPLELGNCSIXXWLLGNPECDLFLXVPEWSYIMEKKXXXXXXXXXXXXXXXXXXXXXXXXXXXXXXXXXXXXXXXXXXXXXXXXXXXXXXXXXXXXXXXXXXXXXXXXXXXXXXSYNNTSGEQVLXXXXXXXXXXXXXXXXXXXXXXXXXXXXXXXXXXXXXXXXXXXXXXXXXXXXXXXXXXXXXXXXXINFESNGNLIAPEYGFKISKRGSSGVMKTXXXXXXCDTKCQTPLGALNTTLPFHNIHXLTIGECPKYVRSXXXXXXXXXXXXPQTESRGLFGAIAXXXXXXXXXXXXXXXXXXXXXXXXXXXXXXXXXXXXXXXXXXXXXXXXXXXXXXXXXXXXXXXXXLERRLENLSKRXXXXXXXXXXXXXXXXXLMENERTLEFHDSNVKNLYDRVRMQLRDNAKETGNGCFEFYHKCDDECMSSXXXGTYDYIKYEEESKLNRSEIKGXXXXXXXAYQILAIYATVXXXLSLAIMMAGIFFWMCSNGSLQXXXXX

SEQ ID NO: 419839 - protein, 569 aa, Influenza virus
  MOD_RES (1)..(25): Any amino acid
  MOD_RES (37)..(46): Any amino acid
  MOD_RES (58)..(69): Any amino acid
  MOD_RES (81)..(309): Any amino acid
  MOD_RES (321)..(422): Any amino acid
  MOD_RES (434)..(448): Any amino acid
  MOD_RES (467)..(467): Any amino acid
  MOD_RES (480)..(502): Any amino acid
  MOD_RES (514)..(569): Any amino acid
XXXXXXXXXXXXXXXXXXXXXXXXXCIGYHSNNSTKXXXXXXXXXXTVTHAQDILERXXXXXXXXXXXXSPLELGDCSIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMPFHNVHPLTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLENLDKKMEDXXXXXXXXXXXXXXXMENERILDFHDSNVKSLYXKVKMQLRDNAKEXXXXXXXXXXXXXXXXXXXXXXXTYNYSKYEEESXXXXXXXXXXXXXXXXXXXXXXXXXXXXXXXXXXXXXXXXXXXXXXXXXXXXXXXX

SEQ ID NO: 419840 - protein, 569 aa, Influenza virus
  MOD_RES (1)..(52): Any amino acid
  MOD_RES (64)..(424): Any amino acid
  MOD_RES (436)..(454): Any amino acid
  MOD_RES (466)..(506): Any amino acid
  MOD_RES (518)..(569): Any amino acid
XXXXXXXXXXXXXXXXXXXXXXXXXXXXXXXXXXXXXXXXXXXXXXXXXXXXDILEKAHNGKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXENLNKKMEDGLXXXXXXXXXXXXXXXXXXXLDFHDSSVKNLXXXXXXXXXXXXXXXXXXXXXXXXXXXXXXXXXXXXXXXXXPKYEKESKLNRXXXXXXXXXXXXXXXXXXXXXXXXXXXXXXXXXXXXXXXXXXXXXXXXXXXX

SEQ ID NO: 419841 - protein, 569 aa, Influenza virus
  MOD_RES (1)..(53): Any amino acid
  MOD_RES (65)..(569): Any amino acid
XXXXXXXXXXXXXXXXXXXXXXXXXXXXXXXXXXXXXXXXXXXXXXXXXXXXXILEKMHNGKLCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419842 - protein, 562 aa, Influenza virus
  MOD_RES (1)..(12): Any amino acid
  MOD_RES (101)..(103): Any amino acid
  MOD_RES (118)..(124): Any amino acid
  MOD_RES (136)..(154): Any amino acid
  MOD_RES (166)..(173): Any amino acid
  MOD_RES (192)..(249): Any amino acid
  MOD_RES (283)..(286): Any amino acid
  MOD_RES (386)..(407): Any amino acid
  MOD_RES (490)..(492): Any amino acid
XXXXXXXXXXXXVRGDQICIGYHANNSTEKVDTILERNVTVTHAKDILEKTHNGKLCKLNGIPPLELGDCSIAGWLLGNPECDRLLSVPEWSYIMEKENPXXXLCYPGSFNDYEELKXXXXXXXHFEKVKILPKDXXXXXXXXXXXXXXXXXXXPSFFRNMVWLTXXXXXXXXAKGSYNNTSGEQMLIIWGXXXXXXXXXXXXXXXXXXXXXXXXXXXXXXXXXXXXXXXXXXXXXXXXXXXXXXXXXXWDTINFESTGNLIAPEYGFKISKRGSSGIMKTEXXXXNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFXXXXXXXXXXXXXXXXXXXXXXKEFSNLERRLENLNKKMEDGFLDVWTYNAELLVLMENERTLDFHDSNVKNLYDKVRMQLRDNVKELGNGCFEFYHKCDDECMXXXKNGTYDYPKYEEESKLNRNEIKGVKLSSMGVYQILAIYATVAGSLSLAIMMAGISFWMCSNGSLQCRICI

SEQ ID NO: 419843 - protein, 562 aa, Influenza virus
  MOD_RES (1)..(12): Any amino acid
  MOD_RES (61)..(62): Any amino acid
  MOD_RES (101)..(103): Any amino acid
  MOD_RES (118)..(124): Any amino acid
  MOD_RES (136)..(154): Any amino acid
  MOD_RES (166)..(173): Any amino acid
  MOD_RES (192)..(249): Any amino acid
  MOD_RES (283)..(286): Any amino acid
  MOD_RES (386)..(407): Any amino acid
  MOD_RES (490)..(492): Any amino acid
  MOD_RES (531)..(532): Any amino acid
  MOD_RES (562)..(562): Any amino acid
XXXXXXXXXXXXVKGDQICIGYHANNSTETVDTILERNVTVTHAQDILEKTHNGRLCKLNXXPPLELGDCSITGWLLGNPECDRLLRVPEWSYIVERENPXXXLCYPGSFNNYEELKXXXXXXXHFEKVKILPRDXXXXXXXXXXXXXXXXXXXSSFFRNMVWLTXXXXXXXXAKRSYNNTSGEQMLVIWGXXXXXXXXXXXXXXXXXXXXXXXXXXXXXXXXXXXXXXXXXXXXXXXXXXXXXXXXXXWDVINFESTGNLIAPEYGFRISKRGSSGIMKTGXXXXNCETKCQSPLGAINTTLPFHNIHPLTIGECPKYVRSEKLVLATGPRNVPQIEPRGLFGAIAGFIEGGWQGMIDGWYGYHHSNDQGAGYAADKESTQRAFXXXXXXXXXXXXXXXXXXXXXXKEFSNLEKRLENLNKKVEDGFLDVWTYNTELLVLMENEMTLDFHDSNVKSLYDKVRMQLRDNAKEIGNGCFEFYHKCNDECMXXXRNGTYDYPKYEKESKLNRNEIKGVKLSNMGVYQILAIYXXVAGSLSLAIMIAGISLWMCSNGSLQCRVCX

SEQ ID NO: 419844 - protein, 562 aa, Influenza virus
  MOD_RES (1)..(12): Any amino acid
  MOD_RES (71)..(76): Any amino acid
  MOD_RES (101)..(103): Any amino acid
  MOD_RES (118)..(124): Any amino acid
  MOD_RES (136)..(154): Any amino acid
  MOD_RES (166)..(173): Any amino acid
  MOD_RES (189)..(249): Any amino acid
  MOD_RES (278)..(286): Any amino acid
  MOD_RES (348)..(368): Any amino acid
  MOD_RES (386)..(407): Any amino acid
  MOD_RES (490)..(492): Any amino acid
  MOD_RES (548)..(549): Any amino acid
XXXXXXXXXXXXVRGDQICVGYHSNNSTEKIDTILERNVTVTHAKNILEKTHNGKLCRLSGIPPLELGDCXXXXXXLGNPECDRLLTVPEWSYIVEKENPXXXLCYPGSLNDYEELKXXXXXXXHFEKVRILPKDXXXXXXXXXXXXXXXXXXXPSFFRNMIWLTXXXXXXXXARGSYNNTSGEQVLVXXXXXXXXXXXXXXXXXXXXXXXXXXXXXXXXXXXXXXXXXXXXXXXXXXXXXXXXXXXXXWDVISFESTGNLIAPEYGFKISRRGNSGXXXXXXXXXDCETKCQTPLGALNTTLPFHNIHPLTMGECPKYVKSDRLVLATGLRNVPQMESRGLFGAIAXXXXXXXXXXXXXXXXXXXXXDQGSGYAADKASTQKAIXXXXXXXXXXXXXXXXXXXXXXKEFNNLERRLENLSKRMEDGFIDVWTYNAELLVLMENEMTLDFHDSNVRNLYDKVRMQLKDNAKEIGNGCFEFYHKCDNECMXXXKNGTYYYPKYEEESKLKRNEIKGVKLSNMGIYQILAIYATVAGSLSLAIMVAGISXXMCSNGSLQFRICI

SEQ ID NO: 419845 - protein, 562 aa, Influenza virus
  MOD_RES (1)..(12): Any amino acid
  MOD_RES (71)..(76): Any amino acid
  MOD_RES (101)..(103): Any amino acid
  MOD_RES (118)..(124): Any amino acid
  MOD_RES (136)..(173): Any amino acid
  MOD_RES (192)..(249): Any amino acid
  MOD_RES (283)..(286): Any amino acid
  MOD_RES (300)..(302): Any amino acid
  MOD_RES (349)..(368): Any amino acid
  MOD_RES (386)..(407): Any amino acid
  MOD_RES (478)..(492): Any amino acid
  MOD_RES (531)..(536): Any amino acid
  MOD_RES (558)..(562): Any amino acid
XXXXXXXXXXXXVKGDRICIGYHANNSTEMVDTILERNVTVTHAQNILEKTHNGKLCRLRGIPPLELGDCXXXXXXLGNPECDRLLNVPEWSYIIEKENPXXXLCYPGNFNDYEELKXXXXXXXHFEKVKILARNXXXXXXXXXXXXXXXXXXXXXXXXXXXXXXXXXXXXXXAKGSYNNTNGEQILIIWGXXXXXXXXXXXXXXXXXXXXXXXXXXXXXXXXXXXXXXXXXXXXXXXXXXXXXXXXXXLDTINFESTGNLVAPEYGFKISKRGGSGIMKTEXXXXNCDTKCQTPLGAIXXXLPFHNVHPLAIGECPKYVKSDRLVLAIGLRNVPQIEARGLFGAIAGXXXXXXXXXXXXXXXXXXXXEQGSGYAADKESTQKAIXXXXXXXXXXXXXXXXXXXXXXKEFNNLEKRLENLDKKMEDGLLDVWTYNAELLVLMENERILDFHDSNVKNLYNKVRMQLRDNVKELGDGCXXXXXXXXXXXXXXXKNGTYDYSKYEEESKLNKNEIKGVKLSSMGIYQILAIYXXXXXXLSLAIMIAGIFLWMCSNGSLQXXXXX

SEQ ID NO: 419846 - protein, 562 aa, Influenza virus
  MOD_RES (1)..(13): Any amino acid
  MOD_RES (62)..(63): Any amino acid
  MOD_RES (99)..(124): Any amino acid
  MOD_RES (136)..(173): Any amino acid
  MOD_RES (186)..(249): Any amino acid
  MOD_RES (265)..(267): Any amino acid
  MOD_RES (283)..(286): Any amino acid
  MOD_RES (301)..(307): Any amino acid
  MOD_RES (347)..(374): Any amino acid
  MOD_RES (386)..(407): Any amino acid
  MOD_RES (471)..(492): Any amino acid
  MOD_RES (536)..(536): Any amino acid
  MOD_RES (558)..(562): Any amino acid
XXXXXXXXXXXXXRGDQICIGYHSNNSTEKVDTNLERNVTVTHAKDILEKAHNGKLCRLSGXXPLELGNCSIAGWLLGNPECDRLLIVPEWSYIMEREXXXXXXXXXXXXXXXXXXXXXXXXXXHFEKIKILPRDXXXXXXXXXXXXXXXXXXXXXXXXXXXXXXXXXXXXXXAQGSYNNTSGEQXXXXXXXXXXXXXXXXXXXXXXXXXXXXXXXXXXXXXXXXXXXXXXXXXXXXXXXXXXXXXXXXWDTISFESTGNLVAPXXXFKISKRGSSGVMKTEXXXXNCEIKCQTPLGAINXXXXXXXVHPLTIGECPRYVKSEKLVLATGLRNAHKMESRGLFGAIXXXXXXXXXXXXXXXXXXXXXXXXXXXXAADKESTQKAVXXXXXXXXXXXXXXXXXXXXXXKEFGNLERRLENLNKRMEDGFLGVWTYNAELLVLMENERTLGFHDSNVKNLYEKVRMQLRDNVXXXXXXXXXXXXXXXXXXXXXXRNGTYNYPKYEEESRLNRNEIKGVKLSNMGVYQVLAIYATVAGXLSLAIMMAGIFFWMCSNGSLQXXXXX

SEQ ID NO: 419847 - protein, 562 aa, Influenza virus
  MOD_RES (1)..(30): Any amino acid
  MOD_RES (59)..(88): Any amino acid
  MOD_RES (101)..(175): Any amino acid
  MOD_RES (192)..(262): Any amino acid
  MOD_RES (274)..(287): Any amino acid
  MOD_RES (300)..(313): Any amino acid
  MOD_RES (345)..(411): Any amino acid
  MOD_RES (440)..(445): Any amino acid
  MOD_RES (457)..(458): Any amino acid
  MOD_RES (481)..(493): Any amino acid
  MOD_RES (537)..(562): Any amino acid
XXXXXXXXXXXXXXXXXXXXXXXXXXXXXXADTILERNVTVTHAQDILERTHNGKLCKXXXXXXXXXXXXXXXXXXXXXXXXXXXXXXPEWSYIVERETPXXXXXXXXXXXXXXXXXXXXXXXXXXXXXXXXXXXXXXXXXXXXXXXXXXXXXXXXXXXXXXXXXXXXXXXXXXXGSYNNTSGKQMLIIWGXXXXXXXXXXXXXXXXXXXXXXXXXXXXXXXXXXXXXXXXXXXXXXXXXXXXXXXXXXXXXXXXXXXXXXXVPEYGFKISKRXXXXXXXXXXXXXXCETQCQTPLGAIXXXXXXXXXXXXXXGECPKYVKSERLVLATGLRNIPQIESRGLFGXXXXXXXXXXXXXXXXXXXXXXXXXXXXXXXXXXXXXXXXXXXXXXXXXXXXXXXXXXXXXXXXXXXNLEKRLGNLNKKMEDGFRDVWTYNAELLXXXXXXRTLDFHDSNVRXXYDRVRMQLRDNAKELGNGCFEFXXXXXXXXXXXXXTGTYDYPKYEEESRLNRNEIKGIKLSNMGVYQILVIYATVAGSXXXXXXXXXXXXXXXXXXXXXXXXXX

SEQ ID NO: 419848 - protein, 562 aa, Influenza virus
  MOD_RES (1)..(315): Any amino acid
  MOD_RES (333)..(445): Any amino acid
  MOD_RES (459)..(499): Any amino acid
  MOD_RES (528)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCPKYVKSKRLVLATGLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTLDFHDSSVKNLXXXXXXXXXXXXXXXXXXXXXXXXXXXXXXXXXXXXXXXXXPKYEEESKLNKNEIKGVELSSMGVYQILXXXXXXXXXXXXXXXXXXXXXXXXXXXXXXXXXXX

SEQ ID NO: 419849 - protein, 562 aa, Influenza virus
  MOD_RES (1)..(506): Any amino acid
  MOD_RES (521)..(562): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLKRNEIKGVELSSXXXXXXXXXXXXXXXXXXXXXXXXXXXXXXXXXXXXXXXXXX

SEQ ID NO: 419850 - protein, 469 aa, Influenza virus
  MOD_RES (16)..(24): Any amino acid
  MOD_RES (43)..(86): Any amino acid
  MOD_RES (126)..(126): Any amino acid
  MOD_RES (208)..(212): Any amino acid
  MOD_RES (262)..(262): Any amino acid
  MOD_RES (303)..(303): Any amino acid
  MOD_RES (358)..(367): Any amino acid
  MOD_RES (386)..(399): Any amino acid
MNPNQKIITIGSVSLXXXXXXXXXQIAILATTVTLHFKQHECXXXXXXXXXXXXXXXXXXXXXXXXXXXXXXXXXXXXXXXXXXXXWSKPQCQITGFAPFSKDNSIRLSAGGDIWVTREPYVSCDXGKCYQFALGQGTTLDNKHSNGTIHDRIPHRTLLMNELGVPFHLGTKQVCVAWSSSSCHDGKAWLHVCVTGDDRNATASFIYXXXXXDSIGSWSQNILRTQESECVCINGTCTVVMTDGSASGRADTRILFIKEGKXVHISPLSGSAQHIEECSCYPRYPDVRCICRDNWKGSNRPVXDINMEDYSIDSSYVCSGLVGDTPRNDDSSSNSNCRDPNNERGNPGVKGWAFDNGXXXXXXXXXXKDLRSGYETFKVIGGWSTXXXXXXXXXXXXXXNNNWSGYSGIFSVEGKSCINRCFYVELIRGRPQETRVWWTSNSIVVFCGTSGTYGTGSWPDGANINFMPI

SEQ ID NO: 419851 - protein, 469 aa, Influenza virus
  MOD_RES (16)..(24): Any amino acid
  MOD_RES (43)..(86): Any amino acid
  MOD_RES (126)..(126): Any amino acid
  MOD_RES (208)..(212): Any amino acid
  MOD_RES (262)..(262): Any amino acid
  MOD_RES (303)..(303): Any amino acid
  MOD_RES (358)..(367): Any amino acid
  MOD_RES (386)..(399): Any amino acid
  MOD_RES (451)..(452): Any amino acid
MNPNQKTITIGSVSLXXXXXXXXXQIAILVTTVTLHFKQHDCXXXXXXXXXXXXXXXXXXXXXXXXXXXXXXXXXXXXXXXXXXXXWSKPQCKITGFAPFSKDNSIRLSASGDIWVTREPYVSCSXSKCYQFALGQGATLDNKHSNDTIHDRTPHRTLLMNELGVSFHLGTKQVCIAWSSSSCHDGRAWLHVCVTGDDKNATASFIYXXXXXDSIVSWSQNILRTQESECICINGSCTVVMTDGSASGKADTRILFIEEGKXIHISPLSGSAQHVEECSCYPRYPGVRCICRDNWRGSNRPVXDINMADYSIDSSYICSGLVGDTPRNGDSSSNSNCRNPNNERGNQGVKGWAFDNGXXXXXXXXXXKDSRSGYETFKVIGGWTTXXXXXXXXXXXXXXSDNRSGYSGIFSVENKGCINRCFYVELIRGRKQEARVWWTSNSIVVFVAPSXXYGTGSWPDGADINFMPI

SEQ ID NO: 419852 - protein, 469 aa, Influenza virus
  MOD_RES (16)..(24): Any amino acid
  MOD_RES (43)..(86): Any amino acid
  MOD_RES (122)..(126): Any amino acid
  MOD_RES (160)..(161): Any amino acid
  MOD_RES (208)..(212): Any amino acid
  MOD_RES (262)..(262): Any amino acid
  MOD_RES (303)..(303): Any amino acid
  MOD_RES (355)..(367): Any amino acid
  MOD_RES (386)..(399): Any amino acid
MNPNQKIITIDSVSLXXXXXXXXXQIAILAATVTLHFKQHKCXXXXXXXXXXXXXXXXXXXXXXXXXXXXXXXXXXXXXXXXXXXXWSKPQCHITGFAPFSKDNSIRLSADGDIWVTREPYXXXXXVKCYQFALGQGTTLENKHSNGTKHDRIPHRTLLXXELGVPFHLGTRQVCIAWSSSSCHDGKAWLHICVTGDDENATASFIYXXXXXDSVGSWSQNILRTHESECVCINGTCAVVMTDGSASGRADTKILFIEEGKXVHIGPLSGSAQHIEECSCYPQYPDVRCVCRDNWKGSNRPIXDISMEDYSIDSNYVCSGLVGDTPRSDDSSSSSNCRDPNNEKGNQGVKGWAFXXXXXXXXXXXXXKDSRSGYETFRVIGGWATXXXXXXXXXXXXXXSNNWSGYSGIFSVEHKRCINRCFYVELIRGRQQETRVWWTSNSIAVFCGTSGTYGKGSWPDGANINLMPI

SEQ ID NO: 419853 - protein, 469 aa, Influenza virus
  MOD_RES (1)..(1): Any amino acid
  MOD_RES (16)..(24): Any amino acid
  MOD_RES (43)..(86): Any amino acid
  MOD_RES (126)..(126): Any amino acid
  MOD_RES (164)..(166): Any amino acid
  MOD_RES (183)..(183): Any amino acid
  MOD_RES (205)..(212): Any amino acid
  MOD_RES (245)..(246): Any amino acid
  MOD_RES (262)..(262): Any amino acid
  MOD_RES (301)..(303): Any amino acid
  MOD_RES (356)..(367): Any amino acid
  MOD_RES (379)..(399): Any amino acid
  MOD_RES (412)..(414): Any amino acid
  MOD_RES (434)..(436): Any amino acid
  MOD_RES (450)..(454): Any amino acid
XNPNQKIITMGSVSLXXXXXXXXXQIAILATTITLHFKQNECXXXXXXXXXXXXXXXXXXXXXXXXXXXXXXXXXXXXXXXXXXXXWSKPQCQIAGFAPFSKDNSIRLSAGGDIWITREPYVSCDXNKCYQFALGQGTTLNNKHSNGTIHDRSPHRTLLMNELXXXFHLGTRQVCVAWSSSSXHDGKAWLHVCITGDDKNATASXXXXXXXXDSIGSWSHNILRTQESECVCISGTCAVVMTDGXXSGKADTRILFVKEGKXVHISPLAGSAQHVEECSCYPRYPNVRCVCRDNWRGSNRXXXDINIAEYSIDSSYVCSGLVGDTPRNNDGSSNSNCKDPNNERGTQGVKGWAFDXXXXXXXXXXXXRDSRSGYETFKXXXXXXXXXXXXXXXXXXXXXSNNRSGYSGIFSXXXKNCINRCFYVELIRGRSQEXXXWWTSSSIVVFCGTXXXXXTGSWPDGANIDFMPV

SEQ ID NO: 419854 - protein, 469 aa, Influenza virus
  MOD_RES (1)..(3): Any amino acid
  MOD_RES (16)..(24): Any amino acid
  MOD_RES (43)..(87): Any amino acid
  MOD_RES (101)..(102): Any amino acid
  MOD_RES (120)..(126): Any amino acid
  MOD_RES (160)..(166): Any amino acid
  MOD_RES (207)..(213): Any amino acid
  MOD_RES (225)..(225): Any amino acid
  MOD_RES (242)..(249): Any amino acid
  MOD_RES (262)..(262): Any amino acid
  MOD_RES (300)..(303): Any amino acid
  MOD_RES (356)..(367): Any amino acid
  MOD_RES (380)..(399): Any amino acid
  MOD_RES (411)..(414): Any amino acid
  MOD_RES (433)..(454): Any amino acid
XXXNQKIITIGSASLXXXXXXXXXHIAILATTVTLHFKQNECXXXXXXXXXXXXXXXXXXXXXXXXXXXXXXXXXXXXXXXXXXXXXSKTQCQITGFAPFXXDNPIRLSGGGDIWVTREXXXXXXXDKCYQFALGQGTTLDNKHSNDTVHDRIPHRTLLXXXXXXXFHLGTKQVCAAWSSSSCHDGKAWLHVCVTGYEKNATASFIXXXXXXXSISSWSQNILRXQESECVCINGSCTVVMXXXXXXXXADTRILFIREGKXVHVSPLSGSAQHIEECSCYSRYPNVRCTCRDNWKGSNXXXXDISMEDYSIGSGYVCSGLVGDTPRNDDRSSSSNCRNPNNEKGNHGVKGWAFDXXXXXXXXXXXXKESRSGYETFKVXXXXXXXXXXXXXXXXXXXXKNNWSGYSGIFXXXXKSCVNRCFYVELIRGMPQXXXXXXXXXXXXXXXXXXXXXXTGSWPDGANTNFMPI

SEQ ID NO: 419855 - protein, 469 aa, Influenza virus
  MOD_RES (1)..(3): Any amino acid
  MOD_RES (15)..(106): Any amino acid
  MOD_RES (126)..(128): Any amino acid
  MOD_RES (140)..(192): Any amino acid
  MOD_RES (208)..(225): Any amino acid
  MOD_RES (247)..(283): Any amino acid
  MOD_RES (296)..(308): Any amino acid
  MOD_RES (334)..(339): Any amino acid
  MOD_RES (358)..(369): Any amino acid
  MOD_RES (382)..(422): Any amino acid
  MOD_RES (434)..(456): Any amino acid
  MOD_RES (468)..(469): Any amino acid
XXXNQKIITIGFVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLSAGGDIWVMREPYVSCNXXXCHQFALGQGTTXXXXXXXXXXXXXXXXXXXXXXXXXXXXXXXXXXXXXXXXXXXXXXXXXXXXXCITGDDRNATASLIYXXXXXXXXXXXXXXXXXXQESECVCINGICTVVMTDGSAXXXXXXXXXXXXXXXXXXXXXXXXXXXXXXXXXXXXXYPDVRCTCRDNWXXXXXXXXXXXXXDYSIDSGYVCSGLVGDTPRNDDRFSXXXXXXPNNERGYPGVKGWAFDSGXXXXXXXXXXXXSRSGYETFRVTGXXXXXXXXXXXXXXXXXXXXXXXXXXXXXXXXXXXXXXXXXYVELIRGRRQEXXXXXXXXXXXXXXXXXXXXXXXSWPDGANISFMXX

SEQ ID NO: 419856 - protein, 469 aa, Influenza virus
  MOD_RES (1)..(195): Any amino acid
  MOD_RES (208)..(234): Any amino acid
  MOD_RES (246)..(289): Any amino acid
  MOD_RES (301)..(340): Any amino acid
  MOD_RES (355)..(371): Any amino acid
  MOD_RES (383)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGDDRNATASFVYXXXXXXXXXXXXXXXXXXXXXXXXXXXGTCTVVMTDGNXXXXXXXXXXXXXXXXXXXXXXXXXXXXXXXXXXXXXXXXXXXXICKDNWKGSNRXXXXXXXXXXXXXXXXXXXXXXXXXXXXXXXXXXXXXXXXNNERGNHGVKGWAFXXXXXXXXXXXXXXXXXLGYETFKVIGGXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419857 - protein, 469 aa, Influenza virus
  MOD_RES (1)..(346): Any amino acid
  MOD_RES (358)..(373): Any amino acid
  MOD_RES (386)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPGVKGWAFDDGXXXXXXXXXXXXXXXXYETFRVIGGWTTXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419858 - protein, 469 aa, Influenza virus
  MOD_RES (1)..(346): Any amino acid
  MOD_RES (358)..(373): Any amino acid
  MOD_RES (386)..(469): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPGVKGWAFDYGXXXXXXXXXXXXXXXXYETFRVIGGWVTXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419859 - protein, 580 aa, Influenza virus
  MOD_RES (16)..(29): Any amino acid
  MOD_RES (41)..(57): Any amino acid
  MOD_RES (72)..(86): Any amino acid
  MOD_RES (102)..(133): Any amino acid
  MOD_RES (146)..(200): Any amino acid
  MOD_RES (213)..(273): Any amino acid
  MOD_RES (287)..(291): Any amino acid
  MOD_RES (303)..(307): Any amino acid
  MOD_RES (332)..(340): Any amino acid
  MOD_RES (355)..(356): Any amino acid
  MOD_RES (407)..(414): Any amino acid
  MOD_RES (475)..(480): Any amino acid
  MOD_RES (506)..(539): Any amino acid
  MOD_RES (557)..(562): Any amino acid
MLSLIMRTVIALSYIXXXXXXXXXXXXXXNNNNNTATLCLXXXXXXXXXXXXXXXXXDQIEVTNATELVQSXXXXXXXXXXXXXXXWEKNCTLIDALLGDPXXXXXXXXXXXXXXXXXXXXXXXXXXXXXXXXSLRSLVASSGTLXXXXXXXXXXXXXXXXXXXXXXXXXXXXXXXXXXXXXXXXXXXXXXXXXXXXXXXFDKLYIWGVHHPXXXXXXXXXXXXXXXXXXXXXXXXXXXXXXXXXXXXXXXXXXXXXXXXXXXXXXXXXXXXXSTGNLIAPRGYFKXXXXXLNNEIRWPPHWXXXXXECITPNGSIPNDKPFQNVNRITYGXXXXXXXXXTLKLATGMRNVPEKXXRGIFGAIAGFIENGWEGMVDGWYGFRHQNSESEGTGQAADLKSTQAAIDQXXXXXXXXIGKTNEKFHQIEKEFSEVEGRIQDLEKYVEDTKIDLWSYNAELLVALENQHTIDLTDSEMXXXXXXTKKQLRENAEDMGNGCFKIYHKCDNXXXXXXXXXXXXXXXXXXXXXXXXXXXXXXXXXXGYKDWILWISFAISCFLXXXXXXGFIMWACQKGNIRCNICI

SEQ ID NO: 419860 - protein, 580 aa, Influenza virus
  MOD_RES (1)..(3): Any amino acid
  MOD_RES (16)..(32): Any amino acid
  MOD_RES (51)..(57): Any amino acid
  MOD_RES (72)..(90): Any amino acid
  MOD_RES (102)..(133): Any amino acid
  MOD_RES (146)..(200): Any amino acid
  MOD_RES (213)..(273): Any amino acid
  MOD_RES (287)..(307): Any amino acid
  MOD_RES (332)..(340): Any amino acid
  MOD_RES (355)..(356): Any amino acid
  MOD_RES (407)..(414): Any amino acid
  MOD_RES (475)..(480): Any amino acid
  MOD_RES (506)..(539): Any amino acid
  MOD_RES (556)..(562): Any amino acid
XXXHSMSGFRSNLPGXXXXXXXXXXXXXXXXXNNSTATLCLGHHAVPNGTXXXXXXXDHIEVTNATELVQNXXXXXXXXXXXXXXXXXXXCTLMDALLGDPXXXXXXXXXXXXXXXXXXXXXXXXXXXXXXXXSLRSLIASSGTLXXXXXXXXXXXXXXXXXXXXXXXXXXXXXXXXXXXXXXXXXXXXXXXXXXXXXXXFDKLYVWGVHHPXXXXXXXXXXXXXXXXXXXXXXXXXXXXXXXXXXXXXXXXXXXXXXXXXXXXXXXXXXXXXSNGNLIAPRGYFRXXXXXXXXXXXXXXXXXXXXXECITPNGSISNDKPFQNVNKITYGXXXXXXXXXTLKLATGMRNIPEKXXRGLFGAIAGFIENGWEGMIDGWYGFRHLNSESEGIGQAADLKSTQTAIDQXXXXXXXXIEKTNEKFHQIEKEFSEIEGRIQDLEKYIEDTKIDLWSYNAGLLVALENQNTIDLTDSEMXXXXXXTRRQLRENAEDMGGGCFTIYHKCDNXXXXXXXXXXXXXXXXXXXXXXXXXXXXXXXXXXGYKDWVLWISFAISCFXXXXXXXGFIMWACQRGNIRCNICI

SEQ ID NO: 419861 - protein, 580 aa, Influenza virus
  MOD_RES (1)..(10): Any amino acid
  MOD_RES (23)..(35): Any amino acid
  MOD_RES (51)..(57): Any amino acid
  MOD_RES (72)..(90): Any amino acid
  MOD_RES (102)..(133): Any amino acid
  MOD_RES (146)..(200): Any amino acid
  MOD_RES (213)..(273): Any amino acid
  MOD_RES (287)..(307): Any amino acid
  MOD_RES (332)..(343): Any amino acid
  MOD_RES (355)..(356): Any amino acid
  MOD_RES (407)..(414): Any amino acid
  MOD_RES (475)..(480): Any amino acid
  MOD_RES (506)..(539): Any amino acid
  MOD_RES (557)..(562): Any amino acid
  MOD_RES (577)..(580): Any amino acid
XXXXXXXXXXIFIFILLTHWAYXXXXXXXXXXXXXMATLCLGHHAVANGTXXXXXXXDQVEVTNATELVQIXXXXXXXXXXXXXXXXXXXCTLIDAMLGDPXXXXXXXXXXXXXXXXXXXXXXXXXXXXXXXXSLRSIVASSGTLXXXXXXXXXXXXXXXXXXXXXXXXXXXXXXXXXXXXXXXXXXXXXXXXXXXXXXXFDKLYIWGIHHPXXXXXXXXXXXXXXXXXXXXXXXXXXXXXXXXXXXXXXXXXXXXXXXXXXXXXXXXXXXXXSNGNLVAPRGYFKXXXXXXXXXXXXXXXXXXXXXACITPNGSIPNEKPFQNVNKVTYGXXXXXXXXXXXXLATGMRNVPERXXKGLFGAIAGFIENGWEGMMDGWYGFRHHNSESEGRGQAADLKSTQAAVNQXXXXXXXXIERTNEKFHQIEKEFTEVEGRIQDLERYVEDTKIDLWSYNADVLVALENQHTIHLTDSEMXXXXXXTRKQLRENAEDLGNGCLKIYHKCDNXXXXXXXXXXXXXXXXXXXXXXXXXXXXXXXXXXEYKDWILWISFATSCFLXXXXXXGFIVWACQRGNIRCXXXX

SEQ ID NO: 419862 - protein, 580 aa, Influenza virus
  MOD_RES (1)..(10): Any amino acid
  MOD_RES (23)..(35): Any amino acid
  MOD_RES (51)..(57): Any amino acid
  MOD_RES (72)..(90): Any amino acid
  MOD_RES (102)..(133): Any amino acid
  MOD_RES (146)..(200): Any amino acid
  MOD_RES (212)..(273): Any amino acid
  MOD_RES (285)..(307): Any amino acid
  MOD_RES (331)..(343): Any amino acid
  MOD_RES (355)..(365): Any amino acid
  MOD_RES (407)..(414): Any amino acid
  MOD_RES (427)..(429): Any amino acid
  MOD_RES (475)..(480): Any amino acid
  MOD_RES (506)..(539): Any amino acid
  MOD_RES (557)..(562): Any amino acid
XXXXXXXXXXIFIFLLLTHWAYXXXXXXXXXXXXXAATLCLGHHAVQNGTXXXXXXXDRIEVTNATELVQGXXXXXXXXXXXXXXXXXXXCTLVDALLGDPXXXXXXXXXXXXXXXXXXXXXXXXXXXXXXXXTLRSLVASSGNLXXXXXXXXXXXXXXXXXXXXXXXXXXXXXXXXXXXXXXXXXXXXXXXXXXXXXXXSDKLYIWGVHHXXXXXXXXXXXXXXXXXXXXXXXXXXXXXXXXXXXXXXXXXXXXXXXXXXXXXXXXXXXXXXCTGNLIAPRGYXXXXXXXXXXXXXXXXXXXXXXXGCITPNGSIPNNRPFQNVNKITYXXXXXXXXXXXXXLATGMRNVPETXXXXXXXXXXXFIENGWEGMVNGWYGFRHQNSNSEGTGQAADLKSTQAAINQXXXXXXXXIKKTNEKFHQIEXXXSEVEGRIQNLEKYVEDTKVDLWSYNAELLIALENQHTIDLADSEMXXXXXXTKRQLRENAEDIGNGCFRIYHKCDNXXXXXXXXXXXXXXXXXXXXXXXXXXXXXXXXXXGYKNWILWISFAISCLLXXXXXXGFIMWTCQKGNIKCNICI

SEQ ID NO: 419863 - protein, 580 aa, Influenza virus
  MOD_RES (1)..(10): Any amino acid
  MOD_RES (23)..(35): Any amino acid
  MOD_RES (49)..(57): Any amino acid
  MOD_RES (69)..(133): Any amino acid
  MOD_RES (145)..(200): Any amino acid
  MOD_RES (213)..(274): Any amino acid
  MOD_RES (286)..(307): Any amino acid
  MOD_RES (320)..(343): Any amino acid
  MOD_RES (355)..(372): Any amino acid
  MOD_RES (402)..(414): Any amino acid
  MOD_RES (426)..(437): Any amino acid
  MOD_RES (449)..(450): Any amino acid
  MOD_RES (471)..(482): Any amino acid
  MOD_RES (494)..(494): Any amino acid
  MOD_RES (506)..(539): Any amino acid
  MOD_RES (557)..(562): Any amino acid
  MOD_RES (579)..(580): Any amino acid
XXXXXXXXXXIFNFILLTHWAYXXXXXXXXXXXXXTAMLCLGHHAVPNXXXXXXXXXDNIEVTNATELXXXXXXXXXXXXXXXXXXXXXXXXXXXXXXXXXXXXXXXXXXXXXXXXXXXXXXXXXXXXXXXXXSLRSLVGSSGTXXXXXXXXXXXXXXXXXXXXXXXXXXXXXXXXXXXXXXXXXXXXXXXXXXXXXXXXFDKLYVWGIHHPXXXXXXXXXXXXXXXXXXXXXXXXXXXXXXXXXXXXXXXXXXXXXXXXXXXXXXXXXXXXXXNGNLIAPRGYYXXXXXXXXXXXXXXXXXXXXXXKCITPNGSIPNGXXXXXXXXXXXXXXXXXXXXXXXXLATGMRNIPERXXXXXXXXXXXXXXXXXXGMVDGWYGFRYQNSESEGMGQAADLKSTQXXXXXXXXXXXXXVEKTNEKFHQIXXXXXXXXXXXXDLEKYVEDTKVXXWSYNAEFLVALENQHTIDMTXXXXXXXXXXXXKQLRENAEEMGXGCFKIYHRCDNXXXXXXXXXXXXXXXXXXXXXXXXXXXXXXXXXXGYKDWFLWISFAMSCFLXXXXXXGFVMWACQKGNIKCNIXX

SEQ ID NO: 419864 - protein, 580 aa, Influenza virus
  MOD_RES (1)..(13): Any amino acid
  MOD_RES (25)..(35): Any amino acid
  MOD_RES (51)..(134): Any amino acid
  MOD_RES (146)..(377): Any amino acid
  MOD_RES (398)..(451): Any amino acid
  MOD_RES (475)..(483): Any amino acid
  MOD_RES (498)..(541): Any amino acid
  MOD_RES (556)..(566): Any amino acid
XXXXXXXXXXXXXVLSCIFCLAFGXXXXXXXXXXXDATLCLGHHAVSNGTXXXXXXXXXXXXXXXXXXXXXXXXXXXXXXXXXXXXXXXXXXXXXXXXXXXXXXXXXXXXXXXXXXXXXXXXXXXXXXXXXXXXLRSIVASSGTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRLVRFRHQNSEGIGQAADLXXXXXXXXXXXXXXXXXXXXXXXXXXXXXXXXXXXXXXXXXXXXXXXXXXXXXXSYNAEILVALENQHTIDLTDAEMXXXXXXXXXQLRENAEDMGDGCFXXXXXXXXXXXXXXXXXXXXXXXXXXXXXXXXXXXXXXXXXXXXKDWILWISFAMSCFXXXXXXXXXXXWACQKGNIRCDICI

SEQ ID NO: 419865 - protein, 580 aa, Influenza virus
  MOD_RES (1)..(13): Any amino acid
  MOD_RES (25)..(379): Any amino acid
  MOD_RES (398)..(458): Any amino acid
  MOD_RES (470)..(486): Any amino acid
  MOD_RES (498)..(567): Any amino acid
  MOD_RES (579)..(580): Any amino acid
XXXXXXXXXXXXXRFSYVFCLALGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHQNSEGRGQAADLXXXXXXXXXXXXXXXXXXXXXXXXXXXXXXXXXXXXXXXXXXXXXXXXXXXXXXXXXXXXXVVLENQHTIDLXXXXXXXXXXXXXXXXXENAEDMGNGCLXXXXXXXXXXXXXXXXXXXXXXXXXXXXXXXXXXXXXXXXXXXXXXXXXXXXXXXXXXXXXXXXXXXXXXACQKGNIRCSIXX

SEQ ID NO: 419866 - protein, 580 aa, Influenza virus
  MOD_RES (1)..(379): Any amino acid
  MOD_RES (398)..(569): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRYQNSEGMGQAADLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQKGNIRCNICV

SEQ ID NO: 419867 - protein, 580 aa, Influenza virus
  MOD_RES (1)..(379): Any amino acid
  MOD_RES (399)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHHNSEGTGQAGDLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419868 - protein, 580 aa, Influenza virus
  MOD_RES (1)..(379): Any amino acid
  MOD_RES (391)..(393): Any amino acid
  MOD_RES (407)..(580): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHLNSEGXXXAADFKSTQAAINQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419869 - protein, 574 aa, Influenza virus
  MOD_RES (13)..(23): Any amino acid
  MOD_RES (51)..(51): Any amino acid
  MOD_RES (66)..(82): Any amino acid
  MOD_RES (99)..(127): Any amino acid
  MOD_RES (142)..(194): Any amino acid
  MOD_RES (207)..(251): Any amino acid
  MOD_RES (263)..(267): Any amino acid
  MOD_RES (282)..(285): Any amino acid
  MOD_RES (297)..(301): Any amino acid
  MOD_RES (329)..(329): Any amino acid
  MOD_RES (401)..(408): Any amino acid
  MOD_RES (500)..(501): Any amino acid
  MOD_RES (513)..(514): Any amino acid
  MOD_RES (526)..(533): Any amino acid
  MOD_RES (553)..(555): Any amino acid
HSMSGFRSNLPGXXXXXXXXXXXNNNNNTATLCLLGHHAVPNGTIVKTITXDQIEVTNATELVQSXXXXXXXXXXXXXXXXXKNCTLIDALLGDPQCDXXXXXXXXXXXXXXXXXXXXXXXXXXXXXSLRSLVASSGTLEFXXXXXXXXXXXXXXXXXXXXXXXXXXXXXXXXXXXXXXXXXXXXXXXXXXXXXFDKLYIWGVHHPXXXXXXXXXXXXXXXXXXXXXXXXXXXXXXXXXXXXXXXXXXXXXSIYWTIVKPGDXXXXXSTGNLIAPRGYFKIXXXXLNNEIRWPPHWXXXXXECITPNGSIPNDKPFQNVNRITYGACPXYVKQNTLKLATGMRNVPEKQTRGIFGAIAGFIENGWEGMVDGWYGFRHQNSESEGTGQAADLKSTQAAINQXXXXXXXXIGKTNEKFHQIEKEFSEVEGRIQDLEKYVEDTKIDLWSYNAELLVALENQHTIDLTDSEMNKLFERTKKQLRENAEDMGNGCFKIYHKCDNXXIGSIRNGTYDHXXYRDEALNNRFQXXXXXXXXGYKDWILWISFAISCFLLCXXXLGFIMWACQKGNIRCNICI

SEQ ID NO: 419870 - protein, 574 aa, Influenza virus
  MOD_RES (1)..(1): Any amino acid
  MOD_RES (13)..(26): Any amino acid
  MOD_RES (51)..(51): Any amino acid
  MOD_RES (66)..(84): Any amino acid
  MOD_RES (99)..(127): Any amino acid
  MOD_RES (142)..(194): Any amino acid
  MOD_RES (207)..(251): Any amino acid
  MOD_RES (263)..(267): Any amino acid
  MOD_RES (282)..(301): Any amino acid
  MOD_RES (329)..(329): Any amino acid
  MOD_RES (380)..(380): Any amino acid
  MOD_RES (401)..(408): Any amino acid
  MOD_RES (499)..(501): Any amino acid
  MOD_RES (513)..(514): Any amino acid
  MOD_RES (526)..(533): Any amino acid
  MOD_RES (550)..(555): Any amino acid
XMKTIIIVLSCIXXXXXXXXXXXXXXNNSTATLCLGHHAVPNGTLVKTITXDHIEVTNATELVQNXXXXXXXXXXXXXXXXXXXCTLMDALLGDPHCDXXXXXXXXXXXXXXXXXXXXXXXXXXXXXSLRSLIASSGTLEFXXXXXXXXXXXXXXXXXXXXXXXXXXXXXXXXXXXXXXXXXXXXXXXXXXXXXFDKLYVWGVHHPXXXXXXXXXXXXXXXXXXXXXXXXXXXXXXXXXXXXXXXXXXXXXSVYWTVVKPGDXXXXXSNGNLIAPRGYFRIXXXXXXXXXXXXXXXXXXXXACITPNGSIPNEKPFQNVNKITYGACPXYVKQSTLKLATGMRNIPEKQTRGLFGAIAGFIENGWEGMMDGWYGFRHQNXNSEGTGQAADLKSTQAAVNQXXXXXXXXIEKTNEKFHQIEKEFTEVEGRIQDLERYVEDTKIDLWSYNAGLLVALENQNTIDLTDSEMNKLFDRTRKQLRENAEDLGNGCFKIYHKCNXXXIESIRNGTYDHXXYRDEAVNNRFQXXXXXXXXGYKDWVLWISFAISCFXXXXXXLGFIMWACQRGNIRCNICI

SEQ ID NO: 419871 - protein, 574 aa, Influenza virus
  MOD_RES (1)..(29): Any amino acid
  MOD_RES (51)..(51): Any amino acid
  MOD_RES (66)..(84): Any amino acid
  MOD_RES (99)..(127): Any amino acid
  MOD_RES (142)..(194): Any amino acid
  MOD_RES (206)..(251): Any amino acid
  MOD_RES (263)..(267): Any amino acid
  MOD_RES (282)..(301): Any amino acid
  MOD_RES (329)..(329): Any amino acid
  MOD_RES (380)..(380): Any amino acid
  MOD_RES (401)..(408): Any amino acid
  MOD_RES (421)..(427): Any amino acid
  MOD_RES (500)..(501): Any amino acid
  MOD_RES (513)..(514): Any amino acid
  MOD_RES (526)..(533): Any amino acid
  MOD_RES (553)..(555): Any amino acid
XXXXXXXXXXXXXXXXXXXXXXXXXXXXXMATLCLGHHAVPNGTVVKTITXDQVEVTNATELVQIXXXXXXXXXXXXXXXXXXXCTLVDALLGDPHCDXXXXXXXXXXXXXXXXXXXXXXXXXXXXXSLRSIVASSGTLEFXXXXXXXXXXXXXXXXXXXXXXXXXXXXXXXXXXXXXXXXXXXXXXXXXXXXXSDKLYIWGVHHXXXXXXXXXXXXXXXXXXXXXXXXXXXXXXXXXXXXXXXXXXXXXXSIHWTIVKPGDXXXXXCTGNLIAPRGYYKMXXXXXXXXXXXXXXXXXXXXECITPNGSISNDKPFQNVNRITYGPCPXYIKQNTLKLATGMRNVPETQTRGIFGAIAGFIENGWEGMIDGWYGFRHQNXNSEGIGQAADLKSTQAAIDQXXXXXXXXIKKTNEKFHQIEXXXXXXXGRIQDLEKYIEDTKIDLWSYNAELLIALENQHTIHLTDSEMNKLFEKTRRQLRENAEDMGNGCLKIYHKCDNXXIGSIRNETYDHXXYRNEALNNRFQXXXXXXXXEYKDWILWISFATSCFLLCXXXLGFIMWTCQKGNIRCDICI

SEQ ID NO: 419872 - protein, 574 aa, Influenza virus
  MOD_RES (1)..(29): Any amino acid
  MOD_RES (51)..(51): Any amino acid
  MOD_RES (64)..(85): Any amino acid
  MOD_RES (99)..(127): Any amino acid
  MOD_RES (142)..(194): Any amino acid
  MOD_RES (207)..(251): Any amino acid
  MOD_RES (263)..(268): Any amino acid
  MOD_RES (280)..(301): Any amino acid
  MOD_RES (329)..(329): Any amino acid
  MOD_RES (359)..(359): Any amino acid
  MOD_RES (401)..(408): Any amino acid
  MOD_RES (420)..(431): Any amino acid
  MOD_RES (476)..(476): Any amino acid
  MOD_RES (494)..(501): Any amino acid
  MOD_RES (513)..(514): Any amino acid
  MOD_RES (526)..(533): Any amino acid
  MOD_RES (550)..(555): Any amino acid
  MOD_RES (571)..(574): Any amino acid
XXXXXXXXXXXXXXXXXXXXXXXXXXXXXAATLCLGHHAVPNGTMVKTITXDNIEVTNATELVXXXXXXXXXXXXXXXXXXXXXXTLIDALLGDPHCDXXXXXXXXXXXXXXXXXXXXXXXXXXXXXTLRSLVASSGNLEFXXXXXXXXXXXXXXXXXXXXXXXXXXXXXXXXXXXXXXXXXXXXXXXXXXXXXFDKLYIWGIHHPXXXXXXXXXXXXXXXXXXXXXXXXXXXXXXXXXXXXXXXXXXXXXSIYWTVVKPGDXXXXXXNGNLIAPRGYYXXXXXXXXXXXXXXXXXXXXXXGCITPNGSIPNGKPFQNVNRITYGVCPXYVKQKTLKLATGMRNVPERQTRGIFGAIAXFIENGWEGMVNGWYGFRHQNSNSEGRGQAADLKSTQAAITQXXXXXXXXVEKTNEKFHQIXXXXXXXXXXXXDLEKYVEDTKVDLWSYNAELLIAMENQHTIDLTDSEMSKLFERTXKQLRENAEEMGNGCFKIXXXXXXXXIGSIRNGTYNHXXYRDEALNNRSQXXXXXXXXGYKDWFLWISFAISCFXXXXXXLGFIVWACQRGNIRCXXXX

SEQ ID NO: 419873 - protein, 574 aa, Influenza virus
  MOD_RES (1)..(29): Any amino acid
  MOD_RES (51)..(85): Any amino acid
  MOD_RES (99)..(194): Any amino acid
  MOD_RES (206)..(251): Any amino acid
  MOD_RES (263)..(270): Any amino acid
  MOD_RES (282)..(301): Any amino acid
  MOD_RES (329)..(329): Any amino acid
  MOD_RES (359)..(367): Any amino acid
  MOD_RES (393)..(444): Any amino acid
  MOD_RES (476)..(481): Any amino acid
  MOD_RES (500)..(501): Any amino acid
  MOD_RES (513)..(514): Any amino acid
  MOD_RES (526)..(534): Any amino acid
  MOD_RES (553)..(555): Any amino acid
XXXXXXXXXXXXXXXXXXXXXXXXXXXXXTAMLCLGHHAVPNGTIVRTITXXXXXXXXXXXXXXXXXXXXXXXXXXXXXXXXXXXTLIDSLLGDPHCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNKLYIWGVHHXXXXXXXXXXXXXXXXXXXXXXXXXXXXXXXXXXXXXXXXXXXXXXSVYWTIVKPGDXXXXXXXXNLIAPRGYFKMXXXXXXXXXXXXXXXXXXXXKCITPNGSIPNNKPFQNINRITYGACPXYVRQNTLKLATGMRNIPERQTRGLFGAIAXXXXXXXXXMVDGWYGFRHHNSESEGMGQAADLKXXXXXXXXXXXXXXXXXXXXXXXXXXXXXXXXXXXXXXXXXXXXXXXXXXXXWSYNAEFLVALENQHTIHLTDSEMSKLFEKTXXXXXXNAEDMGNGCFTIYHKCDNXXMESIRNGTYDHXXYRDEALSNRFQXXXXXXXXXYKNWILWISFAISCLLLCXXXLGFVMWACQKGNIKCNICI

SEQ ID NO: 419874 - protein, 574 aa, Influenza virus
  MOD_RES (1)..(270): Any amino acid
  MOD_RES (282)..(369): Any amino acid
  MOD_RES (382)..(387): Any amino acid
  MOD_RES (401)..(444): Any amino acid
  MOD_RES (474)..(481): Any amino acid
  MOD_RES (500)..(535): Any amino acid
  MOD_RES (553)..(558): Any amino acid
  MOD_RES (570)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLIAPRGYFKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGWYGFRHLNSEXXXXXXAADFKSTQAAINQXXXXXXXXXXXXXXXXXXXXXXXXXXXXXXXXXXXXXXXXXXXXWSYNAEILVALENQHTIDMTDSEMNKLFEXXXXXXXXNAEDMGNGCFRIYHKCDNXXXXXXXXXXXXXXXXXXXXXXXXXXXXXXXXXXXXKDWILWISFAMSCFLLCXXXXXXIMWACQKGNIKXXXXX

SEQ ID NO: 419875 - protein, 574 aa, Influenza virus
  MOD_RES (1)..(371): Any amino acid
  MOD_RES (392)..(450): Any amino acid
  MOD_RES (472)..(560): Any amino acid
  MOD_RES (573)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRLVRFRHQNSEGMGQAADLXXXXXXXXXXXXXXXXXXXXXXXXXXXXXXXXXXXXXXXXXXXXXXXXXXXXXXXXXXXVLVALENQHTIDLADSEMNKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWACQKGNIRCDIXX

SEQ ID NO: 419876 - protein, 574 aa, Influenza virus
  MOD_RES (1)..(373): Any amino acid
  MOD_RES (385)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHQNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419877 - protein, 574 aa, Influenza virus
  MOD_RES (1)..(373): Any amino acid
  MOD_RES (385)..(574): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWYGFRHHNSEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419878 - protein, 574 aa, Influenza virus; identical to SEQ ID NO: 419424
  MOD_RES (1)..(373): Any amino acid
  MOD_RES (385)..(574): Any amino acid

SEQ ID NO: 419879 - protein, 486 aa, Influenza virus
  MOD_RES (17)..(79): Any amino acid
  MOD_RES (92)..(101): Any amino acid
  MOD_RES (134)..(134): Any amino acid
  MOD_RES (151)..(159): Any amino acid
  MOD_RES (205)..(228): Any amino acid
  MOD_RES (257)..(263): Any amino acid
  MOD_RES (277)..(278): Any amino acid
  MOD_RES (317)..(324): Any amino acid
  MOD_RES (340)..(413): Any amino acid
  MOD_RES (442)..(446): Any amino acid
AKAGVKMNPNQKIITIXXXXXXXXXXXXXXXXXXXXXXXXXXXXXXXXXXXXXXXXXXXXXXXXXXXXXXXXXXXXXXXEKEKEICSVVLEXXXXXXXXXXITGFAPFSKDNSIRLSAGGDIWVTREPYVSCDXDKCYQFALGQGTTLNNXXXXXXXXXRTPYRTLLMNELGVPFHLGTKQVCIAWSSSSCHDGKAWLHVCVTGXXXXXXXXXXXXXXXXXXXXXXXXEILRTQESECVCINGTCTVVMTDGSASGXXXXXXXEYYFVKEGKIVHIXXLSGSAQHVEECSCYPRYPGVRCVCRDNWKGSNRPIVDIXXXXXXXXSSYVCSGLVGDTPRKXXXXXXXXXXXXXXXXXXXXXXXXXXXXXXXXXXXXXXXXXXXXXXXXXXXXXXXXXXXXXXXXXXXXXXXXXXRSGYSGIFSVEGKSCINRCFYVELIRGRXXXXXVLWTSNSIVVFCGTSGTYGTGSWPDGADINLHAYISFRNL

SEQ ID NO: 419880 - protein, 486 aa, Influenza virus
  MOD_RES (1)..(101): Any amino acid
  MOD_RES (134)..(134): Any amino acid
  MOD_RES (151)..(159): Any amino acid
  MOD_RES (203)..(228): Any amino acid
  MOD_RES (257)..(278): Any amino acid
  MOD_RES (317)..(324): Any amino acid
  MOD_RES (340)..(413): Any amino acid
  MOD_RES (442)..(446): Any amino acid
  MOD_RES (483)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAGFAPFSKDNSIRLAAGGDIWVTRELYVSCDXGKCYQFALGQGTTLDNXXXXXXXXXRIPHRTLLMNELGVPFHLGTRQVCIAWSSSSCHDGRAWLHVCVXXXXXXXXXXXXXXXXXXXXXXXXXXKILRTQESECVCISGTCAVVMTDGSASGXXXXXXXXXXXXXXXXXXXXXXLSGSAQHIEECSCYPRYPNVRCICRDNWKGSNRPVVDIXXXXXXXXSRYVCSGLVGDTPRNXXXXXXXXXXXXXXXXXXXXXXXXXXXXXXXXXXXXXXXXXXXXXXXXXXXXXXXXXXXXXXXXXXXXXXXXXXWSGYSGIFSVESKSCVNRCFYVELIRGSXXXXXVWWTSNSIVVFCGTSGTYGSGSWPDGADINLMPIYSXXXX

SEQ ID NO: 419881 - protein, 486 aa, Influenza virus
  MOD_RES (1)..(110): Any amino acid
  MOD_RES (134)..(134): Any amino acid
  MOD_RES (151)..(159): Any amino acid
  MOD_RES (205)..(228): Any amino acid
  MOD_RES (253)..(278): Any amino acid
  MOD_RES (317)..(324): Any amino acid
  MOD_RES (339)..(413): Any amino acid
  MOD_RES (438)..(446): Any amino acid
  MOD_RES (475)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNSIRLSAGGAIWVTREPYVSCSXSKCYQFALGQGTTLSNXXXXXXXXXRTPHRTLLMNELGIPFHLGTRQVCMAWSSSSCHDGKAWLHVCITGXXXXXXXXXXXXXXXXXXXXXXXXNILRTQESECVCINGTCAVVMTDGXXXXXXXXXXXXXXXXXXXXXXXXXXLLGSAQHVEECSCYPRFPGIRCVCRDNWKGSNRPVIDIXXXXXXXXSSYMCSGLVGDTPRXXXXXXXXXXXXXXXXXXXXXXXXXXXXXXXXXXXXXXXXXXXXXXXXXXXXXXXXXXXXXXXXXXXXXXXXXXXMSGYSGIFSVENKNCINRCFYVELXXXXXXXXXVWWTSNSIVAFCGTSGTYGTGSWPDGANXXXXXXXXXXXX

SEQ ID NO: 419882 - protein, 486 aa, Influenza virus
  MOD_RES (1)..(110): Any amino acid
  MOD_RES (134)..(134): Any amino acid
  MOD_RES (146)..(164): Any amino acid
  MOD_RES (187)..(228): Any amino acid
  MOD_RES (255)..(278): Any amino acid
  MOD_RES (317)..(324): Any amino acid
  MOD_RES (339)..(413): Any amino acid
  MOD_RES (427)..(463): Any amino acid
  MOD_RES (475)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNSIRLAAGGAIWVTREPYVSCGXNKCYQFALGQGXXXXXXXXXXXXXXXXXXXTLLMSELGVPFHLGTKQVCMAWXXXXXXXXXXXXXXXXXXXXXXXXXXXXXXXXXXXXXXXXXXDILRTQESECVCINGTCTVIMTDGSAXXXXXXXXXXXXXXXXXXXXXXXXLSGNAQHVEECSCYPRYSGVRCVCRDNWRGSNRPIVDIXXXXXXXXSSYLCSGLVGDTPRXXXXXXXXXXXXXXXXXXXXXXXXXXXXXXXXXXXXXXXXXXXXXXXXXXXXXXXXXXXXXXXXXXXXXXXXXXXRSGYSGVFSVEGKXXXXXXXXXXXXXXXXXXXXXXXXXXXXXXXXXXXXXYGTGSWPDGAEXXXXXXXXXXXX

SEQ ID NO: 419883 - protein, 486 aa, Influenza virus
  MOD_RES (1)..(116): Any amino acid
  MOD_RES (132)..(134): Any amino acid
  MOD_RES (146)..(169): Any amino acid
  MOD_RES (184)..(228): Any amino acid
  MOD_RES (252)..(278): Any amino acid
  MOD_RES (298)..(303): Any amino acid
  MOD_RES (317)..(470): Any amino acid
  MOD_RES (484)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSAGGDIWVTRVPYVSXXXDRCYQFALGQGXXXXXXXXXXXXXXXXXXXXXXXXELGVPFYLGTKQVCXXXXXXXXXXXXXXXXXXXXXXXXXXXXXXXXXXXXXXXXXXXXXEILRTQESECICINGTCTVVITDXXXXXXXXXXXXXXXXXXXXXXXXXXXLSGGAQHVEECSCYPRYPDXXXXXXDNWKGSNRPIIDIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGADIKSHAYISFXXX

SEQ ID NO: 419884 - protein, 486 aa, Influenza virus
  MOD_RES (1)..(117): Any amino acid
  MOD_RES (131)..(239): Any amino acid
  MOD_RES (257)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGGDIWVTREHYVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCIDGTCTVVMTDGNASGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419885 - protein, 486 aa, Influenza virus
  MOD_RES (1)..(245): Any amino acid
  MOD_RES (257)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVVMTDGSASEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419886 - protein, 486 aa, Influenza virus
  MOD_RES (1)..(245): Any amino acid
  MOD_RES (257)..(486): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVVMTDGSASDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419887 - protein, 571 aa, Influenza virus
  MOD_RES (1)..(18): Any amino acid
  MOD_RES (33)..(46): Any amino acid
  MOD_RES (59)..(76): Any amino acid
  MOD_RES (93)..(109): Any amino acid
  MOD_RES (139)..(141): Any amino acid
  MOD_RES (157)..(177): Any amino acid
  MOD_RES (206)..(236): Any amino acid
  MOD_RES (275)..(317): Any amino acid
  MOD_RES (342)..(343): Any amino acid
  MOD_RES (505)..(505): Any amino acid
  MOD_RES (546)..(549): Any amino acid
XXXXXXXXXXXXXXXXXXYTGNPVICLGHHAVXXXXXXXXXXXXXXIEVVTAQELVESXXXXXXXXXXXXXXXXXXCDIVNGALGSPGCDHLXXXXXXXXXXXXXXXXXCYPFDVPDYQSLRSILANNGKFEFIAEEFXXXTVKQNGKSGACKRANXXXXXXXXXXXXXXXXXXXXXQNLTKVNNGDYARLYIWGVHHPSTDTEQXXXXXXXXXXXXXXXXXXXXXXXXXXXXXXXVRGQSGRISFYWTIVEPGDLIVFNTIGNLIAPRGHYKLXXXXXXXXXXXXXXXXXXXXXXXXXXXXXXXXXXXXXXXXXXXGDCPKYVKQGSLKLATGMRNIPEKXXRGLFGAIAGFIENGWQGLIDGWYGFRHQNAEGTGTAADLKSTQAAIDQINGKLNRLIEKTNEKYHQIEKEFEQVEGRIQDLEKYVEDTKIDLWSYNAELLVALENQHTIDVTDSEMNKLFERVRRQLRENAEDKGNGCFEIFHQCDNNCIESIRNGTYDHDXYRDEAINNRFQIQGVKLTQGYKDIILWISFSISCFLLVALXXXXALLLAFILWACQNGNIRCQICI

SEQ ID NO: 419888 - protein, 571 aa, Influenza virus
  MOD_RES (1)..(18): Any amino acid
  MOD_RES (33)..(46): Any amino acid
  MOD_RES (59)..(76): Any amino acid
  MOD_RES (93)..(109): Any amino acid
  MOD_RES (139)..(141): Any amino acid
  MOD_RES (157)..(177): Any amino acid
  MOD_RES (206)..(236): Any amino acid
  MOD_RES (275)..(317): Any amino acid
  MOD_RES (342)..(343): Any amino acid
  MOD_RES (355)..(362): Any amino acid
  MOD_RES (437)..(443): Any amino acid
  MOD_RES (505)..(505): Any amino acid
  MOD_RES (544)..(549): Any amino acid
XXXXXXXXXXXXXXXXXXYTGNPVICMGHHAVXXXXXXXXXXXXXXVEVVTAQELVEAXXXXXXXXXXXXXXXXXXCDIINGALGSPGCDRLXXXXXXXXXXXXXXXXXCYPFDVPEYQSLRSILANNGRFEFIAEEFXXXTVKQNGKSSACKRANXXXXXXXXXXXXXXXXXXXXXQNLTKINNGDYTRLYIWGVHHPSTDKEQXXXXXXXXXXXXXXXXXXXXXXXXXXXXXXXVRGQSGRVSFYWTIVEPGNLIVFNTIGNLVAPRGHYKLXXXXXXXXXXXXXXXXXXXXXXXXXXXXXXXXXXXXXXXXXXXGDCPKYIKQGSLKLATGMRNIPERXXKGLFGAIAGFIXXXXXXXXDGWYGFRHQNSEGTGTAADLKSTQTAIDQINGKLNRLIERTNEKYHQIEKEFGQVEGRIQDLERYVEDTKIDLWXXXXXXXVALENQHTIDMTDSEMNRLFERVRRQLRENAEDRGNGCFEIFHKCDNSCIESIRNGTYNHDXYRDEAISNRFQIQGVRLTQGYKDIILWVSFSISCFLLVXXXXXXALLIAFVLWACQNGNLRCQICI

SEQ ID NO: 419889 - protein, 571 aa, Influenza virus
  MOD_RES (1)..(18): Any amino acid
  MOD_RES (32)..(46): Any amino acid
  MOD_RES (59)..(76): Any amino acid
  MOD_RES (93)..(109): Any amino acid
  MOD_RES (139)..(141): Any amino acid
  MOD_RES (157)..(177): Any amino acid
  MOD_RES (206)..(236): Any amino acid
  MOD_RES (275)..(317): Any amino acid
  MOD_RES (341)..(380): Any amino acid
  MOD_RES (434)..(444): Any amino acid
  MOD_RES (505)..(505): Any amino acid
  MOD_RES (546)..(549): Any amino acid
XXXXXXXXXXXXXXXXXXYTENPVICLGHHAXXXXXXXXXXXXXXXIEVVAAQELVESXXXXXXXXXXXXXXXXXXCDIVNSALGSPGCDHLXXXXXXXXXXXXXXXXXCYPFDVPNYQSLRSILANNGKFEFIVEKFXXXTVKQDGKSSACKRANXXXXXXXXXXXXXXXXXXXXXQNLTKVNSGDYARLYIWGVHHPSTDAEQXXXXXXXXXXXXXXXXXXXXXXXXXXXXXXXVRSQSGRISFYWTIVDPGDIIVFNTIGNLIAPRGHYRLXXXXXXXXXXXXXXXXXXXXXXXXXXXXXXXXXXXXXXXXXXXGECPKYVKQGSLRLATGMRNIPEXXXXXXXXXXXXXXXXXXXXXXXXXXXXXXXXXXXXXXXXDLKSTQAAIDKINGKLNRLIEKTNDKYHQIEKEFEQVEGRTQDLENYVEDTKIXXXXXXXXXXXALENQHIIDVTDSEMNKLFERIRHQLRENAEDKGNGCFEIFHKCDNKCIESIRNGTYDHNXYRNEAINNRFQIQGIKLTQGYKDVILWISFSISCFLLAALXXXXALLLAFVLWACQNGNVRCQICI

SEQ ID NO: 419890 - protein, 571 aa, Influenza virus
  MOD_RES (1)..(18): Any amino acid
  MOD_RES (30)..(46): Any amino acid
  MOD_RES (58)..(76): Any amino acid
  MOD_RES (93)..(109): Any amino acid
  MOD_RES (139)..(141): Any amino acid
  MOD_RES (157)..(177): Any amino acid
  MOD_RES (204)..(236): Any amino acid
  MOD_RES (269)..(317): Any amino acid
  MOD_RES (333)..(381): Any amino acid
  MOD_RES (400)..(412): Any amino acid
  MOD_RES (434)..(447): Any amino acid
  MOD_RES (505)..(505): Any amino acid
  MOD_RES (544)..(549): Any amino acid
  MOD_RES (569)..(571): Any amino acid
XXXXXXXXXXXXXXXXXXYIGNPVICMGHXXXXXXXXXXXXXXXXXVEVVAAQELVEXXXXXXXXXXXXXXXXXXXCDIVNAALGSPGCDHLXXXXXXXXXXXXXXXXXCYPFDVPGYQSLRSILANNGKLEFIAEEFXXXTIKQNGKSGACKRADXXXXXXXXXXXXXXXXXXXXXQNLTKVNNGNYARLYIWGVHHPSTSTXXXXXXXXXXXXXXXXXXXXXXXXXXXXXXXXXVRGLSSRISFYWTIVEPEDLILFNTIGNLIAPXXXXXXXXXXXXXXXXXXXXXXXXXXXXXXXXXXXXXXXXXXXXXXXXXGDCPRYVKQGSLKLAXXXXXXXXXXXXXXXXXXXXXXXXXXXXXXXXXXXXXXXXXXXXXXXXXLKSTQAAINQINGKLNRLXXXXXXXXXXXXXEFEQVEGRIQYLEKYVEDTKIXXXXXXXXXXXXXXNQHTIDVADSEMNKLFERVRHQLRENAEDKGNGCFEIFHRCDNTCIESIRNGTYNHNXYRDEAINSRFQIQGVKLAQGYKDIILWFSFSISCFLLVXXXXXXALLLAFMLWACQTGNIRCQXXX

SEQ ID NO: 419891 - protein, 571 aa, Influenza virus
  MOD_RES (1)..(18): Any amino acid
  MOD_RES (33)..(46): Any amino acid
  MOD_RES (59)..(114): Any amino acid
  MOD_RES (139)..(141): Any amino acid
  MOD_RES (153)..(177): Any amino acid
  MOD_RES (189)..(236): Any amino acid
  MOD_RES (265)..(317): Any amino acid
  MOD_RES (330)..(384): Any amino acid
  MOD_RES (404)..(412): Any amino acid
  MOD_RES (436)..(449): Any amino acid
  MOD_RES (478)..(479): Any amino acid
  MOD_RES (501)..(505): Any amino acid
  MOD_RES (552)..(556): Any amino acid
  MOD_RES (568)..(571): Any amino acid
XXXXXXXXXXXXXXXXXXHTGNPVICLGHHSVXXXXXXXXXXXXXXVEVITAQELVESXXXXXXXXXXXXXXXXXXXXXXXXXXXXXXXXXXXXXXXXXXXXXXXXXXXXXXXXVPDYQSIRSILANNGKFEFIAEDFXXXAVKQNGKSGACXXXXXXXXXXXXXXXXXXXXXXXXXQNLTKTNNGDYXXXXXXXXXXXXXXXXXXXXXXXXXXXXXXXXXXXXXXXXXXXXXXXXVRGQSSRISFYWTIVVPGDLILFNTIGNXXXXXXXXXXXXXXXXXXXXXXXXXXXXXXXXXXXXXXXXXXXXXXXXXXXXXGNCPKYVKQGSLXXXXXXXXXXXXXXXXXXXXXXXXXXXXXXXXXXXXXXXXXXXXXXXXXXXXXXXTQTAIDQITGKLNRLIEKTXXXXXXXXXEFNKIEGRVQDLEEYVEDTKIDLXXXXXXXXXXXXXXHTIDVTDSEMDKLFERVKRQLRENAEDKXXGCFEIFHQCNNNCIESIRNGKXXXXXYRDDAINNRFQIQGVKLIQGYKDIILWISFSMSCQASPSCLVVRKSXXXXXLWACQNGNIRWXXXX

SEQ ID NO: 419892 - protein, 571 aa, Influenza virus
  MOD_RES (1)..(19): Any amino acid
  MOD_RES (31)..(47): Any amino acid
  MOD_RES (59)..(143): Any amino acid
  MOD_RES (155)..(241): Any amino acid
  MOD_RES (265)..(384): Any amino acid
  MOD_RES (403)..(413): Any amino acid
  MOD_RES (444)..(449): Any amino acid
  MOD_RES (467)..(487): Any amino acid
  MOD_RES (499)..(532): Any amino acid
  MOD_RES (546)..(549): Any amino acid
  MOD_RES (562)..(571): Any amino acid
XXXXXXXXXXXXXXXXXXXTGNPVMCLGHHXXXXXXXXXXXXXXXXXEVVTAQELVEPXXXXXXXXXXXXXXXXXXXXXXXXXXXXXXXXXXXXXXXXXXXXXXXXXXXXXXXXXXXXXXXXXXXXXXXXXXXXXXXXXXXXXEQNGKSGACKRXXXXXXXXXXXXXXXXXXXXXXXXXXXXXXXXXXXXXXXXXXXXXXXXXXXXXXXXXXXXXXXXXXXXXXXXXXXXXXXXXXXXXXXGRISVYWTIVEPGDVIVFNTIGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTQAAIDQVNGKLNRLIEKXXXXXXXXXXXFEQVEGRIQNLEKYVEDTKVDLWSYNAELLXXXXXXHTIDVTDSEMSKLFERVXXXXXXXXXXXXXXXXXXXXXCGNNCIESIRNXXXXXXXXXXXXXXXXXXXXXXXXXXXXXXXXXXISFSISCFLLIALXXXXALLLTFILWACQXXXXXXXXXX

SEQ ID NO: 419893 - protein, 571 aa, Influenza virus
  MOD_RES (1)..(24): Any amino acid
  MOD_RES (36)..(244): Any amino acid
  MOD_RES (256)..(385): Any amino acid
  MOD_RES (402)..(422): Any amino acid
  MOD_RES (434)..(535): Any amino acid
  MOD_RES (550)..(571): Any amino acid
XXXXXXXXXXXXXXXXXXXXXXXXWICMGHHAVANXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLYWTIVEPGDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQAAIDQISGKLNRLIEXXXXXXXXXXXXXXXXXXXXXDLEKYVEDTKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTTRQASPSCLVVRXXXXXXXXXXXXXXXXXXXXXX

SEQ ID NO: 419894 - protein, 571 aa, Influenza virus
  MOD_RES (1)..(541): Any amino acid
  MOD_RES (554)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSISCFLLVALLLXXXXXXXXXXXXXXXXXX

SEQ ID NO: 419895 - protein, 571 aa, Influenza virus
  MOD_RES (1)..(541): Any amino acid
  MOD_RES (554)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSISCFLLAALLLXXXXXXXXXXXXXXXXXX

SEQ ID NO: 419896 - protein, 571 aa, Influenza virus
  MOD_RES (1)..(541): Any amino acid
  MOD_RES (554)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSISCFLLVALFLXXXXXXXXXXXXXXXXXX

SEQ ID NO: 419897 - protein, 571 aa, Influenza virus; identical to SEQ ID NO: 419442
  MOD_RES (1)..(541): Any amino acid
  MOD_RES (554)..(571): Any amino acid

SEQ ID NO: 419898 - protein, 571 aa, Influenza virus
  MOD_RES (1)..(542): Any amino acid
  MOD_RES (554)..(571): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISCFLLVALLIXXXXXXXXXXXXXXXXXX

SEQ ID NO: 419899 - protein, 608 aa, Influenza virus
  MOD_RES (14)..(18): Any amino acid
  MOD_RES (30)..(36): Any amino acid
  MOD_RES (53)..(74): Any amino acid
  MOD_RES (92)..(138): Any amino acid
  MOD_RES (150)..(163): Any amino acid
  MOD_RES (175)..(266): Any amino acid
  MOD_RES (283)..(302): Any amino acid
  MOD_RES (314)..(319): Any amino acid
  MOD_RES (339)..(352): Any amino acid
  MOD_RES (396)..(398): Any amino acid
  MOD_RES (414)..(458): Any amino acid
  MOD_RES (516)..(555): Any amino acid
  MOD_RES (582)..(584): Any amino acid
ICQMEKIVLLFAIXXXXXSDQICIGYHANXXXXXXXVDTIMEKNVTVTHAQDXXXXXXXXXXXXXXXXXXXXXXDCSVAGWLLGNPMCDEFXXXXXXXXXXXXXXXXXXXXXXXXXXXXXXXXXXXXXXXXXXXXXXXADHPPKVAWSSXXXXXXXXXXXXXXNGRSSFFRNVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFESNGNFIAPEYAYKIXXXXXXXXXXXXXXXXXXXXPSVKLPMGAINXXXXXXPFHNIHPLTIGECPKYVKSXXXXXXXXXXXXXXREREGGRRRKRGRQKRGLFGAIAGFFIEGGWQGMVDGWYGYHHXXXQGSGYAADKESTQKAXXXXXXXXXXXXXXXXXXXXXXXXXXXXXXXXXXXXXXXXXXXXXDVWTYNAELLVLMENERTLDFHDSNVKNLYDKVRLQLRDNAKELGNGCFEFYHKCDNXXXXXXXXXXXXXXXXXXXXXXXXXXXXXXXXXXXXXXXXLSIYSTVASSLSTGNHGSLVLSLWMCXXXLWMCSNGSLQCRICIRFVNSDCSK

SEQ ID NO: 419900 - protein, 608 aa, Influenza virus
  MOD_RES (14)..(18): Any amino acid
  MOD_RES (30)..(36): Any amino acid
  MOD_RES (53)..(74): Any amino acid
  MOD_RES (92)..(163): Any amino acid
  MOD_RES (175)..(266): Any amino acid
  MOD_RES (283)..(309): Any amino acid
  MOD_RES (339)..(360): Any amino acid
  MOD_RES (396)..(398): Any amino acid
  MOD_RES (414)..(458): Any amino acid
  MOD_RES (516)..(555): Any amino acid
  MOD_RES (567)..(584): Any amino acid
  MOD_RES (608)..(608): Any amino acid
SVKMEKIVLLLATXXXXXGDQICIGYHANXXXXXXXVDTIMERNVTVTHAQDXXXXXXXXXXXXXXXXXXXXXXDCSIAGWLLGNPMCDKFXXXXXXXXXXXXXXXXXXXXXXXXXXXXXXXXXXXXXXXXXXXXXXXXXXXXXXXXXXXXXXXXXXXXXXXXTGRSSFFRNVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFESTGNFIAPEYAYIVXXXXXXXXXXXXXXXXXXXXXXXXXXXGAIGAIDSSMPFHNVHPLTIGKCPKYVKSXXXXXXXXXXXXXXXXXXXXXXKKKRGLFGAIAFGAIAGFIEGGWQGMVDGWYGFHHXXXQGSGYAADQESTQKAXXXXXXXXXXXXXXXXXXXXXXXXXXXXXXXXXXXXXXXXXXXXXNVWTYNAELLVLMENERTLDLHDSNVKNLYDRVRLQLKDNAKELGNGCFEFYHRCDNXXXXXXXXXXXXXXXXXXXXXXXXXXXXXXXXXXXXXXXXLSIYSTAASSLXXXXXXXXXXXXXXXXXXFWMCSNGSLQCKICIKICESRLRX

SEQ ID NO: 419901 - protein, 608 aa, Influenza virus
  MOD_RES (1)..(2): Any amino acid
  MOD_RES (14)..(18): Any amino acid
  MOD_RES (30)..(36): Any amino acid
  MOD_RES (53)..(74): Any amino acid
  MOD_RES (91)..(163): Any amino acid
  MOD_RES (175)..(266): Any amino acid
  MOD_RES (283)..(319): Any amino acid
  MOD_RES (339)..(362): Any amino acid
  MOD_RES (375)..(376): Any amino acid
  MOD_RES (396)..(398): Any amino acid
  MOD_RES (414)..(458): Any amino acid
  MOD_RES (470)..(474): Any amino acid
  MOD_RES (516)..(555): Any amino acid
  MOD_RES (567)..(584): Any amino acid
  MOD_RES (600)..(608): Any amino acid
XXKMEKIVLLLAIXXXXXSDHICIGYHANXXXXXXXIDTIMEKNVTVTHAQNXXXXXXXXXXXXXXXXXXXXXXDCSVSGWLLGNPMCDAXXXXXXXXXXXXXXXXXXXXXXXXXXXXXXXXXXXXXXXXXXXXXXXXXXXXXXXXXXXXXXXXXXXXXXXXXSGRSSFFRNVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFDSNGNFIAPEYAYKVXXXXXXXXXXXXXXXXXXXXXXXXXXXXXXXXXXXXXPFHNVHPFTIGECPKYVRSXXXXXXXXXXXXXXXXXXXXXXXXTRRQKRGLFGAIXXGFIEGGWQGMIDGWYGYHHXXXQGSGYAADKKSTQKAXXXXXXXXXXXXXXXXXXXXXXXXXXXXXXXXXXXXXXXXXXXXXGVWTYNAELLVXXXXXRTLDFHDSNVRNLYDKVRLQLKDNARELGNGCFEFYHKCNNXXXXXXXXXXXXXXXXXXXXXXXXXXXXXXXXXXXXXXXXLSIYSTVVSSLXXXXXXXXXXXXXXXXXXLWMCFNGSLQCRICIXXXXXXXXX

SEQ ID NO: 419902 - protein, 608 aa, Influenza virus
  MOD_RES (1)..(18): Any amino acid
  MOD_RES (30)..(36): Any amino acid
  MOD_RES (53)..(76): Any amino acid
  MOD_RES (92)..(266): Any amino acid
  MOD_RES (283)..(319): Any amino acid
  MOD_RES (339)..(362): Any amino acid
  MOD_RES (377)..(398): Any amino acid
  MOD_RES (414)..(458): Any amino acid
  MOD_RES (476)..(478): Any amino acid
  MOD_RES (504)..(504): Any amino acid
  MOD_RES (516)..(555): Any amino acid
  MOD_RES (567)..(584): Any amino acid
  MOD_RES (596)..(596): Any amino acid
  MOD_RES (608)..(608): Any amino acid
XXXXXXXXXXXXXXXXXXGDRICIGYHANXXXXXXXVDTIMEKNITVTHAQDXXXXXXXXXXXXXXXXXXXXXXXXSVAGWLLGNPLCDEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFESNGNFITPEYAYKIXXXXXXXXXXXXXXXXXXXXXXXXXXXXXXXXXXXXXPLHNIHPLTIGECPRYVKSXXXXXXXXXXXXXXXXXXXXXXXXKRRKKRGLFGAIAGXXXXXXXXXXXXXXXXXXXXXXQGSGYAADRESTQKAXXXXXXXXXXXXXXXXXXXXXXXXXXXXXXXXXXXXXXXXXXXXXDVWTYNAEILVLMENERXXXFHDSNVKNLYEKVRHQLRDNAKELGXGCFEFYHKCDDXXXXXXXXXXXXXXXXXXXXXXXXXXXXXXXXXXXXXXXXLSIYSTVTSSLXXXXXXXXXXXXXXXXXXLWMCSNGSYNAXFAFKFVSSDCSX

SEQ ID NO: 419903 - protein, 608 aa, Influenza virus
  MOD_RES (1)..(18): Any amino acid
  MOD_RES (30)..(39): Any amino acid
  MOD_RES (51)..(80): Any amino acid
  MOD_RES (92)..(267): Any amino acid
  MOD_RES (283)..(319): Any amino acid
  MOD_RES (339)..(366): Any amino acid
  MOD_RES (378)..(398): Any amino acid
  MOD_RES (410)..(458): Any amino acid
  MOD_RES (470)..(478): Any amino acid
  MOD_RES (505)..(555): Any amino acid
  MOD_RES (567)..(584): Any amino acid
  MOD_RES (596)..(596): Any amino acid
  MOD_RES (608)..(608): Any amino acid
XXXXXXXXXXXXXXXXXXSDQICVGYHANXXXXXXXXXXIMEKNVAVTHAXXXXXXXXXXXXXXXXXXXXXXXXXXXXXXWLLGNPTCDEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXESNGNFIAPENAYKIXXXXXXXXXXXXXXXXXXXXXXXXXXXXXXXXXXXXXPFHNVHPLAIGECPKYVKSXXXXXXXXXXXXXXXXXXXXXXXXXXXXTRGLFGAIAGFXXXXXXXXXXXXXXXXXXXXXQGSGYAADRKSXXXXXXXXXXXXXXXXXXXXXXXXXXXXXXXXXXXXXXXXXXXXXXXXXDIWTYNAELLVXXXXXXXXXFHDSNVKNLYNKVRLQLRDNARELGNXXXXXXXXXXXXXXXXXXXXXXXXXXXXXXXXXXXXXXXXXXXXXXXXXXXLSLYSTVASSLXXXXXXXXXXXXXXXXXXLWMCSHGSLQCXVCIKFVSSDCSX

SEQ ID NO: 419904 - protein, 608 aa, Influenza virus
  MOD_RES (1)..(21): Any amino acid
  MOD_RES (36)..(39): Any amino acid
  MOD_RES (53)..(324): Any amino acid
  MOD_RES (336)..(366): Any amino acid
  MOD_RES (378)..(399): Any amino acid
  MOD_RES (411)..(563): Any amino acid
  MOD_RES (577)..(586): Any amino acid
  MOD_RES (600)..(608): Any amino acid
XXXXXXXXXXXXXXXXXXXXXDQICIGYHANNSTEXXXXIIEKNVTVTHAKDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHPFTIGECPRYXXXXXXXXXXXXXXXXXXXXXXXXXXXXXXXRRGLFGAIAGFXXXXXXXXXXXXXXXXXXXXXXGSGYAADKESSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPSTGNHGSLVLXXXXXXXXXXMCSNGSLQCRVCIXXXXXXXXX

SEQ ID NO: 419905 - protein, 608 aa, Influenza virus
  MOD_RES (1)..(21): Any amino acid
  MOD_RES (36)..(367): Any amino acid
  MOD_RES (382)..(401): Any amino acid
  MOD_RES (414)..(608): Any amino acid
XXXXXXXXXXXXXXXXXXXXXDHICIGYHANNSTKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRGLFGAIAGFIEGXXXXXXXXXXXXXXXXXXXXGYAADKESTQRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419906 - protein, 608 aa, Influenza virus
  MOD_RES (1)..(21): Any amino acid
  MOD_RES (36)..(608): Any amino acid
XXXXXXXXXXXXXXXXXXXXXDRICIGYHANNSTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419907 - protein, 608 aa, Influenza virus
  MOD_RES (1)..(21): Any amino acid
  MOD_RES (36)..(608): Any amino acid
XXXXXXXXXXXXXXXXXXXXXDQICVGYHANNSTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419908 - protein, 608 aa, Influenza virus
  MOD_RES (1)..(23): Any amino acid
  MOD_RES (36)..(608): Any amino acid
XXXXXXXXXXXXXXXXXXXXXXXICIGYHANKSTKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419909 - protein, 599 aa, Influenza virus
  MOD_RES (14)..(18): Any amino acid
  MOD_RES (57)..(68): Any amino acid
  MOD_RES (92)..(92): Any amino acid
  MOD_RES (104)..(118): Any amino acid
  MOD_RES (130)..(135): Any amino acid
  MOD_RES (147)..(217): Any amino acid
  MOD_RES (232)..(261): Any amino acid
  MOD_RES (279)..(298): Any amino acid
  MOD_RES (336)..(348): Any amino acid
  MOD_RES (431)..(432): Any amino acid
  MOD_RES (507)..(541): Any amino acid
ICQMEKIVLLFAIXXXXXSDQICIGYHANANNSTEQVDTIMEKNVTVTHAQDILEKXXXXXXXXXXXXKPLILRDCSVAGWLLGNPMCDEFXNVPEWSYIVEKXXXXXXXXXXXXXXXYEELKHLLSRIXXXXXXADHPPKVAWSSXXXXXXXXXXXXXXXXXXXXXXXXXXXXXXXXXXXXXXXXXXXXXXXXXXXXXXXXXXXXXXXXXXXXXXXTYISVGTSTLNQRLXXXXXXXXXXXXXXXXXXXXXXXXXXXXXXNFESNGNFIAPEYAYKIXXXXXXXXXXXXXXXXXXXXPSVKLPMGAINAINSSMPFHNIHPLTIGECPKYVKSNXXXXXXXXXXXXXREREGGRRRKRGLFGAIAGFFIEGGWQGMVDGWYGYHHSNEQGSGYAADKESTQKAIDGVTNKVNSIIDKMNTQFEAVGREFXXLERRIENLNKKMEDGFLDVWTYNAELLVLMENERTLDFHDSNVKNLYDKVRLQLRDNAKELGNGCFEFYHKCDNXXXXXXXXXXXXXXXXXXXXXXXXXXXXXXXXXXXGTYQILSIYSTVASSLALAIHGSLVLSLWMCGLSLWMCSNGSLQCRICIRFVNSDCSK

SEQ ID NO: 419910 - protein, 599 aa, Influenza virus
  MOD_RES (14)..(18): Any amino acid
  MOD_RES (57)..(68): Any amino acid
  MOD_RES (92)..(92): Any amino acid
  MOD_RES (104)..(118): Any amino acid
  MOD_RES (130)..(217): Any amino acid
  MOD_RES (232)..(261): Any amino acid
  MOD_RES (279)..(305): Any amino acid
  MOD_RES (336)..(355): Any amino acid
  MOD_RES (403)..(403): Any amino acid
  MOD_RES (426)..(432): Any amino acid
  MOD_RES (461)..(465): Any amino acid
  MOD_RES (507)..(541): Any amino acid
  MOD_RES (562)..(571): Any amino acid
  MOD_RES (587)..(587): Any amino acid
  MOD_RES (599)..(599): Any amino acid
SVKMEKIVLLLATXXXXXSDHICIGYHANANNSTKQVDTIMERNVTVTHAQDILERXXXXXXXXXXXXKPLILKDCSVAGWLLGNPLCDEFXNVSEWSYIVEKXXXXXXXXXXXXXXXYEELKHLMSSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYISIGTSTLNQRLXXXXXXXXXXXXXXXXXXXXXXXXXXXXXXHFESNGNFIAPENAYKIXXXXXXXXXXXXXXXXXXXXXXXXXXXGAIGAIDSSMPFHNVHPLTIGECPKYVKSDXXXXXXXXXXXXXXXXXXXXRKKRGLFGAIAGGFIEGGWQGMVDGWYGFHHSNGQGSGYAADKESSQXAIDGITNKVNSIIDKMNTRFEAXXXXXXXLEKRIENLNKKMEDGFLNVWTYNAELLVXXXXXRTLDFHDSNVRNLYDKVRLQLKDNAKELGNGCFEFYHRCDNXXXXXXXXXXXXXXXXXXXXXXXXXXXXXXXXXXXGIYQILSIYSTAASSLALAIXXXXXXXXXXAGLSLWMCSNGSYNAXFAFKFVSSDCSX

SEQ ID NO: 419911 - protein, 599 aa, Influenza virus
  MOD_RES (1)..(2): Any amino acid
  MOD_RES (14)..(18): Any amino acid
  MOD_RES (56)..(68): Any amino acid
  MOD_RES (92)..(92): Any amino acid
  MOD_RES (104)..(118): Any amino acid
  MOD_RES (130)..(217): Any amino acid
  MOD_RES (232)..(261): Any amino acid
  MOD_RES (279)..(308): Any amino acid
  MOD_RES (336)..(355): Any amino acid
  MOD_RES (431)..(432): Any amino acid
  MOD_RES (452)..(469): Any amino acid
  MOD_RES (491)..(494): Any amino acid
  MOD_RES (507)..(541): Any amino acid
  MOD_RES (562)..(571): Any amino acid
  MOD_RES (599)..(599): Any amino acid
XXKMEKIVLLLAIXXXXXGDQICIGYHANANNSTVQVDTIMEKNITVTHAQDILEXXXXXXXXXXXXXRPLILRDCSVAGWLLGNPMCDKFXDVPEWSYIVEKXXXXXXXXXXXXXXXYEELKHLLSSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYVSVGTSTLNQRSXXXXXXXXXXXXXXXXXXXXXXXXXXXXXXSFESNGNFIAPEYAYIVXXXXXXXXXXXXXXXXXXXXXXXXXXXXXXGAINSSMPFHNVHPLTIGKCPKYVKSNXXXXXXXXXXXXXXXXXXXXRKRGLFGAIAGAGFIEGGWQGMIDGWYGYHHSNEQGSGYAADQESTQKAIDGITNKINSIIDKMNTQFETVGKEFXXLERRIESLNKKMEDGFLDIXXXXXXXXXXXXXXXXXXFHDSNVKNLYEKVRLQLRDNAXXXXNGCFEFYHKCNNXXXXXXXXXXXXXXXXXXXXXXXXXXXXXXXXXXXVTYQILSIYSTVVSSLALAIXXXXXXXXXXAGLFLWMCSNGSLQCKICIKICESRLRX

SEQ ID NO: 419912 - protein, 599 aa, Influenza virus
  MOD_RES (1)..(18): Any amino acid
  MOD_RES (57)..(68): Any amino acid
  MOD_RES (80)..(92): Any amino acid
  MOD_RES (104)..(118): Any amino acid
  MOD_RES (130)..(217): Any amino acid
  MOD_RES (231)..(261): Any amino acid
  MOD_RES (279)..(308): Any amino acid
  MOD_RES (324)..(324): Any amino acid
  MOD_RES (336)..(357): Any amino acid
  MOD_RES (431)..(432): Any amino acid
  MOD_RES (453)..(470): Any amino acid
  MOD_RES (492)..(495): Any amino acid
  MOD_RES (507)..(541): Any amino acid
  MOD_RES (599)..(599): Any amino acid
XXXXXXXXXXXXXXXXXXSDQICVGYHANANNSTERVDTIMEKNVTVTHAKDILEKXXXXXXXXXXXXRPLILKDCSVAXXXXXXXXXXXXXKVPEWSYIVEKXXXXXXXXXXXXXXXYEELKHLLNRIXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYVSIGTSTLNQRXXXXXXXXXXXXXXXXXXXXXXXXXXXXXXXNFDSNGNFIAPEYAYKVXXXXXXXXXXXXXXXXXXXXXXXXXXXXXXGAVNSSMPFHNIHPFXIGECPKYVKSSXXXXXXXXXXXXXXXXXXXXXXKKRGLFGAIAGFIEGGWQGMVDGWYGYHHNNEQGSGYAADRESTQKAINGVTNKVNSIINKMNTQFEAVGKEFXXLERRIENLNRKMEDGFLDVWXXXXXXXXXXXXXXXXXXHDSNVKNLYDRVRLQLRDNAKXXXXGCFEFYHKCDDXXXXXXXXXXXXXXXXXXXXXXXXXXXXXXXXXXXGVYQILSIYSTVTSSLSTGNHGSLVLSLWMAGLSFWMCSNGSLQCRVCIKFVSSDCSX

SEQ ID NO: 419913 - protein, 599 aa, Influenza virus
  MOD_RES (1)..(21): Any amino acid
  MOD_RES (57)..(68): Any amino acid
  MOD_RES (83)..(92): Any amino acid
  MOD_RES (104)..(118): Any amino acid
  MOD_RES (130)..(217): Any amino acid
  MOD_RES (232)..(261): Any amino acid
  MOD_RES (279)..(308): Any amino acid
  MOD_RES (336)..(357): Any amino acid
  MOD_RES (369)..(377): Any amino acid
  MOD_RES (431)..(433): Any amino acid
  MOD_RES (448)..(480): Any amino acid
  MOD_RES (493)..(541): Any amino acid
  MOD_RES (562)..(571): Any amino acid
  MOD_RES (590)..(599): Any amino acid
XXXXXXXXXXXXXXXXXXXXXDQICIGYHANNSTEHVDTIMEKNVTVTHAQNILEKXXXXXXXXXXXXRPLILKDCSIAGWLXXXXXXXXXXKVQEWSYIVEKXXXXXXXXXXXXXXXYEELKHLLSRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXTHISVGTSTLNLRLXXXXXXXXXXXXXXXXXXXXXXXXXXXXXXNFESNGNFITPEYAYKIXXXXXXXXXXXXXXXXXXXXXXXXXXXXXXGAINSSMPLHNIHPLTIGECPKYVKSTXXXXXXXXXXXXXXXXXXXXXXRKRGLFGAIAGXXXXXXXXXVDGWYGYHHSKEQGSGYAADKESTQRAIDGVTNKVNSIIGKMNTQFEAIGREFXXXERRVENLNKKMEDGXXXXXXXXXXXXXXXXXXXXXXXXXXXXXXXXXKIRLQLRDNAKEXXXXXXXXXXXXXXXXXXXXXXXXXXXXXXXXXXXXXXXXXXXXXXXXXGTYQILSLYSTVASSLVLAIXXXXXXXXXXAGLLLWMCSNGSLQCRIAXXXXXXXXXX

SEQ ID NO: 419914 - protein, 599 aa, Influenza virus
  MOD_RES (1)..(21): Any amino acid
  MOD_RES (36)..(220): Any amino acid
  MOD_RES (232)..(263): Any amino acid
  MOD_RES (275)..(308): Any amino acid
  MOD_RES (331)..(358): Any amino acid
  MOD_RES (370)..(399): Any amino acid
  MOD_RES (416)..(417): Any amino acid
  MOD_RES (431)..(549): Any amino acid
  MOD_RES (562)..(571): Any amino acid
  MOD_RES (591)..(599): Any amino acid
XXXXXXXXXXXXXXXXXXXXXDHICIGYHANNSTKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSVGTSTLNQRMXXXXXXXXXXXXXXXXXXXXXXXXXXXXXXXXESDGNFIAPENXXXXXXXXXXXXXXXXXXXXXXXXXXXXXXXXXXGAINTSMPFHNIHPLTIGKCPKXXXXXXXXXXXXXXXXXXXXXXXXXXXXTRGLFGAIAGFXXXXXXXXXXXXXXXXXXXXXXXXXXXXXXSTQKAMDGVTNKVNSIXXKMNIQFEAVGREFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYSTVASSLTLAIXXXXXXXXXXAGLSLWMCFNGSLQCRICIXXXXXXXXX

SEQ ID NO: 419915 - protein, 599 aa, Influenza virus
  MOD_RES (1)..(21): Any amino acid
  MOD_RES (36)..(311): Any amino acid
  MOD_RES (325)..(358): Any amino acid
  MOD_RES (370)..(554): Any amino acid
  MOD_RES (568)..(575): Any amino acid
  MOD_RES (587)..(599): Any amino acid
XXXXXXXXXXXXXXXXXXXXXDQICVGYHANNSTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSSMPFHNIHPHTXXXXXXXXXXXXXXXXXXXXXXXXXXXXXXXXXXRRGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPSTGNHGSLVLXXXXXXXXLWMCSHGSLQCXXXXXXXXXXXXX

SEQ ID NO: 419916 - protein, 599 aa, Influenza virus
  MOD_RES (1)..(24): Any amino acid
  MOD_RES (36)..(599): Any amino acid
XXXXXXXXXXXXXXXXXXXXXXXXCIGYHANNSTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419917 - protein, 500 aa, Influenza virus
  MOD_RES (32)..(41): Any amino acid
  MOD_RES (56)..(74): Any amino acid
  MOD_RES (86)..(118): Any amino acid
  MOD_RES (136)..(137): Any amino acid
  MOD_RES (182)..(182): Any amino acid
  MOD_RES (228)..(241): Any amino acid
  MOD_RES (266)..(271): Any amino acid
  MOD_RES (291)..(292): Any amino acid
  MOD_RES (309)..(310): Any amino acid
  MOD_RES (330)..(336): Any amino acid
  MOD_RES (351)..(372): Any amino acid
  MOD_RES (387)..(388): Any amino acid
  MOD_RES (403)..(417): Any amino acid
  MOD_RES (456)..(457): Any amino acid
  MOD_RES (472)..(472): Any amino acid
LVFREQKQEFKMNPNKKIITIITIGSICMVTXXXXXXXXXXNLDLNMGQPFYSHRXXXXXXXXXXXXXXXXXXXYENNTWVNQTYXXXXXXXXXXXXXXXXXXXXXXXXXXXXXXXXXYSKDNSIRIGSKGDVFVXXEPFISCSHLECRTFFLTQGALLNDKHSNGTVKDRSPHRTLMSCPXGEAPSPYNSRFESVAWSASACHDGTSWLTIGISGPDNGAVAVLKYXXXXXXXXXXXXXXILRTQESECACVNGSCFTVMTDGPXXXXXXYKYKIFKNGKKGKWLNQSKXXAPNYHYEECSCYPDAGXXTCVCRDNWHGSNRPWVSFNXXXXXXXGYICSGVFGDNPRPXXXXXXXXXXXXXXXXXXXXXXFKYGNGVWIGRTKSXXSRSGFEMIWDPNGWXXXXXXXXXXXXXXXITDWSGYSGSFVQHPELTGLDCIRPCFWVELIRGRPKEXXIWTSGSSISFCGVNXIFLWCKIVTTVGWSWPDGAELPFTIDKS

SEQ ID NO: 419918 - protein, 500 aa, Influenza virus
  MOD_RES (1)..(1): Any amino acid
  MOD_RES (22)..(51): Any amino acid
  MOD_RES (63)..(74): Any amino acid
  MOD_RES (86)..(118): Any amino acid
  MOD_RES (136)..(137): Any amino acid
  MOD_RES (182)..(182): Any amino acid
  MOD_RES (228)..(241): Any amino acid
  MOD_RES (254)..(254): Any amino acid
  MOD_RES (266)..(279): Any amino acid
  MOD_RES (291)..(292): Any amino acid
  MOD_RES (309)..(310): Any amino acid
  MOD_RES (330)..(336): Any amino acid
  MOD_RES (351)..(372): Any amino acid
  MOD_RES (385)..(388): Any amino acid
  MOD_RES (403)..(417): Any amino acid
  MOD_RES (456)..(457): Any amino acid
  MOD_RES (472)..(484): Any amino acid
  MOD_RES (496)..(500): Any amino acid
XGLREQKQEFKMNPNQKIITIXXXXXXXXXXXXXXXXXXXXXXXXXXXXXXGPSHSIHTGNQXXXXXXXXXXXXYENNTWVNQTFXXXXXXXXXXXXXXXXXXXXXXXXXXXXXXXXXHSKDNSIRIGSRGDVFVXXEPFISCSHMECRTFFLTQGSLLNDKHSNGTIKDRSPYRTLMSCPXGEAPSPYNSKFESVAWSASACHDGISWLTIGVSGPDNGAVAVVKYXXXXXXXXXXXXXXIMRTQESECACVXGSCFTIMTDGPXXXXXXXXXXXXXXGKRGKWVKSVQXXAPDYHYEECSCYPNAGXXICVCRDNWHGSNRPWISFNXXXXXXXGYICSGIFGDNPRPXXXXXXXXXXXXXXXXXXXXXXFRYGNGVWIGRTXXXXSRSGFEMVWDPNGWXXXXXXXXXXXXXXXLTDWSGYSGSFIQHPELTGLNCIRPCFWVELVRGRPKEXXVWTSGSSISFCGVSXXXXXXXXXXXXXWSWPDDAELPFXXXXX

SEQ ID NO: 419919 - protein, 500 aa, Influenza virus
  MOD_RES (1)..(1): Any amino acid
  MOD_RES (22)..(74): Any amino acid
  MOD_RES (86)..(118): Any amino acid
  MOD_RES (136)..(137): Any amino acid
  MOD_RES (182)..(182): Any amino acid
  MOD_RES (196)..(196): Any amino acid
  MOD_RES (228)..(241): Any amino acid
  MOD_RES (266)..(292): Any amino acid
  MOD_RES (309)..(310): Any amino acid
  MOD_RES (330)..(336): Any amino acid
  MOD_RES (351)..(372): Any amino acid
  MOD_RES (387)..(388): Any amino acid
  MOD_RES (402)..(417): Any amino acid
  MOD_RES (456)..(457): Any amino acid
  MOD_RES (472)..(484): Any amino acid
  MOD_RES (496)..(500): Any amino acid
XFSGSQKQEFKMNPNQKIMTIXXXXXXXXXXXXXXXXXXXXXXXXXXXXXXXXXXXXXXXXXXXXXXXXXXXXXYKNNTWVNQTYXXXXXXXXXXXXXXXXXXXXXXXXXXXXXXXXXYSKDNGIRIGSKGDVFAXXEPFISCSHSECRTFFLTQGALLNDKHSNETVKDRSPHRALMSCPXGEVPSPYNSRFESXAWSASACHDGSSWLTIGISGPDSGAVAVLKYXXXXXXXXXXXXXXTLRTQESECACINGFCFTVMTDGPXXXXXXXXXXXXXXXXXXXXXXXXXXXAPNYYYEECSCYPDASXXMCVCRDNWHGSNRPWLSFNXXXXXXXGYICSGVFGDTPRPXXXXXXXXXXXXXXXXXXXXXXFKYGDGVWIGRTKSXXSRSGFEIIWDPNGXXXXXXXXXXXXXXXXTTDWSGYSGSFVQHPEMTGLDCMRPCFWVELIRGQPKEXXVWTSGSIISFCGVNXXXXXXXXXXXXXWSWPDGAELPSXXXXX

SEQ ID NO: 419920 - protein, 500 aa, Influenza virus
  MOD_RES (1)..(5): Any amino acid
  MOD_RES (32)..(74): Any amino acid
  MOD_RES (86)..(118): Any amino acid
  MOD_RES (135)..(137): Any amino acid
  MOD_RES (168)..(168): Any amino acid
  MOD_RES (180)..(182): Any amino acid
  MOD_RES (195)..(197): Any amino acid
  MOD_RES (228)..(241): Any amino acid
  MOD_RES (266)..(292): Any amino acid
  MOD_RES (309)..(310): Any amino acid
  MOD_RES (330)..(336): Any amino acid
  MOD_RES (351)..(372): Any amino acid
  MOD_RES (387)..(388): Any amino acid
  MOD_RES (403)..(417): Any amino acid
  MOD_RES (456)..(457): Any amino acid
  MOD_RES (472)..(484): Any amino acid
  MOD_RES (496)..(500): Any amino acid
XXXXXQKQEIKMNPNQKIITDITIGSICMVTXXXXXXXXXXXXXXXXXXXXXXXXXXXXXXXXXXXXXXXXXXXYENNTWGNQTYXXXXXXXXXXXXXXXXXXXXXXXXXXXXXXXXXHSKDNNIRIGSKGDVFXXXEPFVSCSHLECRTFSLTHGALLNDKHSNGSXNDRSPHRTLMSXXXGVAPSPYNSRFEXXXWSASACHDGTNWLTIGISGPDNEAVAVLKYXXXXXXXXXXXXXXVLRTQESECACANGYCFTVMTDGPXXXXXXXXXXXXXXXXXXXXXXXXXXXALNYHYEECSCYPDSGXXTCVCRDSWHGSNRPWVSFDXXXXXXXGYICSGVFGDSPRPXXXXXXXXXXXXXXXXXXXXXXFKYGNGAWIGRTKSXXSRRGFEMIWDPDGWXXXXXXXXXXXXXXXITEWSGYSGSFVQHPELTGVDCIKPCFWVELIRGRPEEXXIWASGSSISFCGVDXXXXXXXXXXXXXWSWPDGAEVPFXXXXX

SEQ ID NO: 419921 - protein, 500 aa, Influenza virus
  MOD_RES (1)..(8): Any amino acid
  MOD_RES (21)..(74): Any amino acid
  MOD_RES (86)..(118): Any amino acid
  MOD_RES (136)..(137): Any amino acid
  MOD_RES (182)..(182): Any amino acid
  MOD_RES (194)..(197): Any amino acid
  MOD_RES (220)..(244): Any amino acid
  MOD_RES (266)..(336): Any amino acid
  MOD_RES (351)..(372): Any amino acid
  MOD_RES (384)..(388): Any amino acid
  MOD_RES (400)..(417): Any amino acid
  MOD_RES (449)..(457): Any amino acid
  MOD_RES (469)..(484): Any amino acid
  MOD_RES (496)..(500): Any amino acid
XXXXXXXXEIKMNPNQKIMTXXXXXXXXXXXXXXXXXXXXXXXXXXXXXXXXXXXXXXXXXXXXXXXXXXXXXXNQNSTWVSQTYXXXXXXXXXXXXXXXXXXXXXXXXXXXXXXXXXHSKDNGIRIGSRGDVFIXXAPFISCSYLECRTFFLTHGALLNDKHSNGTAKDRSPQRTLMSCPXGESPSPYNSRFXXXXWSASACHDGASWLIIGISGPDNXXXXXXXXXXXXXXXXXXXXXXXXXTQESECVCVNGSCFTLMTDGPXXXXXXXXXXXXXXXXXXXXXXXXXXXXXXXXXXXXXXXXXXXXXXXXXXXXXXXXXXXXXXXXXXXXXXXGYICSGFFGDNPRPXXXXXXXXXXXXXXXXXXXXXXYKYGNGVWIGRXXXXXSRSGFEMIWDSXXXXXXXXXXXXXXXXXXITNWSGYSGSFVQHPELTGLNCMRPCFWVELXXXXXXXXXIWTSGSIISFCXXXXXXXXXXXXXXXXWSWPDDAELPLXXXXX

SEQ ID NO: 419922 - protein, 500 aa, Influenza virus
  MOD_RES (1)..(18): Any amino acid
  MOD_RES (31)..(142): Any amino acid
  MOD_RES (154)..(162): Any amino acid
  MOD_RES (182)..(207): Any amino acid
  MOD_RES (228)..(375): Any amino acid
  MOD_RES (387)..(389): Any amino acid
  MOD_RES (402)..(441): Any amino acid
  MOD_RES (456)..(489): Any amino acid
XXXXXXXXXXXXXXXXXXIEIITIGSICMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCSQLECRTFFLXXXXXXXXXHSNGTVNDRSPHRSLMSCPXXXXXXXXXXXXXXXXXXXXXXXXXXGWLTIGISGPDDGAVAVLKYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKGVWIGRTKSXXXRSGFEMIWDPDGXXXXXXXXXXXXXXXXXXXXXXXXXXXXXXXXXXXXXXXXPCFWIELIRGRPKEXXXXXXXXXXXXXXXXXXXXXXXXXXXXXXXXXXGAELPFTIDKY

SEQ ID NO: 419923 - protein, 500 aa, Influenza virus
  MOD_RES (1)..(18): Any amino acid
  MOD_RES (31)..(143): Any amino acid
  MOD_RES (155)..(500): Any amino acid
XXXXXXXXXXXXXXXXXXNRDITIGSICMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHLECRTFFLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419924 - protein, 500 aa, Influenza virus
  MOD_RES (1)..(146): Any amino acid
  MOD_RES (158)..(500): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXECKTFFLTQGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419925 - protein, 573 aa, Influenza virus
  MOD_RES (1)..(16): Any amino acid
  MOD_RES (44)..(89): Any amino acid
  MOD_RES (101)..(152): Any amino acid
  MOD_RES (171)..(257): Any amino acid
  MOD_RES (274)..(287): Any amino acid
  MOD_RES (299)..(339): Any amino acid
  MOD_RES (380)..(381): Any amino acid
  MOD_RES (396)..(441): Any amino acid
  MOD_RES (475)..(478): Any amino acid
  MOD_RES (497)..(497): Any amino acid
  MOD_RES (509)..(536): Any amino acid
  MOD_RES (549)..(549): Any amino acid
XXXXXXXXXXXXXXXXDQICIGYHANNSTEQVDTIMEKNVTVTXXXXXXXXXXXXXXXXXXXXXXXXXXXXXXXXXXXXXXXXXXXXXXPEWSYIVEKDNXXXXXXXXXXXXXXXXXXXXXXXXXXXXXXXXXXXXXXXXXXXXXXXXXXXXYYNGRSSFFRNVVWLIKKXXXXXXXXXXXXXXXXXXXXXXXXXXXXXXXXXXXXXXXXXXXXXXXXXXXXXXXXXXXXXXXXXXXXXXXXXXXXXXXXXXXXXXXFESNGNFIAPEYAYKIXXXXXXXXXXXXXXYGNCDTKCQTPXXXXXXXXXXXXXXXXXXXXXXXXXXXXXXXXXXXXXXXXXRKRKRKTRGLFGAIFGAIAGFIEGGWQGMVDGWYGYHHSNXXGSGYAADKESTQKAXXXXXXXXXXXXXXXXXXXXXXXXXXXXXXXXXXXXXXXXXXXXXXVWTYNAELLVLMENERTLDFHDSNVKNLYDKVRXXXXDNAKELGNGCFEFYHKCDXECMESVRNGTYXXXXXXXXXXXXXXXXXXXXXXXXXXXXILSIYSTVASSLXLAIMIAGLSFWMCSNGSLQCRICI

SEQ ID NO: 419926 - protein, 573 aa, Influenza virus
  MOD_RES (1)..(16): Any amino acid
  MOD_RES (44)..(89): Any amino acid
  MOD_RES (101)..(152): Any amino acid
  MOD_RES (171)..(257): Any amino acid
  MOD_RES (274)..(287): Any amino acid
  MOD_RES (299)..(344): Any amino acid
  MOD_RES (380)..(381): Any amino acid
  MOD_RES (396)..(441): Any amino acid
  MOD_RES (472)..(478): Any amino acid
  MOD_RES (497)..(497): Any amino acid
  MOD_RES (509)..(536): Any amino acid
  MOD_RES (549)..(549): Any amino acid
  MOD_RES (568)..(573): Any amino acid
XXXXXXXXXXXXXXXXDRICIGYHANNSKKQIDTIMERNVTVTXXXXXXXXXXXXXXXXXXXXXXXXXXXXXXXXXXXXXXXXXXXXXXPEWSYIVEKDSXXXXXXXXXXXXXXXXXXXXXXXXXXXXXXXXXXXXXXXXXXXXXXXXXXXXYHTGRSSFFRNVVWLTKKXXXXXXXXXXXXXXXXXXXXXXXXXXXXXXXXXXXXXXXXXXXXXXXXXXXXXXXXXXXXXXXXXXXXXXXXXXXXXXXXXXXXXXXFESTGNFIAPEYAYRIXXXXXXXXXXXXXXYGNCNTKCQTPXXXXXXXXXXXXXXXXXXXXXXXXXXXXXXXXXXXXXXXXXXXXXXEKRRKKRGLFGAIAGFIEGGWQGLVDGWYGYHHINXXGSGYAADKKSTQKAXXXXXXXXXXXXXXXXXXXXXXXXXXXXXXXXXXXXXXXXXXXXXXVWTYNAELFVLMENERTLDLHDSNVKNLYDXXXXXXXDNARELGNGCFEFYHRCDXECMESVKNGTYXXXXXXXXXXXXXXXXXXXXXXXXXXXXILSIYSTVVSSLXLAIMVAGLSFWMCSNGSIXXXXXX

SEQ ID NO: 419927 - protein, 573 aa, Influenza virus
  MOD_RES (1)..(16): Any amino acid
  MOD_RES (44)..(89): Any amino acid
  MOD_RES (101)..(158): Any amino acid
  MOD_RES (171)..(260): Any amino acid
  MOD_RES (274)..(287): Any amino acid
  MOD_RES (299)..(344): Any amino acid
  MOD_RES (357)..(358): Any amino acid
  MOD_RES (380)..(381): Any amino acid
  MOD_RES (396)..(441): Any amino acid
  MOD_RES (475)..(478): Any amino acid
  MOD_RES (497)..(497): Any amino acid
  MOD_RES (509)..(536): Any amino acid
  MOD_RES (549)..(549): Any amino acid
  MOD_RES (570)..(573): Any amino acid
XXXXXXXXXXXXXXXXDRICVGYHANNSTKQVDTIIEKNVTVTXXXXXXXXXXXXXXXXXXXXXXXXXXXXXXXXXXXXXXXXXXXXXXPEWSYIVEKNNXXXXXXXXXXXXXXXXXXXXXXXXXXXXXXXXXXXXXXXXXXXXXXXXXXXXXXXXXXSFFRNVVWLVKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGNFIAPEYAFKIXXXXXXXXXXXXXXYGNCNAKCQTPXXXXXXXXXXXXXXXXXXXXXXXXXXXXXXXXXXXXXXXXXXXXXXERRRKKRGLFGAXXGFIEGGWQGMIDGWYGYHHSNXXGSGYAADRKSTQKAXXXXXXXXXXXXXXXXXXXXXXXXXXXXXXXXXXXXXXXXXXXXXXVWTYNTELLVLMENEITLDFHDSNVRNLYDKVRXXXXDNAKEMGNGCFEFYHKCNXKCMESVRNGTYXXXXXXXXXXXXXXXXXXXXXXXXXXXXILSIYSSVASSLXLAIMMAGLSFWMCSNGPLQCXXXX

SEQ ID NO: 419928 - protein, 573 aa, Influenza virus
  MOD_RES (1)..(16): Any amino acid
  MOD_RES (44)..(89): Any amino acid
  MOD_RES (101)..(158): Any amino acid
  MOD_RES (171)..(287): Any amino acid
  MOD_RES (299)..(348): Any amino acid
  MOD_RES (361)..(368): Any amino acid
  MOD_RES (380)..(381): Any amino acid
  MOD_RES (393)..(442): Any amino acid
  MOD_RES (475)..(478): Any amino acid
  MOD_RES (490)..(497): Any amino acid
  MOD_RES (509)..(536): Any amino acid
  MOD_RES (549)..(549): Any amino acid
XXXXXXXXXXXXXXXXDQICIGHHANNSTEQVDTTMEKNVTVTXXXXXXXXXXXXXXXXXXXXXXXXXXXXXXXXXXXXXXXXXXXXXXPEWSYIVEKDKXXXXXXXXXXXXXXXXXXXXXXXXXXXXXXXXXXXXXXXXXXXXXXXXXXXXXXXXXXSFYRNVVWLIKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYGNCDAKCQTPXXXXXXXXXXXXXXXXXXXXXXXXXXXXXXXXXXXXXXXXXXXXXXXXXXETRGLFGAIAGFXXXXXXXXVDGWYGYHHTNXXGSGYAADKASTXXXXXXXXXXXXXXXXXXXXXXXXXXXXXXXXXXXXXXXXXXXXXXXXXXWTYNAELLVLIENERTLDLHDSNVKNLYNKVRXXXXNNAKELGNGCFXXXXXXXXVCMESVRNGTYXXXXXXXXXXXXXXXXXXXXXXXXXXXXILSVYSTVASSLXLAIMIAGLFFWMCSNGSLQCTICI

SEQ ID NO: 419929 - protein, 573 aa, Influenza virus
  MOD_RES (1)..(19): Any amino acid
  MOD_RES (44)..(89): Any amino acid
  MOD_RES (101)..(158): Any amino acid
  MOD_RES (171)..(348): Any amino acid
  MOD_RES (360)..(368): Any amino acid
  MOD_RES (380)..(381): Any amino acid
  MOD_RES (396)..(443): Any amino acid
  MOD_RES (472)..(478): Any amino acid
  MOD_RES (495)..(497): Any amino acid
  MOD_RES (509)..(536): Any amino acid
  MOD_RES (549)..(549): Any amino acid
XXXXXXXXXXXXXXXXXXXCIGYHANNSTKQIDTIREKNVTVTXXXXXXXXXXXXXXXXXXXXXXXXXXXXXXXXXXXXXXXXXXXXXXPEWSYIVEKANXXXXXXXXXXXXXXXXXXXXXXXXXXXXXXXXXXXXXXXXXXXXXXXXXXXXXXXXXXSFFRNIVWLIKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTRGLFGAIAGXXXXXXXXXVDGWYGYHHNNXXGGGYAADKESTQRAXXXXXXXXXXXXXXXXXXXXXXXXXXXXXXXXXXXXXXXXXXXXXXXXSYNAELLVLMENERTLYFHDSNVKNLYNXXXXXXXDNAKEWGNGCFEFYHKXXXECIESVRNGTYXXXXXXXXXXXXXXXXXXXXXXXXXXXXILTIYSTVASSLXLAIIIAGLSFWRCSNGSLQCRVCI

SEQ ID NO: 419930 - protein, 573 aa, Influenza virus
  MOD_RES (1)..(24): Any amino acid
  MOD_RES (36)..(348): Any amino acid
  MOD_RES (360)..(382): Any amino acid
  MOD_RES (395)..(444): Any amino acid
  MOD_RES (475)..(480): Any amino acid
  MOD_RES (493)..(553): Any amino acid
  MOD_RES (572)..(573): Any amino acid
XXXXXXXXXXXXXXXXXXXXXXXXANNSPEQVDTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXETKGLFGAIAGXXXXXXXXXXXXXXXXXXXXXXXSGYGEDNESTQKXXXXXXXXXXXXXXXXXXXXXXXXXXXXXXXXXXXXXXXXXXXXXXXXXXYNAEFFVLMENERILDFHDSNVKKLYDRVRXXXXXXANELGNGCFEFYXXXXXXXXXXXXXXXXXXXXXXXXXXXXXXXXXXXXXXXXXXXXXXXXXXXXXXXXXXXXXVAGLSLWMCSNGSLQCRVXX

SEQ ID NO: 419931 - protein, 573 aa, Influenza virus
  MOD_RES (1)..(382): Any amino acid
  MOD_RES (394)..(447): Any amino acid
  MOD_RES (468)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGYAANKESTQXXXXXXXXXXXXXXXXXXXXXXXXXXXXXXXXXXXXXXXXXXXXXXXXXXXXXXEFLVLMENERTLDFHDSNVRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419932 - protein, 573 aa, Influenza virus
  MOD_RES (1)..(384): Any amino acid
  MOD_RES (396)..(450): Any amino acid
  MOD_RES (463)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYAEGQESPPKAXXXXXXXXXXXXXXXXXXXXXXXXXXXXXXXXXXXXXXXXXXXXXXXXXXXXXXXVLMETERTLDFHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419933 - protein, 573 aa, Influenza virus
  MOD_RES (1)..(452): Any amino acid
  MOD_RES (465)..(573): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMVNERTLDFHDSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419934 - protein, 471 aa, Influenza virus
  MOD_RES (1)..(88): Any amino acid
  MOD_RES (113)..(113): Any amino acid
  MOD_RES (126)..(127): Any amino acid
  MOD_RES (142)..(153): Any amino acid
  MOD_RES (199)..(216): Any amino acid
  MOD_RES (235)..(236): Any amino acid
  MOD_RES (248)..(269): Any amino acid
  MOD_RES (283)..(283): Any amino acid
  MOD_RES (315)..(315): Any amino acid
  MOD_RES (334)..(334): Any amino acid
  MOD_RES (346)..(346): Any amino acid
  MOD_RES (358)..(368): Any amino acid
  MOD_RES (383)..(403): Any amino acid
  MOD_RES (416)..(417): Any amino acid
  MOD_RES (436)..(436): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCQITGFAPFSKDNSIRLSAGGXIWVTREPYVSCDXXKCYQFALGQGTTLDXXXXXXXXXXXXPHRTLLMNELGVPFHLGTKQVCIAWSSSSCHDGKAWLHVCVTGDDXXXXXXXXXXXXXXXXXXSWSQNILRTQESECVCINXXCTVVMTDGSASXXXXXXXXXXXXXXXXXXXXXXGSAQHIEECSCYPXSYPNVRCVCRDNWKGSNRPVKLDINMADYSIXSSYVCSGLVGDTPRNDDSXSSSNCRDPNNEXGNPGVKGWAFDXXXXXXXXXXXSKDSRSGYETFRVIXXXXXXXXXXXXXXXXXXXXXNWSGYSGIFSVEXXSCINRCFYVELIRGRPQEXRVWWTSNSIVVFCGTSGTYGTGSWPDGANINFMPX

SEQ ID NO: 419935 - protein, 471 aa, Influenza virus
  MOD_RES (1)..(88): Any amino acid
  MOD_RES (113)..(113): Any amino acid
  MOD_RES (126)..(127): Any amino acid
  MOD_RES (142)..(153): Any amino acid
  MOD_RES (199)..(216): Any amino acid
  MOD_RES (235)..(236): Any amino acid
  MOD_RES (248)..(269): Any amino acid
  MOD_RES (283)..(283): Any amino acid
  MOD_RES (304)..(315): Any amino acid
  MOD_RES (334)..(334): Any amino acid
  MOD_RES (346)..(346): Any amino acid
  MOD_RES (358)..(368): Any amino acid
  MOD_RES (383)..(403): Any amino acid
  MOD_RES (416)..(417): Any amino acid
  MOD_RES (436)..(436): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCQVTGFAPFSKDNSIQLSAGGXIWITREPYVSCDXXRCYQFALGQGTTLNXXXXXXXXXXXXPHRTLLMSELGVPFHLGTRQVCIAWSSSSCYDGKAWLHICVTGDDXXXXXXXXXXXXXXXXXXSWSKNILRTQESECICINXXCAVVMTDGSASXXXXXXXXXXXXXXXXXXXXXXGSAQHVEECSCYPXSYLNVRCVCRDNWMGSNRPVXXXXXXXXXXXXSSYICSGLVGDTPRNNDSXSNSNCKDPNNEXGNSGVKGWAFDXXXXXXXXXXXSKNSRSGYETFRVTXXXXXXXXXXXXXXXXXXXXXNWSGYSGVFSVEXXSCVNRCFYVELIRGRPKEXRVWWTSNSIVAFCGTSGTYGTGSWPDGADINFMPX

SEQ ID NO: 419936 - protein, 471 aa, Influenza virus
  MOD_RES (1)..(88): Any amino acid
  MOD_RES (112)..(114): Any amino acid
  MOD_RES (126)..(130): Any amino acid
  MOD_RES (142)..(153): Any amino acid
  MOD_RES (199)..(216): Any amino acid
  MOD_RES (235)..(236): Any amino acid
  MOD_RES (248)..(269): Any amino acid
  MOD_RES (281)..(287): Any amino acid
  MOD_RES (304)..(315): Any amino acid
  MOD_RES (334)..(334): Any amino acid
  MOD_RES (346)..(346): Any amino acid
  MOD_RES (358)..(368): Any amino acid
  MOD_RES (383)..(403): Any amino acid
  MOD_RES (416)..(417): Any amino acid
  MOD_RES (435)..(436): Any amino acid
  MOD_RES (453)..(456): Any amino acid
  MOD_RES (468)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCQIAGFAPFSKDNSVRLSAGXXXWVTREPYVSCSXXXXXQFPLGQGTTLDXXXXXXXXXXXXSYRTLLMNELGVPFHMGTKQVCMAWSSSSCHDGRAWLHVCITGDDXXXXXXXXXXXXXXXXXXTWSQNILRTQESECVCVNXXCTVIMTDGSASXXXXXXXXXXXXXXXXXXXXXXGNAQHIEECSCXXXXXXXIRCVCRDNWKGSNRPIXXXXXXXXXXXXSRYICSGLVGDTPRNDDGXSNSNCRDPNNEXGSQGVKGWAFDXXXXXXXXXXXSRDSRSGYETFRIIXXXXXXXXXXXXXXXXXXXXXNWSGYSGIFSIEXXGCINRCFYVELTRGRPQXXRVWWTTNSIVVFCGTSXXXXTGSWPDGANIIXXXX

SEQ ID NO: 419937 - protein, 471 aa, Influenza virus
  MOD_RES (1)..(88): Any amino acid
  MOD_RES (101)..(114): Any amino acid
  MOD_RES (126)..(153): Any amino acid
  MOD_RES (199)..(216): Any amino acid
  MOD_RES (235)..(236): Any amino acid
  MOD_RES (248)..(270): Any amino acid
  MOD_RES (282)..(287): Any amino acid
  MOD_RES (302)..(315): Any amino acid
  MOD_RES (334)..(334): Any amino acid
  MOD_RES (346)..(346): Any amino acid
  MOD_RES (358)..(368): Any amino acid
  MOD_RES (383)..(403): Any amino acid
  MOD_RES (416)..(417): Any amino acid
  MOD_RES (429)..(436): Any amino acid
  MOD_RES (448)..(457): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCEITGFAPFXXXXXXXXXXXXXXWVTREPYVSCGXXXXXXXXXXXXXXXXXXXXXXXXXXXXSHRTLLMNELGIPFHLGTKQVCMAWSSSSCHDGNAWLHVCVTGHDXXXXXXXXXXXXXXXXXXSSPQNILRTQESECVCISXXCAVVMTDGNASXXXXXXXXXXXXXXXXXXXXXXXSAQHIEGCSCYXXXXXXVRCICRDNWKGSNRXXXXXXXXXXXXXXSHYVCSGLVGDTPRNDDIXSSSNCKDPNNEXGSPGVKGWAFDXXXXXXXXXXXKEDSRSGYETFKVIXXXXXXXXXXXXXXXXXXXXXNRSGYSGIFSVEXXNCINRCFYVELXXXXXXXXRVWWTSNSIIVXXXXXXXXXXGSWPDGANINLMPX

SEQ ID NO: 419938 - protein, 471 aa, Influenza virus
  MOD_RES (1)..(88): Any amino acid
  MOD_RES (101)..(114): Any amino acid
  MOD_RES (126)..(153): Any amino acid
  MOD_RES (165)..(165): Any amino acid
  MOD_RES (194)..(217): Any amino acid
  MOD_RES (229)..(236): Any amino acid
  MOD_RES (248)..(270): Any amino acid
  MOD_RES (282)..(287): Any amino acid
  MOD_RES (304)..(334): Any amino acid
  MOD_RES (346)..(346): Any amino acid
  MOD_RES (358)..(369): Any amino acid
  MOD_RES (381)..(417): Any amino acid
  MOD_RES (429)..(439): Any amino acid
  MOD_RES (452)..(459): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXKPQCKITGFAPFXXXXXXXXXXXXXXWVTRESYVSCGXXXXXXXXXXXXXXXXXXXXXXXXXXXXPYRTLLMNELGXPFHLGTKQVCVAWSSSSCHDGKAWLHICXXXXXXXXXXXXXXXXXXXXXXXXWSQNILKKQESXXXXXXXXCTVVLTDGSASXXXXXXXXXXXXXXXXXXXXXXXSAQATEECSRYXXXXXXVTCVCRDNWKSSNRPVXXXXXXXXXXXXXXXXXXXXXXXXXXXXXXXSSSNCRDSNNEXENPGVKGWAFDXXXXXXXXXXXXKDSRSGYETFKXXXXXXXXXXXXXXXXXXXXXXXXXXXXXXXXXXXXXHCINRCFYVELXXXXXXXXXXXWTSNSIVVFCATXXXXXXXXWPDGANINFMAX

SEQ ID NO: 419939 - protein, 471 aa, Influenza virus
  MOD_RES (1)..(158): Any amino acid
  MOD_RES (172)..(173): Any amino acid
  MOD_RES (191)..(218): Any amino acid
  MOD_RES (235)..(371): Any amino acid
  MOD_RES (383)..(422): Any amino acid
  MOD_RES (436)..(459): Any amino acid
  MOD_RES (471)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLMTELGVPFHLGTXXVCIAWSRSSCHDGKAWLXXXXXXXXXXXXXXXXXXXXXXXXXXXXSLNILRTQESECVCIDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSRSGYETFRVLXXXXXXXXXXXXXXXXXXXXXXXXXXXXXXXXXXXXXXXXCFYLELIRGRPQEXXXXXXXXXXXXXXXXXXXXXXXXWPDGADINYMPX

SEQ ID NO: 419940 - protein, 471 aa, Influenza virus
  MOD_RES (1)..(182): Any amino acid
  MOD_RES (194)..(471): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCHDGRAWLHICXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419941 - protein, 570 aa, Influenza virus
  MOD_RES (1)..(14): Any amino acid
  MOD_RES (52)..(250): Any amino acid
  MOD_RES (274)..(277): Any amino acid
  MOD_RES (289)..(307): Any amino acid
  MOD_RES (319)..(329): Any amino acid
  MOD_RES (343)..(344): Any amino acid
  MOD_RES (391)..(431): Any amino acid
  MOD_RES (462)..(471): Any amino acid
  MOD_RES (495)..(527): Any amino acid
  MOD_RES (550)..(554): Any amino acid
XXXXXXXXXXXXXXKSDKICIGYHANNSTTQVDTILEKNVTVTHSVELLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGETLNVESNGNLIAPWYAYKXXXXNNNKGAVFKSNXXXXXXXXXXXXXXXXXXXNKTFQNVSPLWXXXXXXXXXXXSLRLATGLRNVPQXXTRGLFGAIAGFIEGGWTGMIDGWYGYHHENSQGSGYAADKESTQKAXXXXXXXXXXXXXXXXXXXXXXXXXXXXXXXXXXXXXXXXXDGFLDVWTYNAELLVLLENERTLDLHDANVXXXXXXXXXXLRDNANDLGNGCFEFWHKCDNECXXXXXXXXXXXXXXXXXXXXXXXXXXXXXXXXXGVYQILAIYSTVSSSLVLVGLIXXXXXWMCSNGSMQCRICIGS

SEQ ID NO: 419942 - protein, 570 aa, Influenza virus
  MOD_RES (1)..(14): Any amino acid
  MOD_RES (52)..(250): Any amino acid
  MOD_RES (274)..(307): Any amino acid
  MOD_RES (319)..(329): Any amino acid
  MOD_RES (343)..(344): Any amino acid
  MOD_RES (391)..(431): Any amino acid
  MOD_RES (462)..(471): Any amino acid
  MOD_RES (490)..(527): Any amino acid
  MOD_RES (547)..(554): Any amino acid
  MOD_RES (566)..(570): Any amino acid
XXXXXXXXXXXXXXRSDKICIGYHANNSTTKVDTILERNVTVTHSVELLESXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRPGETLNVESNGNLVAPWYAYKXXXXXXXXXXXXXXXXXXXXXXXXXXXXXXXXXXNKTFQNISPVWXXXXXXXXXXXSLKLATGLRNVPQXXTRGIFGAIAGFIEGGWTGLIDGWYGYHHENSQGSGYAADRESTQKAXXXXXXXXXXXXXXXXXXXXXXXXXXXXXXXXXXXXXXXXXDGFLNVWTYNAELLVLLEDERTLDMHDANVXXXXXXXXXXLRDNAKDLGNGCFEFWHRXXXXXXXXXXXXXXXXXXXXXXXXXXXXXXXXXXXXXXDVYQILAIYSTISSSLVLMXXXXXXXXWMCSNGSMQCKXXXXX

SEQ ID NO: 419943 - protein, 570 aa, Influenza virus
  MOD_RES (1)..(14): Any amino acid
  MOD_RES (52)..(250): Any amino acid
  MOD_RES (274)..(307): Any amino acid
  MOD_RES (319)..(329): Any amino acid
  MOD_RES (343)..(344): Any amino acid
  MOD_RES (375)..(378): Any amino acid
  MOD_RES (391)..(431): Any amino acid
  MOD_RES (461)..(471): Any amino acid
  MOD_RES (495)..(527): Any amino acid
  MOD_RES (550)..(554): Any amino acid
  MOD_RES (566)..(570): Any amino acid
XXXXXXXXXXXXXXKSDRICIGYHANNSTTQIDTILEKNITVTHSVELLEDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGETLKVESNGNLIAPWYAFRXXXXXXXXXXXXXXXXXXXXXXXXXXXXXXXXXXNKTFQNVSPVWXXXXXXXXXXXSLRLATGLRNIPQXXNRGLFGAIAGFIEGGWTGMVDGWYGYHHENXXXXGYAADRESTQRAXXXXXXXXXXXXXXXXXXXXXXXXXXXXXXXXXXXXXXXXXDGFMDVWTYNAELLILLENERTLDMHDANXXXXXXXXXXXLKDNAKDLGNGCFEFWHKCNNECXXXXXXXXXXXXXXXXXXXXXXXXXXXXXXXXXGIYQILAIYSTVSSSLVLAGLIXXXXXWMCSNGSMQCNXXXXX

SEQ ID NO: 419944 - protein, 570 aa, Influenza virus
  MOD_RES (1)..(14): Any amino acid
  MOD_RES (52)..(250): Any amino acid
  MOD_RES (274)..(307): Any amino acid
  MOD_RES (319)..(329): Any amino acid
  MOD_RES (341)..(344): Any amino acid
  MOD_RES (356)..(378): Any amino acid
  MOD_RES (391)..(431): Any amino acid
  MOD_RES (462)..(471): Any amino acid
  MOD_RES (495)..(527): Any amino acid
  MOD_RES (550)..(554): Any amino acid
  MOD_RES (566)..(570): Any amino acid
XXXXXXXXXXXXXXRSHKICIGYHANNSTTQVNTILEKNVTVTHSIELLENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKPGETLNIESNGNLIAPWYAYRXXXXXXXXXXXXXXXXXXXXXXXXXXXXXXXXXXNKTFQNVSPIWXXXXXXXXXXXNLKLATGLRNVXXXXARGLFGAIAGFXXXXXXXXXXXXXXXXXXXXXXXGYAADKESTQRAXXXXXXXXXXXXXXXXXXXXXXXXXXXXXXXXXXXXXXXXXNGFLDVWTYNAELLVLLENGRTLDMHDANVXXXXXXXXXXLKDNANDLGNGCFEFWHKCDDECXXXXXXXXXXXXXXXXXXXXXXXXXXXXXXXXXGVYQILSIYSTVSSSLVLVGLVXXXXXWMCSNSSMQCRXXXXX

SEQ ID NO: 419945 - protein, 570 aa, Influenza virus
  MOD_RES (1)..(24): Any amino acid
  MOD_RES (52)..(262): Any amino acid
  MOD_RES (274)..(307): Any amino acid
  MOD_RES (319)..(331): Any amino acid
  MOD_RES (343)..(431): Any amino acid
  MOD_RES (445)..(448): Any amino acid
  MOD_RES (461)..(471): Any amino acid
  MOD_RES (495)..(535): Any amino acid
  MOD_RES (550)..(554): Any amino acid
  MOD_RES (566)..(570): Any amino acid
XXXXXXXXXXXXXXXXXXXXXXXXANNSTTQVDTLLEKNVTVTHSIELLESXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNLVAPWYAYRXXXXXXXXXXXXXXXXXXXXXXXXXXXXXXXXXXNRTFQNVSPLWXXXXXXXXXXXXXRLATGLRNVPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGLLDVWTYNAELXXXXENERTLDMHDVNXXXXXXXXXXXLRDNAMILGNGCFEFWHKCDNDCXXXXXXXXXXXXXXXXXXXXXXXXXXXXXXXXXXXXXXXXXYSTVSSGLVLVGLIXXXXXWMCLNGSMQCRXXXXX

SEQ ID NO: 419946 - protein, 570 aa, Influenza virus
  MOD_RES (1)..(31): Any amino acid
  MOD_RES (43)..(433): Any amino acid
  MOD_RES (447)..(448): Any amino acid
  MOD_RES (462)..(537): Any amino acid
  MOD_RES (550)..(570): Any amino acid
XXXXXXXXXXXXXXXXXXXXXXXXXXXXXXXVDTILEKNITVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLGVWTYNAELLVXXENERTLDQHDANVXXXXXXXXXXXXXXXXXXXXXXXXXXXXXXXXXXXXXXXXXXXXXXXXXXXXXXXXXXXXXXXXXXXXXXXXXXXXTISSSLVLVGLIXXXXXXXXXXXXXXXXXXXXX

SEQ ID NO: 419947 - protein, 570 aa, Influenza virus
  MOD_RES (1)..(441): Any amino acid
  MOD_RES (453)..(570): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAEMLVLLENERXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419948 - protein, 619 aa, Influenza virus
  MOD_RES (1)..(1): Any amino acid
  MOD_RES (14)..(23): Any amino acid
  MOD_RES (42)..(49): Any amino acid
  MOD_RES (67)..(93): Any amino acid
  MOD_RES (105)..(170): Any amino acid
  MOD_RES (185)..(275): Any amino acid
  MOD_RES (289)..(341): Any amino acid
  MOD_RES (355)..(356): Any amino acid
  MOD_RES (389)..(393): Any amino acid
  MOD_RES (449)..(465): Any amino acid
  MOD_RES (480)..(489): Any amino acid
  MOD_RES (508)..(513): Any amino acid
  MOD_RES (539)..(539): Any amino acid
  MOD_RES (552)..(571): Any amino acid
  MOD_RES (591)..(602): Any amino acid
  MOD_RES (614)..(619): Any amino acid
XKSRGYKMNTQILXXXXXXXXXXGCDHSDNADKICLGHHAVXXXXXXXXLTERGIEVVNATETVETXXXXXXXXXXXXXXXXXXXXXXXXXXXGPPQCDQFLEFXXXXXXXXXXXXXXXXXXXXXXXXXXXXXXXXXXXXXXXXXXXXXXXXXXXXXXXXXXXXXXXXXXSSSFYAEMKWLLSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNGAFIAPDRASFXXXXXXXXXXXXXXXXXXXXXXXXXXXXXXXXXXXXXXXXXXXXXXXXXXXXXSLLLATGMRNVPEXXTHKQLTHHMRKKRGLFGAIAMTRGLFGAIAGFXXXXXLFGAIAGFIENGWEGLIDGWYGFRHQNAQGEGTAADYKSTQSAIDQITGKLNRLIXXXXXXXXXXXXXXXXXEQQIGNVINWTRDSXXXXXXXXXXLLVAMENQHTIDLADSEMXXXXXXVRKQLRENAEEDGTGCFEIFHKCDDXCMESIRNNTYDHXXXXXXXXXXXXXXXXXXXXSGYKDIILWFSFGASCFLLXXXXXXXXXXXXKNGNMRCTICIXXXXXX

SEQ ID NO: 419949 - protein, 619 aa, Influenza virus
  MOD_RES (1)..(1): Any amino acid
  MOD_RES (14)..(30): Any amino acid
  MOD_RES (42)..(49): Any amino acid
  MOD_RES (67)..(93): Any amino acid
  MOD_RES (105)..(171): Any amino acid
  MOD_RES (185)..(275): Any amino acid
  MOD_RES (289)..(341): Any amino acid
  MOD_RES (355)..(356): Any amino acid
  MOD_RES (388)..(399): Any amino acid
  MOD_RES (447)..(465): Any amino acid
  MOD_RES (480)..(489): Any amino acid
  MOD_RES (508)..(513): Any amino acid
  MOD_RES (539)..(539): Any amino acid
  MOD_RES (552)..(571): Any amino acid
  MOD_RES (591)..(602): Any amino acid
  MOD_RES (614)..(619): Any amino acid
XKSRGYKMNNQILXXXXXXXXXXXXXXXXXGDKICLGHHAVXXXXXXXXLTERGVEVVNATETVERXXXXXXXXXXXXXXXXXXXXXXXXXXXGPPQCDLFLEFXXXXXXXXXXXXXXXXXXXXXXXXXXXXXXXXXXXXXXXXXXXXXXXXXXXXXXXXXXXXXXXXXXXPSFYAEMKWLLSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNGAFIAPDRVSFXXXXXXXXXXXXXXXXXXXXXXXXXXXXXXXXXXXXXXXXXXXXXXXXXXXXXSLLLATGMKNVPEXXAHKQLTHHMRKKRGLFGAKAETRGLFGAIAGXXXXXXXXXXXXGFIENGWEGLVDGWYGFRHQNSQGEGTAADYKSTQSAVDQITGKLNRXXXXXXXXXXXXXXXXXXXEKQIGNVINWTQDAXXXXXXXXXXFLVAVENQHTIDLTDSEMXXXXXXVKKQLRENAEEDGNGCFEIFHQCDNXCMASIRNNTYDHXXXXXXXXXXXXXXXXXXXXSGYKDVILWFSFGASCFILXXXXXXXXXXXXKNGNMQCTICIXXXXXX

SEQ ID NO: 419950 - protein, 619 aa, Influenza virus
  MOD_RES (1)..(1): Any amino acid
  MOD_RES (14)..(49): Any amino acid
  MOD_RES (67)..(93): Any amino acid
  MOD_RES (105)..(171): Any amino acid
  MOD_RES (185)..(275): Any amino acid
  MOD_RES (289)..(341): Any amino acid
  MOD_RES (355)..(356): Any amino acid
  MOD_RES (368)..(375): Any amino acid
  MOD_RES (387)..(400): Any amino acid
  MOD_RES (449)..(465): Any amino acid
  MOD_RES (480)..(489): Any amino acid
  MOD_RES (504)..(513): Any amino acid
  MOD_RES (537)..(539): Any amino acid
  MOD_RES (552)..(571): Any amino acid
  MOD_RES (591)..(602): Any amino acid
  MOD_RES (614)..(619): Any amino acid
XKSRGYKMNTRILXXXXXXXXXXXXXXXXXXXXXXXXXXXXXXXXXXXXLTEKGIEVVNATETVEQXXXXXXXXXXXXXXXXXXXXXXXXXXXGPPQCDRFLEFXXXXXXXXXXXXXXXXXXXXXXXXXXXXXXXXXXXXXXXXXXXXXXXXXXXXXXXXXXXXXXXXXXXSSFYAEMEWLLSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNGAFIAPNRASFXXXXXXXXXXXXXXXXXXXXXXXXXXXXXXXXXXXXXXXXXXXXXXXXXXXXXSLMLATGMKNVPEXXIHKQLTHHMRKXXXXXXXXRMTRGLFGAIAXXXXXXXXXXXXXXFIENGWEGLINGWYGFRHQNAQGEGIAADYKSTQSAINQITGKLNRLIXXXXXXXXXXXXXXXXXERQIGNVINWTRDAXXXXXXXXXXLLIAMENQHTIDLTXXXXXXXXXXVRRQLRENAEEDGTGCFEILHKCXXXCMESIRNNTYNHXXXXXXXXXXXXXXXXXXXXSGYKEVILWFSFGASCLILXXXXXXXXXXXXRNGNMRCTICIXXXXXX

SEQ ID NO: 419951 - protein, 619 aa, Influenza virus
  MOD_RES (1)..(1): Any amino acid
  MOD_RES (14)..(49): Any amino acid
  MOD_RES (67)..(93): Any amino acid
  MOD_RES (105)..(173): Any amino acid
  MOD_RES (185)..(275): Any amino acid
  MOD_RES (289)..(341): Any amino acid
  MOD_RES (355)..(375): Any amino acid
  MOD_RES (387)..(405): Any amino acid
  MOD_RES (426)..(429): Any amino acid
  MOD_RES (449)..(465): Any amino acid
  MOD_RES (480)..(489): Any amino acid
  MOD_RES (504)..(513): Any amino acid
  MOD_RES (526)..(527): Any amino acid
  MOD_RES (539)..(539): Any amino acid
  MOD_RES (552)..(571): Any amino acid
  MOD_RES (591)..(603): Any amino acid
  MOD_RES (617)..(619): Any amino acid
XKSRGYKMNIQILXXXXXXXXXXXXXXXXXXXXXXXXXXXXXXXXXXXXLTERGVEVVDATETVERXXXXXXXXXXXXXXXXXXXXXXXXXXXGPPQCDKFLEFXXXXXXXXXXXXXXXXXXXXXXXXXXXXXXXXXXXXXXXXXXXXXXXXXXXXXXXXXXXXXXXXXXXXXFYAEMKWLLSDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNGAFVAPDRVSFXXXXXXXXXXXXXXXXXXXXXXXXXXXXXXXXXXXXXXXXXXXXXXXXXXXXXSLLLATGMRNIPEXXXXXXXXXXXXXXXXXXXXXRETRGLFGAIAXXXXXXXXXXXXXXXXXXXWEGLIDGWYGYRHQNAQGEGXXXXYKSTQSAIDQVTGKLNRLIXXXXXXXXXXXXXXXXXEKQLGNVINWTRDSXXXXXXXXXXLLVALENQHTIDLAXXXXXXXXXXVKRQLRENAEEDXXGCFEIFHKCDNXCMASIRNSTYDHXXXXXXXXXXXXXXXXXXXXGGYKDIILWFSFGASCFTLXXXXXXXXXXXXXNETCSALFVYSLRXXX

SEQ ID NO: 419952 - protein, 619 aa, Influenza virus
  MOD_RES (1)..(1): Any amino acid
  MOD_RES (14)..(49): Any amino acid
  MOD_RES (67)..(276): Any amino acid
  MOD_RES (289)..(341): Any amino acid
  MOD_RES (353)..(375): Any amino acid
  MOD_RES (388)..(406): Any amino acid
  MOD_RES (428)..(432): Any amino acid
  MOD_RES (449)..(465): Any amino acid
  MOD_RES (477)..(489): Any amino acid
  MOD_RES (504)..(513): Any amino acid
  MOD_RES (528)..(539): Any amino acid
  MOD_RES (552)..(571): Any amino acid
  MOD_RES (591)..(608): Any amino acid
XKSRGYKMNTKILXXXXXXXXXXXXXXXXXXXXXXXXXXXXXXXXXXXXLTGRGIEVVNATETVENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGAFIAPDRATFXXXXXXXXXXXXXXXXXXXXXXXXXXXXXXXXXXXXXXXXXXXXXXXXXXXXXSILLATGMRNVXXXXXXXXXXXXXXXXXXXXXXXRKTRGLFGAIAGXXXXXXXXXXXXXXXXXXXEGLIDGWYGFKHQNAQGEGTAXXXXXTQAAIDQITGKLNHLIXXXXXXXXXXXXXXXXXEKQIGNLINWTXXXXXXXXXXXXXLLVAIENQHTIDLAXXXXXXXXXXVKRLLRENAEEDGTXXXXXXXXXXXXCMASIRNNTYNHXXXXXXXXXXXXXXXXXXXXNGYKDVILWFSFGASCFLFXXXXXXXXXXXXXXXXXXCSALFVYSLRK

SEQ ID NO: 419953 - protein, 619 aa, Influenza virus
  MOD_RES (1)..(342): Any amino acid
  MOD_RES (354)..(375): Any amino acid
  MOD_RES (387)..(411): Any amino acid
  MOD_RES (426)..(437): Any amino acid
  MOD_RES (449)..(494): Any amino acid
  MOD_RES (508)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRLATGMRNVPXXXXXXXXXXXXXXXXXXXXXXQMTRGLFGAIAXXXXXXXXXXXXXXXXXXXXXXXXXGWYGYKHQNAQGEGXXXXXXXXXXXXNQITGKLNRIIXXXXXXXXXXXXXXXXXXXXXXXXXXXXXXXXXXXXXXXXXXXXXXENQHIIDLADSEMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419954 - protein, 619 aa, Influenza virus
  MOD_RES (1)..(343): Any amino acid
  MOD_RES (355)..(377): Any amino acid
  MOD_RES (389)..(494): Any amino acid
  MOD_RES (506)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQATGMKNVPEXXXXXXXXXXXXXXXXXXXXXXXPRGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNQHTIDLADSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419955 - protein, 619 aa, Influenza virus
  MOD_RES (1)..(377): Any amino acid
  MOD_RES (389)..(496): Any amino acid
  MOD_RES (508)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQHTIDQADSEMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419956 - protein, 619 aa, Influenza virus
  MOD_RES (1)..(377): Any amino acid
  MOD_RES (389)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARGLFGAIAGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419957 - protein, 619 aa, Influenza virus
  MOD_RES (1)..(378): Any amino acid
  MOD_RES (397)..(619): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKPRPRRGLFGAIAGFIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 419958 - protein, 573 aa, Influenza virus
  MOD_RES (18)..(22): Any amino acid
  MOD_RES (62)..(78): Any amino acid
  MOD_RES (98)..(99): Any amino acid
  MOD_RES (111)..(122): Any amino acid
  MOD_RES (134)..(138): Any amino acid
  MOD_RES (150)..(155): Any amino acid
  MOD_RES (175)..(205): Any amino acid
  MOD_RES (219)..(234): Any amino acid
  MOD_RES (247)..(255): Any amino acid
  MOD_RES (279)..(300): Any amino acid
  MOD_RES (315)..(316): Any amino acid
  MOD_RES (568)..(573): Any amino acid
SKSRGYKMNTQILILALXXXXXAKGDKICLGHHAVANGTKVNTLTERGIEVVNATETVETAXXXXXXXXXXXXXXXXXCGLLGTLIGPPQCDQFLEFXXDLIIERREGTDXXXXXXXXXXXXLRQILRRSGGIXXXXXGFTYSGIRTNGXXXXXXRSGSSFYAEMKWLLSNSDNXXXXXXXXXXXXXXXXXXXXXXXXXXXXXXXEQTKLYGSGNKLIXXXXXXXXXXXXXXXXARRIDFHWLLLDXXXXXXXXXNDTVTFTFNGAFIAPDRASFFRGXXXXXXXXXXXXXXXXXXXXXXGGTIVSSLPFQNINXXTVGKCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFLLLAIAMGLVFICIKNGNMQCTICIXXXXXX

SEQ ID NO: 419959 - protein, 573 aa, Influenza virus
  MOD_RES (1)..(22): Any amino acid
  MOD_RES (62)..(78): Any amino acid
  MOD_RES (97)..(99): Any amino acid
  MOD_RES (111)..(122): Any amino acid
  MOD_RES (134)..(138): Any amino acid
  MOD_RES (150)..(155): Any amino acid
  MOD_RES (175)..(205): Any amino acid
  MOD_RES (219)..(234): Any amino acid
  MOD_RES (255)..(255): Any amino acid
  MOD_RES (279)..(300): Any amino acid
  MOD_RES (315)..(316): Any amino acid
  MOD_RES (376)..(392): Any amino acid
  MOD_RES (480)..(481): Any amino acid
  MOD_RES (568)..(573): Any amino acid
XXXXXXXXXXXXXXXXXXXXXXVKGDKICLGHHAVSNGTKVNTLTEKGIEVVNATETVERTXXXXXXXXXXXXXXXXXCGLLGTLTGPPQCDQFLEXXXDLIIERREGNDXXXXXXXXXXXXLRQILRGSGGIXXXXXGFTYNGIRTNGXXXXXXRLGSSFYAEMKWLLSSSDNXXXXXXXXXXXXXXXXXXXXXXXXXXXXXXXEQTKLYGNGNKLVXXXXXXXXXXXXXXXXARPQVNGQSGRIDFHWLLLDXNDTVTFSFNGAFIAPDRASFLRGXXXXXXXXXXXXXXXXXXXXXXGGTIISNLPFQNINXXTVGRCPRYVKQTSLLLATGMRNIPENPKKRGLFGAIAGFIENGWEGLVDGWYGFRHQNAXXXXXXXXXXXXXXXXXQITGKLNRLIDKTNQQFELINNEFNEVEQQIGNVINWTQDAMTEVWSYNAELLVALENQHTIDLADSEMNKLYERVRKQLRENAEEDXXGCFEIFHKCDNQCMESIRNNTYNHTQYREEAMQNRIQIDPVKLSGGYKDIILWFSFGASCFILLAIAMGLVFMCVKNGNMRCTICIXXXXXX

SEQ ID NO: 419960 - protein, 573 aa, Influenza virus
  MOD_RES (1)..(22): Any amino acid
  MOD_RES (61)..(78): Any amino acid
  MOD_RES (98)..(99): Any amino acid
  MOD_RES (111)..(122): Any amino acid
  MOD_RES (134)..(138): Any amino acid
  MOD_RES (150)..(155): Any amino acid
  MOD_RES (168)..(205): Any amino acid
  MOD_RES (219)..(234): Any amino acid
  MOD_RES (247)..(255): Any amino acid
  MOD_RES (279)..(300): Any amino acid
  MOD_RES (315)..(316): Any amino acid
  MOD_RES (386)..(392): Any amino acid
  MOD_RES (481)..(482): Any amino acid
  MOD_RES (532)..(536): Any amino acid
  MOD_RES (566)..(573): Any amino acid
XXXXXXXXXXXXXXXXXXXXXXTNADKICLGHHAVSNGTKINTLTERGVEVVNATETVENXXXXXXXXXXXXXXXXXXCGLLGTITGPPQCDKFLEFXXDLIIERREGADXXXXXXXXXXXXLRQILRESGGIXXXXXGFTYSEIRTNGXXXXXXRSGSSFYAELKWXXXXXXXXXXXXXXXXXXXXXXXXXXXXXXXXXXXXXXEQTKLYGSGSKLIXXXXXXXXXXXXXXXXTRRIDFHWLLLEXXXXXXXXXNDTVTFIFNGAFIAPDRASFFKGXXXXXXXXXXXXXXXXXXXXXXGGTIISSLPFQNINXXAVGKCPRYVKQESLLLATGMKNVPEIPKTRGLFGAIAGFIENGWEGLIDGWYGFRHQNTQGEGTAADYKXXXXXXXQITGKLNRLISKTNQQFELIGNEFTEVEKQIGNVINWTRDSMTEVWSYNAELLVAIENQHTIDLADSEMKKLYERVRRQLRENAEEDGXXCFEIFHKCDDHCMESIRNNTYDHSKYREEAMQNRIQIDSVKLSSGYKDIXXXXXFGASCFLLLAVVMGLVFICIKNGNVRCTIXXXXXXXX

SEQ ID NO: 419961 - protein, 573 aa, Influenza virus
  MOD_RES (1)..(22): Any amino acid
  MOD_RES (34)..(38): Any amino acid
  MOD_RES (62)..(78): Any amino acid
  MOD_RES (97)..(99): Any amino acid
  MOD_RES (111)..(122): Any amino acid
  MOD_RES (134)..(138): Any amino acid
  MOD_RES (150)..(155): Any amino acid
  MOD_RES (175)..(207): Any amino acid
  MOD_RES (219)..(234): Any amino acid
  MOD_RES (247)..(255): Any amino acid
  MOD_RES (279)..(300): Any amino acid
  MOD_RES (315)..(316): Any amino acid
  MOD_RES (342)..(342): Any amino acid
  MOD_RES (356)..(392): Any amino acid
  MOD_RES (445)..(446): Any amino acid
  MOD_RES (480)..(482): Any amino acid
  MOD_RES (532)..(537): Any amino acid
  MOD_RES (565)..(573): Any amino acid
XXXXXXXXXXXXXXXXXXXXXXTKGDKICLGHHXXXXXTKVNTLTERGVEVVNATETVETTXXXXXXXXXXXXXXXXXCGLLGILIGPPQCDKFLEXXXDLIIERKEGTDXXXXXXXXXXXXLRQILRKSGGIXXXXXGFIYSGIRTNGXXXXXXRSSSSFYAEMKWLLSNTDNXXXXXXXXXXXXXXXXXXXXXXXXXXXXXXXXXTKLYGSGNKLVXXXXXXXXXXXXXXXXARRIDFHWLFLDXXXXXXXXXNDTVTFNFNGAFIAPNRASFFRGXXXXXXXXXXXXXXXXXXXXXXWGTIVSSLPFQSINXXTVGKCPRYIKQESLMLATGMKNVPEXPKGRGLFGAIAGFXXXXXXXXXXXXXXXXXXXXXXXXXXXXXXXXXXXXXQITGKLNRLIEKTNQQFELIDSEFSEIEQQIGNVINWTRDSITEVWSYNAELXXAMENQHTIDLTDSEMSKLYGRVKRQLRENAEEDXXXCFEIFHKCDDDCMASIRNNTYDHSRYREEAMQNRIQIDQVKLSSGYKDIXXXXXXGASCFLLLAIVMGLVFICVKNGNMRCTXXXXXXXXX

SEQ ID NO: 419962 - protein, 573 aa, Influenza virus
  MOD_RES (1)..(22): Any amino acid
  MOD_RES (35)..(50): Any amino acid
  MOD_RES (62)..(78): Any amino acid
  MOD_RES (98)..(99): Any amino acid
  MOD_RES (111)..(122): Any amino acid
  MOD_RES (134)..(155): Any amino acid
  MOD_RES (175)..(207): Any amino acid
  MOD_RES (219)..(234): Any amino acid
  MOD_RES (247)..(256): Any amino acid
  MOD_RES (270)..(300): Any amino acid
  MOD_RES (312)..(316): Any amino acid
  MOD_RES (345)..(396): Any amino acid
  MOD_RES (425)..(426): Any amino acid
  MOD_RES (442)..(450): Any amino acid
  MOD_RES (470)..(496): Any amino acid
  MOD_RES (567)..(573): Any amino acid
XXXXXXXXXXXXXXXXXXXXXXARGDKICLGHHAXXXXXXXXXXXXXXXXVVNATETVETVXXXXXXXXXXXXXXXXXCGLLGTVTGPPHCDQFLEFXXDLIIERREGSDXXXXXXXXXXXXLRQVLRRSGGIXXXXXXXXXXXXXXXXXXXXXXRLGPSFYAEMKWLLSSTDNXXXXXXXXXXXXXXXXXXXXXXXXXXXXXXXXXTKLYGNGNKLIXXXXXXXXXXXXXXXXARRIDFNWLLLDXXXXXXXXXXDTITFSFNGAFIAXXXXXXXXXXXXXXXXXXXXXXXXXXXXXXXGGTIASNLPFQXXXXXAVGKCPKYVKQESLMLATGMRNVPENPKXXXXXXXXXXXXXXXXXXXXXXXXXXXXXXXXXXXXXXXXXXXXXXXXXXXXKLNHLIGKTNQQFGLIDNEFSEIEQQIGXXINWTRDAMTEVWSYNXXXXXXXXXQHIIDLADSEMSKLYERVRXXXXXXXXXXXXXXXXXXXXXXXXXXXSIRNNTYDHTKYRTESLQNRIQIDSVKLSSGYKDVILWFSFGASCFILLAIVMGLVFICMKNGNMQCTICXXXXXXX
